United States Patent 10,724,096 (METHODS AND COMPOSITIONS FOR INHIBITING AND TREATING NEUROLOGICAL CONDITIONS) - sequence listing, part 112

SEQ ID NO: 2018 - DNA, 859646 bp, Homo sapiens
cttcagaaactgaacatactgatttaattggctaagaagtccaaatgctaatactcctaataattagccattccttttgtgttttggtgacatatatcctcatacaatgtatatcaaatggaattttttgatttacacctgacatttcaaagtttccatttttgaattctcctagtcttaagtaagtagaacattgtctcctttgtttgctaggcataacgttttccccaacatctagggctccatgatgcaaaatatcattttgccgatcttctgttccagtatttactttaattttttttattataattggattttcaaatacaatcacaaaaacatctcctgttgaaggtggtttcccccaaaagtactcatcaacactactgtaagccttgcttgcttcataattttcaaacacattcatgttggtgtacagacttgcaggggggttatcaggaatgtcaaatgactcctcttcaaaatcatcatccttcagcttattctccgtccctttgtatgatgaataatagcccatgtgctgaaagagagatggtttaaaacggatcacatttttctgagccaacagaccacggaaatgagtcaatagccaatcacaaggcatttcttgataaaacattaataaaaaatgggccaaacgtgggagatcatgagaatgatagagtttaccaatgtagccaagcttagagaattcaagagttacccagtaagttccttctagggatgcaatgactttcttgatggcagttaagaaattttttgaacatcgaacatcatcttcaagcattacataatagtctgaagtattggcacaaaaattaagcagaaaagcataatctacattttgcttggaacgaaatttgactctatcttctggatcattgtaatttcttttaaggccatctaggattgggtaatactcctctggagcatgtataaccattaatcttcctgcaataatatggtgcgcaaatttctgtgtaatatcctggaccatggcatcacgccaggaagaattaaagtctgctaggtgaaccaccactgaaatttccttcagctcttcatagctggattgctcaaaaattgacttaattgtctcaagtaaatagtttcctttttttcgctttactgaagaaagtccaattgtaagataccctgcaaaaaagaattcagaagcaatacaaatgtgaactagaaatatggaaaaagtaaaagagagaagatatttattcctttgacttgctacttactacatattaagtaaatctagtaaatgactatgcacagaacattttatgattaaagtaataagctaaatatataaaggctgtaagtgcttaatacataatttatattttctatgaaaaataaatagcaccttaatcacaataatgtatgagccctattgctgtgaacatttactgatgaaattctaaaaacatggtttaaagtgttctgcagcttaatattctcatatacgcccattagagaaggtagacaggtacctagataacatacaagttactttttaaagataaagtaaaaaaaatgctttttctcttttgcaaaaagagaagggcattcacagttaaggctgacaaactagtttcaaatgatacaaaagaaaaataagggtaagtaagtctttcaatcatctttaaattttttatagaacacatcacatattttcagttttcttttttttgctgtcattatgttgtactagaattcgtaattggacttcacaattttatcttgaaatgtacatagtatattaattagaaagcaaacaatattataagacacattcaaaaaactttaatgctacattgttccaagacataagcaccactttaaaaaattttgaaacacactttatagtaattttgcctgaataactttttattcagacatttataatctaaaattaggaattagatatgtttagagaataaaataaaaccctgagaaaagacagctcacctctgagaagggttagaggtctttctattgaaatattttcactttttaaagctcattctgatattaatcagaattgaataacatttctaagccactatttagaaaatggggaaatctatatacaacaagatcatcgttttaatatagcacctgtataatgcggtttgtatgatattgaaaaaagccccattccaaaaacagtttgtcagagagattgtgatttacacatttcgtttaaataccttggcttacaactcagacttctattgaaacacaatatgttatctagtaccattaaacttgaagccaccaaacttcattaataatagccaatgcttatggaatgctgtctacataagaggcaggagtttgggcattttatctgtaatatgcatcttaaatgttcaaaacggtcttttgggataggtttgctattaccatcattctgctttacagatagggacactaagtcacggtgagatgaggtgactcatgcaaggtggtacacttagtaggtgatgctgcaacaggattcaaactgtctcactcttttatcctctgtgttacattgcctctggtagaaagcagttggcatgtgtgccaataaacattagtaaatttagcatgggaaaaggtaatcagtaatgttcaagcaaaggtggtgtaacagagatgaaaaatgaatggcagtcttagacaattagaaagaagcctaagaacagtagacatttcaaatggtagaatgaaaggaaatgagatataaagaaatctaaattaatttaataatttcctcaacctagtgataacaaatacactcacataaacaagtcttaaaagagaggtcaatttttgtggtcttcacataatttattaagatcatgatagcactgtattttattctaagattcatggtttttttgtttttgtttttgtttttttgaaatggagtcttgctctgttgcccaggctggaatgcagtggtgcgaactcagctcactgcagcctccacctcccaggttcaggcgattcttgtgccttggcctcctcagcctcctgagtagctggaattacaggtgtacacgaccatgcctggttaatttttgtacttttagtagagaaggggtttcaccatgttggccaggcttgtcttgaacacctggcctcaagtgatacacttgccttggcctcccaaagtgctgggattacaggcatgagccaccaaacccagcctaagatttatattttacacattgaaacatttaaaaatcaggctgcatactaaaatcaacagcgttataattaaaattggtaatgcttatactttcttagtggtatgctaattagataatggtactttttgtaagctatggtgtcttagaaatatagtatgttacttcttggctccaaatatatttttttaactgactgcagtgtgttgaatagtttcctccaaaaattcatgtctacttggaacctcagaatgtaattttattagtaaatttgatctttgcagatataattagttaaggatcttgagctgcaataattctggatttagatgtggaccataaattcaataacttgtgtccttataaaaagaggaaaagacacagaaagacaaagagaagaaggccattgatgatggaggcaggaattggagtgatgccccaaagtcaaagagtaccagaagcaaagtcaccagaagctgaaaggggcaaggattctcccttagaactttcagagggagtggggacctgccagcaccttgattttaacctctggcttccagaaccacgagagaataaattgctctttttaaaagccagtcactttgtggtaattcgttatggcagacctaggaaactaaaacactgagtttcattaattaaaaagttgtggcaagtcataaaaccaaactgttaagaggttagaaaatgtagcaatatgaacataggaatttttaaaagttaacttctaaattttaaagtaaattgatttttttctagtcactctataccatcctacaacaaaatctcaagagactcacattacgattaggcattttatttaatttttttgttattaagtgtactgggtcagtgagtatagtagttggcaatttgtgaagaaacattgaagttttgcccaaataatttattatattagtaaagcccttaagcctttttactatacatgtgaaactatcattattttaatgcaaaatattttatgtattctttatttaaatgtttaaggatacttacgctttctttgtaaaggtgtggcagctaggtagcgataggtgacatttatggctcctgagaaattagataaatccttgaaagtatgaacatagcgttctgaattcagttgatgtgtggatgtttcccttataagttgtttgtctccttcctaaataccaagaaagaagcaaggaaaatatataaataatagatggtcatggattaaataaagtttcttttttacacaataaatgtacgactacaatatatagtatgcagggttatataaatctcaactactgacgtcataagctgtagctcatcatcactcacctcattttttacctggaggttctgctccagtagctcgctcgcctattttgctgtgtataccacaattacatttgtttttctataggacacattaataatgataatctcttaaaaaaagaatttctacatgaaaactcccactgcctttatgctacttttcaaatttttgacaatcatttaaggatctcaaaattgacagtaatctattttatagtttaatctaaggctagttcccaccatattgcctgatttactcttcctcaagcagtctcaaataaaagatcacacagtgtctccatgattgtgaaactttaggaatgattaggaagatgcagtagtgggcacaatatttggatttttgatactttattaaataagtcacttatgtggctactatctagctgttgagaagggccagttatgggtgctatggcagtaatttttttcatatgtcctaaagtaacctcaaataggatacattagcaccaaattaaggtaatgtgtagatatctatgactaatatttcttatgatagttaagtttgtgtgtgtgtgtgtgtgtgattctattggatgtaatgcccgatccttttatattttagatcccttttatttatttggtgatggattttgcatgtcattaaatcttcaggaaggtttatattcaagaaaacatattcatattcagattaaaatatatcctttacccactaattgcccttctttgatataagctaaatggtaaattttgattatctaatcatcatttgatcaagcctttactggttatacactattaggaaaatgactatttgtttgactcatatgtgatttactagaattggtagaatacatttgagaacaacctaattagaaagaaatatttctctctctctctctttttttttctcaaaatgtgcactctactatgtggttttatttatttatttaatttttttctttgagatggagtctggctctgttgcccaggctggagtgcagtggcatgatctctgctcactataacctccgcctcctaggttcaagccattctcctgcctcagcctcccgagtagctgggattgcaggcacacgccaccatgcccagctaattttagtattttttagtagagatgagtttccgccatgttggccaagctcgtctcaaactcctgacctcaagtgatccactcacctcggcctcccaaagtgctgggattataggtgtgagccagcacacctggccttatgtggatttattttattcagtatagaaagtcaagctaggcatgtgctagctataagactgtagagaaagtaaatggattaaataactctggtcctgctattattttgctgtggtcattaaaaggttaattaaagccttgttctaaaaaattagacaaagctcagatacaagttttacagctgaaacattcaatacttctacttcgcatcaatctcgagtgacaatgaaaaagatgactaactcagattttctaatctatggccagacgtgactattcttagaataaaaactgaaagtagggaccttaactagaggcttccaatatggtccttactaaatcaagattcattctgaatatcttttctgtatatccaagtatgtttataaatccaaatttggtctttaatagtgtatttctctatttcatactgcctttgataatttggaccaagaaatactttagtcctttataaggttcacaatgtgtaaaagtgtggttttgtgtggcttttacacaatgccatgtgtaaaagccacaaactttcaaagtacttgagattaaaccttagatgctaaattacttagaaatatactaattggctatccactgaattctgatgattttaagttctttatacataaatattttcattggtgtttacctgcatacctataaaacatcattaaagtttaaaataaatttagaactgccaaaatgtaactagtgactcagtttagtatcaattattttaatagtaatgtagtgatgtacataattaataatgcctggaagaaatttctgtaaaaagtacagtaattacagcactaaattcattttaccattctattcttaggtgatgttacattctaaggtaagtgcaggatattgaatacctctttaaaaattctatccttaacacataaaatctagaaattttgtgttataagatggagtacattcatcctgatttaaggacataacagaatataaaaagaaatggaacttacatgaaatcactttattaaattctcaggaacaagcttttttatacttttcagcataaataaataatgcaactttcacctgagtcagccttgttggctgctttccagagtcacctacctgaacagccaggctctccctggataccttctttctgtagctactatgctgtagtatatttctcagtaataagacaaagctttatgacaatcattttctggatgggaatgcaattcaatgaactagctgcagactaaatatatacccttgtggctactttgaagatgctcaaagccaagaagctaagttgattgggcatgcagtgtctcttctacttagtttgccttgtaacggtgtttgtctcttacactaagtgcagcttcctttttcacttaaaggcacatatatctctaatacataagcaaatatgctaaactgctaatatgcctagggtttcaggccacaaatggattttctaacaaaaagacgagaatagaatctgttaactaactccagagaccttactacttctaactattcacctgatatctctaagttagaagtactatttcccagtttttaaaaaaggaagacaaaaaagaaagatctactaatatctgtgcgtagcaaattgcatacattgtgataatcgggaagaaagaagaaaaatgagttcagataattttattaaaaaagaaataaacacaggtaaaaagatcaaaagggagatgtgttaaaaagaaattgcattatattcttggagggggccagtttcccatggatactattcatttttagaagaataattgtaatgcaatttaatattaatcattgaaaaagttttcaacttatagccttgaagcaaaattcagctaaaatgcgatttggttaaaaaacatccgtcagtaaatagtaaattgttaaataataaaaatgctatcatcaaacttagaacaagggatgagtgttggaatttagcaattgctttaactcatttttttccaacttttgtaagtattttaaaataataattttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctggggctacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggccaataataatttttaaaagctaagaagcaatctgttttctgcacctggactgatttgcaaatttgagtagatatattcctaatataatcacagaaatctcattgagaaagtagctttagtagaagagctacttcattaaatcatattatctacatttgatgactaggaccaatgtttagatagcactgtaaacatttgcaaaacaggaacatagcattttattttctaattgacatatactctactacttcttactcattttatggtgaatttaaacaggttctatttcaaaagacataagggcgttttgcacattcaatggtcctttgggtttgttgaaagtgaaagattaaaattgcactggaaactgtcttataaattcagcaagtaattgaacatagcaagcctccaaccaataacatgtgtttgatttacaagattttatttacttctaccagtagacacagaatcaagaaataaatttttattataaaattgaataattaatcaagagaatctctagttaacttacaatctttcattatcttaagaaaaaaatagcaagaacacatgggccttgttctgttgtccttattatatctcatataactaataggttttaaaaatattcaaaaatgcataacattagtatgtttctcctattttctaagtttgcctaaatcatacctactcaaatcctgtttaatctttgttgatttcagccattgtgcatagactgtggagagaaacattaagggtccacaacatcagaatcactatttgaagacaaaaagcctaggcagagtcaaaatctaggattctggtacaatttcagcatcaaagaacagagataaaggatgcaagatgttttacagaggacttcttaggaatatctgtaccaactaaaatcatatggttgactcataggatatagcatagtatctggaaaataatagttaataaataatctaaagcatttttttttggaaatactctctctcttgttaagacactaatttaaacttttagcatttttgcatgtgaaaatcactttttagttcctgttagttgtaaaggttttgatttctgaaatatataaactgtaatcaggttttgattttctgaaatctataaatattaataataacatacaaattaggacagatattttaggctccattaagatagaaaaagtgaatagcaataatgtctgtattaatctcatcagacatgaaatgatgtgatgataacaataagaaaaaaattgaaactaacatattaatttttcataattagtcagaataagcgcttttgcatattgtcatattttccctaaaaaaacctatttatatgtaatcacctaccaatatttggtatctcattttaactactgaatgatttacacatcaatatctttatctcttgagatcttttcagtgggtacaaatataaaacagagtggccatctaggtctattcaaaattcagataaggtgttacacattgtaataaaatattacttatacaaatagcacaattaaaaagcattgttaattagacaatggaattttgaaaatttcagtgataatatagaaaagtagaggaagcaaggagttatactttctaagcagattttgtttattctatgcatttcaaatggaaaacccaaaatcttaatggctccacatatttattctgcatagtgatgatagctaacttatttgtaattacatgtacatatttggagcacaaaatatacaccattaaaaatattggaacataattcaaaacaagtgtaatgttgatgtatggttaatacaaaaaatagacaatatacatgttataattttgctcaaactaagtcttctccaatagcttgagattgaagttaggctacaatgggactaattcttgtttgacttatgccttattttgaagaaaagacaatcaacctcccaaacttaccagaacatagctatcttcaatgtacaagttcataaaaaggagaaaaatgacaagaactcccaagaatgacactgtagaacgttttctcaggcatctcattttatcaagtatttcaaaaatatgtttcatttgatgaaatttaaacattctcttctgtggaaaagagacacagaattactagcagttggttttggatgcaaatatttctttatcgcatatataaaagtcaggtccttgtaaaatttcatctttcaaatgtttgaattaaaattctgttcccaatttcaaacataaggttggcacagatcattaattaatatgttaacataagatcaatgcagtggtttatattaatgtagagtaaataaaaataaaaagcaagtctcatagttactgacgaaaaaagatgaactttggtcataataatgtaaataaaacaggcctctgatgagaaacagtacaaaagcacaatagaaaaacagtcaagtccactgtcatcagtgaggtataactttaaggtaacatttacctctcatattgtagtataacgaaaatgagaaaaagcagaattatgggcctaatattaatctcagagtaggtgtcaactgaaaatatttaactgggaatctgggtggagtaaagaaaagtgataaagaagttaaggctgtggggtaaatccaaacatatgtttgaaaacttctgggttacaattgctttgcttatttttccaattattcttgttaaatcagggtgaatcctatagtattatattaacatttccttgatatctactacttagtagtttagctgtttgaaataattcatgtactacacaaaggcaaaatgagagtcagaaagattcgtgaaaacctaatttaaaaaaatttttactcttctattttctgatattttccaaccaaagattcctttacattattcattattttataaaaaagtataaacatatctgaagcacttaacaaactagaaaaatcacattttgtgtaaaatcaacacattgataacctgaaaacagagctacttagagttgtgtaatggatctccttgggtttatctttatgatgaagtatttatgtgtaagggagactttagaaagtgaaaaatgtccgtcccctataatcttagaactatgcctagaacatagctggcaaatcttatctcttcaatgaattaatgcaagggagaatttgtgggtccttataaattatagtaaaaatattaggaattagaagaaagtcttaatatataagacttaatatatgacttaataattataagtctaaaaataatttctaaaaaagaattatgaaagtgctatacatattactgtccattttctttgatcatatttttcttaagggttatttttcttataaatttgtagaaattgtaaatatgtgtataaatatgcacacatagatgcacataaatgtatatcctgaggatttgggtgatatatgacatttcaaatagtatgagaagtggtaaaaataatgctttggaggcaatattgtagttctgttatgggatcttcagagtgttgcttttctgatcagaaacctctgtgactggtggcatcttgccagagtccttgtcctgcatcgaggaagaatgaggtattcagacaagtggagggtgagcaagatgaagaggagctttattcagtgttagaaccactcagacaagacccacagtgggtaggtcctctctgtagacaggtcaacctgtcaagtgttcagcacttagcagagaggttagctcctctctgctgctggttgatccaccctcttctcagcagacagggtagctcctctctgcaggtggccactccatcatctctccatcctctcctctgctctggctgaacacggggcttttatgggcctcagagaggaggaagcgcatgccaactgatccatggacagccatgggcgggcccagaaaaggcaccacaagttcccagtctggtctgcaggactggcagcctggcccccaggcttcaggccttcaccagcctgaaggtggggcttcactggggacccacccccttccccccagaagtctgtctgcctcccactactgtccatagtgtccaggctgcttgcaccaatgggcacctgcaggccagtgacaagacaccctcagccccctccttggttatccttcccgcactcgtgggcgcttaaagcctggagggtgctgagatgacaagcagctggcatgtcagcactgcccagagctgacattacaggcatgaatctgagatgctgtgccttgggggaactcagtgtctgggcatggtggctcatgcctcaaatcccagctcttagaggggcagaggtaagaagatagcttgagcccaggagtttgagacctgcctgggcaatatagtgagaccccattctccacaaaaaggaaaaagtttacttcacagttctagcagcagagtttccaggtgagatttcatcagagcaggtccttggaagttttcaccatcctgatgacaatatggcaggggtggtgaccagcgagccatcttcagaagtggccctaccttttcaaagggcagacaaaggtgccactagcaacatacgtttctggccagaaaagcaacaccccaaagatcctgtaacattttgggggctcatccagggtctgcggaaaggtaagtaaaagtggatctgctcttactgtctttctttggagtctctaacttccacaacagtcaaaatgaaagaaaaatactggacatttgtcagtcagttaaaagcgactagcacagctaccaggacttaagacatggagaacagactttctggggatgacactgtcaatcctctatcacctctactgggtgttgagaatgttggctttgtttcaatccagtgtcctttcatgcatatctagctgtcacataggactgaaaggaaatcttggggcaactaagggtatctggccaaggctacaccttggtgttatccaaaggcccctggactaactccagtccctgactgcccattagggtgttggcacttggacctccagtctttcctatcattctttctttctctcttttgtggctgtcaaggttcccatctcttctttatatacaatgttaaatgttaaagatgttgttgcaaactagagatattactgggaagaatgtggaattggctcagtcatcaaaagcataaaatggaaagttaagacaaagcaaagtgtgtgttggtatctgtacataaatttgtggcaaacatgtttttgtcatttcctttgttgccaacttagtgtcaagcactttgaagcacagaacagaaacatggcctcaggaagaaagcttttctgtgaatgtgagggcaaatggtccaaggtcccatgtgctggccttctttgccttgcagggcaattcggacctttgccgagactgtaggattgattaagccctcctagatggccatctcaggagaggctgcaagagacggtcccagggaaatagggaagcaaaccccagaggtgcctccagcaggggaatcaaccccctttgctcttccctatgcgggttctctcttaagcttgccccagcctaaaaatcttcgttttaggcaggtcccagtctcaactgctccaataacagatgcctggtgaatatggccccattaaggtccaggtccccttttcaaattaaagggggtcttggcaagttttcaaatggtcctgacaggtatatagaggctttctagaacttaacctaagtaattgagctctcctggaaggatgtcgtgttacttttgagtcaaatcctgaccaccactgaaaagcagggaatcctgcaagtggcagagaattttggaaatgagctttatatcttatatagggccagggatggggaggagttggaagaatggcagtgccattggaggaccagttggaagaatggcaataccattggaggacaaaatgagcccctcatgataaaatgagagaagggaggaggaaacactttcaggtttgcatactgcaaggcttacaagggattgggtccagcctctcaactgcactgagctatccatggtagaccagggattggatgggagtcacactgccttcatcagtggggctggaggggccttggtgaagtgtgattctccatctcctgatttggttaagggacagctggtcctagggggatgagttaatcacacaggtggcccctgatgtcaggagggggctgcaaaaatgggctgtgggaccagatggtactttggagggccttctgggagtggtcacctcagtattttgcagtgggaaccatgaggaaatccagaaaagagaggggagatacaggaaaaaggcagaggcttccagtagccaccttgtggacccgcagaccccagagtccccaagatgcatttgttgactgccacaaatgtggtaggagggactgtctagacagcaggaggaggccaggtagtggaggccagtgcctacgcaggcacccctgagcctgtgtagatggtggcatggggtccttccagggtcctcaagggtgcagaccgcagagaagtctggattctgcacctgggagggcagctgcagtggctcctagggagggcgaggctcctgcctgagcagtggcatgggaggcccaggccagcctccctgctgcagctggcatcttggcagcagccactcttgatgggccactgctaccattagttctgtctacaataatttgaagtagaataaaacaacaacaaaaccccaggatataattcccaagagttgacaaagaaatacagaagtccttagagaataatgacagtcgtctaaattctaatatccaaattctgcaaattgtaatcctctcaaatccattcacaatacagaatacaaataaagtttccatggtgtatacccccagagtaactatgatacagacaattagcacaaactttaattttcatttaattgagaacatttacacccattgtcagcagaataggctgagaagcccaaaccagagcaaacaaaagatcaaaagacagaacaaaataaatgtcatttattaaacaaactatgctagactgcaggccgttaaaaattaaagaagctaataaagccattcacactcctcccccacctcaaacatagaattattttctacaccttggtttaggaaagtttttaaaaaaatccccccccagccgccaaaaaacaaacaaaaaacaaaaaacaaaaaaacactcggacacccaaaaccagactgacaaaattactatgaaaaggaaaacaaaatagctgatttcaagtagggagaacagactccgggattagtccatatttttattgtgatatgaagcaagaaagctctcaagattagtggagacatatctaaaggacatagaaaatggcttgaaaaggcttccattaaggaattttgggaaaactgaagattaaaatttatgggctatgattgatagtaaaatactgaataaatataaattaatgatgaaatggtaattataaatggaaaagaaagaaaaagtaagaaacctcatttgctactactgaaggtgaaaactttaccatcttcagtcactagaaattggtaactgaaagtattaacatttttacccagcatttctagaagacactatgttttatccacagttgatgactttttttctaatattggacaacaggcagcacagggcaatatccccaagtgaagaaaccaaataggtaagccctgtgatttttcctgcttgctgtcaagaggcggtttccaaaaggcagtacagggacagtgaatccaaacagaacgtagagatcttgccaattaggagacagaaataataatttgggggagataaaggtacctagaatttgagtggcagaatatttaagagaacaagtgacagaagagagactcagaattctgcagacggctcttcaaatctttgagttgatactggtatgtcatgtgtgtcatgaaacttcataagactagagaaagaaccataaaaaagtagtaggccaaacagttcctgaagcttatacagtgttggagatagtttgtgtgtccataagccaagtttgtgcgtccatcagccagcaaacttggactggacattaaaaaactggacattaaaaagaatactcagaggccagctgcggtacctcatgcctgtattctcaaaactttggaaggctgaggcaggaggagagcttgagcccaggacattgagaccaccctgggcaacatagtgagaccccatctttacaaaatataagaaaactagcctcgtgtgttggtatacatctgtagtcccagctacttgggagactgaggcaggagcattactcaagcctgggaggtcaagcctgcatgcagtgagctgtaattgtgccactgcactccagcctaggcaacagaataacaccctgtctcaaaacaaacaacaacaaaaagaatactcagaagcatattaccttagtatttgggccaatactctctaggcctgtcctaatgaaagcttaacaacaagcatcaacagcatcaaattattttgcataacttaactccatactagtacaaagtacagcactctttaaacatataggacaatgtctagaacttaagaacataaaaatcacaatatccaggatccagcaaaaattaccatttaaatcatggacaatatggtctataactaggctgaaactaatcagagagaaaaaaatcaagacataactgagatgatagaattaaaagaaaaaggatattaaaaaggctatcataaatatgtcccataggctcaaaatagaagaacaatgataattttaaggagagaaatgaaatatttaaataaaaacaaaaacaatttctagggatgaaaaattttatgtgcgaaatgcaaatacactggctagtagataaagaatagcaggagaaaagatacaacggtagaaataatacaaataaagcacagagagagggacaaacatccagccaaactgctgtctaaattctgagtcacaggaaaagtgagatcataaatgttgtaaggcattaaatttcagagtgttttcttcggcaacaatagacaactgatatagctatctacaggaaactcattttaatgataaagacaaaaaatgagttaataataaaagaaaagatagagataaacattaatcaaaggaaagctggactgggtatattaatataatacaaagcaaacatttagtaattaatgaaagtatcaatttttcaaaggaagcataaatgtacatgcaataaataagagtttcaaaatacctaaacaaaactgacataagggaaaggataaaaaagggaataaataaaggaggaagaaaggaaagaaagagaataaataaattcattcattttcaatatatgaatatcgaagtcctctatttaaatattcctccctcaataattgactgaacatgcaaatacaaaaccagtaaatgtcaaaaatatttaaaacactatcaaataaattaatctacttgggatttatgaaacactccacccaacaatagcagtgtataaatctgttttcatgctgctgataaagatatacccaagacagggcaatttacaacagaaagaggtttaatggacttacagttccacatggctgaggaggcctcacaatcatggtggaaggcaagaaggagcaagtcacatcttacatggatggcagcaggcaaagagagagattttgcaggggaactcctctttataaaaccatcagatattgtgagacttatttactatcgtgagaacagcacaagaaagacctgcctctgtgattcaattaccttccccttggtccctcccttgacacgtgggaattgtgggagttacaattcaagatgagatttgggtggggaaccagccaaaccatatcattccacctcccaaatcccatgtcctcacattccaaaacaatctcgccttcccaacagtccctcaaagtctaaactcgtttcagcattaactcaaaagtccacagtccaaagtctcatccgagacaaggcaagtaccttcagcctatgagactgtaaaatcaaagcaagctagttactgcctagatacaatggaggtacaggcattgggtaaatacagccattacaaatggaagaaattggtcaaaacaaaggggtacaggccccatgcaagtccaaaatccagcaaggcagtcaaatcttaaggctccaaaattatctcctttgactcaaggtctcacatccaggtcatgctgatgcaaaaggttggtttccatggtcttggacagctctgccccaatggctttgcaaggtacggcctcccttcaggctgccttcatgggttagcataaagtgtttgtggcttttccaggtgcacagtgcaagctgtcagtggatctaccattctggggtctggaggatggtggtcctcttctcacagcaccactacatagtgctccagtagggactcagtgtgggggctctgaccccacatttcccttctgcactgccctagcagaggttctctatgagggccctgcccctgcagcaaacttctatctggatatccaggtgtttccatacatcctctgaaatctatgcagaggttcccaaaccctgattcttcacttccatgcactctcaggctcaataccatatggaagctgccaaggcttggggcttgcaccctctgaagcaatggcccaagctctatgttggtccctttcagccatggctagagtggctgggattcagggcacctagtccctaggctgcacacagcactgggaatctgggtctcacctatgaaaccattttttcctcctgggcctccagacctgtgatggaaggggctgccatgaagacctctgacttgacctggagacattttccctattgtcttggtgattacattctgctcctcattacttatgcaaatttctgcagctggcttgcgtttctcttcagaaaatgggattttcttttctatcgcattgtcaagctgcaaattttctgaacttttatgctttgcttcccttataaaactgaatgcctttaacagcacacaagtcacctcttgaatgccttgctgcttagaaatttcttccactagatacactaaatcatctttctcaagttcaaagttccataaatctctaaggcagggataaaatgctgccagtctctttcctaaaacataacaagagtcacttttgctccagttcccaacaagttcttcttctccatctgagaccatctcaatgtggatttcatcatccacatccctatcagcattttgggcaaagccattcaacaagtctctaggaagttccaaaattttccatgtttttctatcttcttctgagccccccaaactgttccaacccctgcctgttacccatttccaaagttgtttccacatttttgggtatcttttcagcagcgctccccactctactgctaccaatttactgtattagtccattttcacagtgctgataaagacatacctgagactgggcaatttacaaaagaaagaggtttaatggacttacagttccacatggctggggagtcctcacaaacatggtggaaggcaagaaagaacaagtcatgtcttacatggatggcaacaggcaaagagagcttgtgcagaggaactcctctttataaaaccatcagatctcatgagacttattcactatcatgagaacagcatgagaaagacctgccaccatgattccattgcctttcactggctgcctcccatgacacatggcaattgtgggagttgcagttcaagatgagatttgggtggggacacagccaaaccatatcaagcagaatacacattcttttcaaatgcacatagaagattttctaaaacagacctgatttggggatgacaagtctcaatacatttaaagaaatcgaaattatatacaaatgttcacaatgtgtctccattactggatatatatccaaaggaagacaaataaatatgttagagaagtatctgtactcccctgtgtattgcagcactattcacaatagccaagataaggaatcaacagaagtgccatatgcagatgaataggtaaagaaaatgtgtgtgtgtgtgtgtgtatatatatatatatatatatatatacatacacaatggaatactatttagccataaaatagaatgaatactatttagccataaaatagaatggaatactatttagccataaaatagaatgaaatcctgtcatttgcagcaacacagatgaaaccagaatgcacatgttaagtgaagtaagccaggcacaggaaaacaaagactgcatgatctaacttatttgtgaaatctaaaaaagttgaactcgtaaaagcagagagtagaatagtgattaccagaggctgggaggggagatggaagctgggttggtgagaggtacagttacaattagacaggaagtataagttcttgcagtctattacacattagggtgactacagctaataacaaagcagtgtatatttcaagatatcctgaagagaagatttggaatgttatcaccgaaaaaactttaaagtgacagatatgctaattaccttaatgtgatcattgtacaatgtatacacatgcattgaaatatcacactgtaccacacaaatatgtaaaattgtgtcaattataaatacaaataattttaaaagaaattagaaaaaagggtaaactaaccccaaagtaagctacaaaaagagcaaattaggcaaaaagtaaacaaaataaaaatgacaaaagtaaaggtaaaaatcaatgaataagaaaaaatagaaacaaatgctggtccttcaaaaagatcaataaaatatatattcctctagccatactgatcaagaaaaaagacattattaatatcatgaatgagacacatgtcatatcactaaagattctacaggataatggtatattttgaaaaaatatgctaataagtttgacaagttaaacaaaatggagaaattccttgcaacacagaaaaattatttatctattaataaaattgaataagcagttaaaacatccctctcaaaacattccaggtccatatgtcttcactagtgaattctaccaaatattttaaggaaaaagtatacctcctctacacaagctactccagaaaatagaagagaagtaaataatttatattttccagatctaataaagcatttttattaaattttatttgataacattttaagtaattttatgaatagtaggagtaaacatgaatatgttgaaaaacaactttattagaaataatgttaagcatctaaacatagctaacccagattttctttctaatttttccaattttgaaagtatatgtctaccaaatctacgatgcctcatcaactgctccccaactatcatgccagaacctgcaacatatccttcttgtaagctgtggtttcatatttctagtatatttctaacaggctcatgcttatcactagtttggattattcctgcgtttgcaccatcaagacactatacacttgggaatttcaatggctcataattttgttgaagggaggacaatttccttatcctgtcaaatcagtttagccagaattccccatcctccatatctgatccctcaatatctgatcaaatttctcacccaccactatctcccaggtaatatatgatcaccctgacctgccatcagtaagaatcctttcaagccagtttagcaaaaaattatctaccctcttaatgattttcaatccactaacttgcattcttttccttggctataaattccaacttgtctttgttgtattcagcattgagaacaatctctttctcctacttcaataccccatggcagtagacccttgaaatcccttgaataaagtctaaattgccatctttaaccagtgttataattttttctttaacagtttttgctgctatgacttgtataggatcaaattcattattggattcccaatcttctgacccagaatcccaagcacctacctttgaagctttcgtcttcacttctggttgattgatggatgagccattggtgatttcgactcctgagccagtgctccaaatgataagtctgttgaagcacagtgagggctgagagagcctgagtacactatacagaggctgagttagtcctgtttctttttgtaagaagttggtatagtcacatgcttctctgttaggaaggtactggctgaattgtaaatcttacttcctgtttctgtctttgagtgggaatttacttcttgaatccctgagctgaaatattttccttggttctttgtgaggcaactctgttctatttgatcctatttctcccacggtaactttttagtcaacggaaacccccttcttaaactctcactgatcgtatactccacttcctttcttgtggtcatggttttgttaaggataatttgagacttcaggatctctttgggaaactgaagattttcccgaagtgagtcctctgagatctcttccttcccattgcttctgctcctccttcatccttttactaccttcaatcttcccttcagctttcttgaatcttttgatatgtgcctcttcagacctctttcctctgtctacctgtcctcccagacgtttttccttcctgcttcagcccttcagtcacctgaactttaggtctcctatttccatcataactttcaagggactctaggaccccaaaagcaattgtctgaggttgaaaaaggaaaaaaaaaggctgattgaaaaatagattggatattttatccagatgaggctttggagacatccagataggtgcttgatgttctttcagtttcttgcctaaaatgtggtcacagcctccataacattgcatgtatgggcaaaagaaaatcttaaatgtgtcttctccacaaatattggctaaaagctttagtcctcatattgagaaggtaaccttaacttgttccatctgtcagaaacacaatgaataaaactataaagtagaggaaataagagagtattactgtgttgtctaactcctggctaaagtttcagaataaaacctttaagatctcttataatatatgtatacattacatttatatacagatatatatgcaatatatattcttatattttatacatataggtatagaatatacatatatcccattctatgtatatacagaatatacatatatcccattctatatatatagaatatatattacatatatgtatgagtaatatatatgattatatatcataatatatatgagatttatctgtggatggtattatcaaattacttagtactttctttttgtgttttagagacagattctcacgctgtcactcaggctggagtgcagtggtgcaatcacagctcactgcagcctcggattcctgagttcaagggatactcttgccttagtatcccaagtagctgggactacaggcgtccgcaatcatgcccagctaattttcaatttttgtttagagatggggtctcaccatgttgcccaggctggtccagaactcctgggctcaagcaatcctcctacctttgtctcccaaagtgtcaggattacaggtgtgagccaccacacctggcctaaaatttcttaaattctgttccaattttcagtgataaatgtgtgcttatataaggtaaatatttctaaaactctcagaaactaattcaaatgcttttcaaattcacatgaaatggacgtatatttggcaattaatactagcttcatattgtttgtttcgtaaaaacagctacattttctgatatatcaacattcagtataatatgaatacacatttttattccacttgggcttactagttgaatcaggtaatatgtcttctagatgcttaggattaaaaaaattatcagttcgaccttagaataagtgtacaagtaaagatgcagtaaagaagagttgtttgatgcccattacttcatatttctcaagacagccataaaaccaaaaacctgtgtgtttaacttctttggtttttgcttttgtgatgcttgcctaacatgatgatgttaactgtaaaaacagttaacagggaagtaaattgagattatggctagctttgcctggtgttgcaatatagttgctgaaaacggtttccaaattatttttgttaacttgaagttttaatgtttttctaagctgtattaagtaataaatactcactaaatatctaggtcattacgaagttttgtgaagttgtgaagttttgtgaagaagaagaagaagaagaagaagaagagggagaaagctcaatgctttattaatgcaaaactagatttttttttctgtggaaaatgccagttttcttggattacagtaaaaggcctttttgttcattttaccttttaagtaatcttcctaggaagccaagattttgtgtcttatcaagacagttttctatgtttatgttaacctttaccattggccttgattatttaagagaactgagagcttgcaatttaaaagcactaaagtattttacatgttttacagtgttgccttttcaaaacaaatcttaagtgaaatcttgtttttgaactgatcttgaaatttctcaaagggaccctaaaaaatgtcaaaaaatttgttctttcaccttgtaaagagaaatactaaaaataatttggtttatttaattgatacattgcattgcatgaaaagacactttcaaataagaaaagatactttaactttccctagattatatttttgtatgggcaaacattattaggtattttagaaatcatataaatttcctagaaatttatcaatatccctgctgtccacaatatctcttagtttaatgtcatcagtggtggctctaattattattgtatgcctcaaaaatagccaaattatcttgtcatttgcatcatttttatgttgaactctcattatatgttaatttccattttaaattttttgtcattcacatatattctgattcttctctgaaaatatttgcaatcagctacaagccataatgcttcatgatggtgttgattaatttagagaccatagtactgaattaaggattttcagaactagagtagacaagccaatgggttcatgaaatttctaacccaagagcaaggagaacaagaattatttgttctgatggacaataatgaagtgaagaagagtgattatggttttgtttgacagtttgttggttcttaaatgtcctattttgtggatataagcactcccttcctttttctcttatttatggaaccacagaaccagcccaatctggttcaactttgaataataaaatggtgagttatttttcagttgccatgggttctgggttgcaatttatgtaaactgcttatgctcagatgaaccacatgtgtaactgtaggcagaaactaaattctaggaccaagaaacagggactgaattaagaaggggacatctcatgacataattcaattagatcaagtcctggcatcaccccatggcacaatccagtcggatcatgcctcatggcatcatctcgttgtaagatcaaatcagatcacacctcgttaccctctgcctataaaacctgccccagtcaccagcctgaagagacagatttggtcactgccttgtgtctccttgccaataaactcatgataaaacctttattttctcaaagacttgtgccacattgggcagagaagccattgcttactcagtaacatttacacttgtaaaaatcagtagattatacttttgtacatataatattttctccctgatccttccagaatttgtaaactattgagtattcttattttcctggcaatatagttatttacatgaatttaataagaatctgttcttgtaacagaacacaattggaaacattggttatatttataaggttttgactgcaatgtcatatttgagaatgatgtgtatagaatctgagttaggaactgaggttaactttataataaggaacaatttttacaaagctatcttgaaaaagctggcccaataataattggcttctagggttcttagccttacagatgagtaaggaagatcacttcctagcaggcccagggaagatgggctatcttgggaacctcaagaagacaggaattcattcaaatctgtaagtaccagaagtgaagtctgatggctagttcttggctggacttcttagcttcaaaaggtttttgaaattataacctgagattccttatgaaaagttccagcaaagaaaactcaaaaagacctatgtggtcaattaccattcttcctttccttatgtaaataatcaggtcaaatctaatgagaccagatttattttgtcttttaaaagagaataacctcattttggttatctttgataaaaaataagtgtgactagagagatacattttatgttccagtggaaaaatatagtgcactcttgtgagttctcgattattctagcttttttccagtatccgtctacaacttccaattttctctcaccctcctgacttggagtcaatgagatgtaaaactgcccttttttcaaaactctgcaagctgaagctcgactatgtgatataaacatcatggaaatcactgtaacagattatgtatggacagcctttgtgcttgttgctgtgtgggccactcagaatgttcatggaaacacttcatgctgtcactgaaaacattcaacctgcaaacccagaagctttgtcagtttgccgctgccatccccacttccctatctaaagattcttcaagctcaaatcaagatgtcttcttgaatggcggccctgtggaatcagaaactgggtttctaaccattaatttttttgttaattttcatagaaattcccctcattaaattcctgactgctaacccatccagcaaatatattatactaccatatcccaacagatgtttcagctggtcctcaatgagcaaaagataactcaaaaagaaacagacttgttttgttcaatggaaaaaagaatatttcttttcttgaacaagaggagggactgacaaagaatctctccttgactaaactttaatcagtctcctctgagctgaagtaggccccatgttgggcatatcctccaagagcctagttttagcacttaccctgtagagtcggcttagccaaaatcccctgctctccatatttcatccctctcaacatctgatcaaatttttcatccaccaccatccctcaagtaatgactgacaaatctatcttgccttaagcaagaaacttactgggtcatttttgcaaataattactctaccctcttagtgatttttccatccactgactcacatcctgctccttggctataaccttctacttttccttttgtattcagagtttagcccaatctctgtcccctactacaaaacccattgcattagcctccatgaagttccttgaataaagtctactttatcagtaataagggtcatgatgaatcattttctttctttaacagcatctaagaatctgattcatctaataattgtgaatcatataattcctctaataattatgactaatataaagagtatcttcctctgtttatatttttctctttatcattatcataggaaaattaaaaattctgcattttcaactgtgttcaatgaatggttaaatatacagattaaaggataatgtctttagaattttacttacatacatgaaagactgcaatattttgggcagcacaataccaatagtgaagaatactatcctgaaatggggctttatttcaatactgcatcttccacctagatgagtccatcattcttccattttctaattatttcaatctatgctttagcacagttagaataatttatatgtgatgaaatactctctattaacatgaaatagtaagatatttcaggatataaaaaatataagatcaccatgatctggtagtgtatcataagatttaccaaaaggtctaatgggctcatatgttaattataatttataatgaatgtgccatttaaacaagaataagttttctctttttttgtctggtagaattcaaataaagtataaatatcatcatacgacaaactttaaaacaaaaatgtgtttaaacaaacagaaaaaaacaataaaaacaaaaaactaattggtttcaacagactctaatgatttatcaaaggtgaacagtatttttcgatgagcagccatttttaatgttgttgataaagtcaagttcattaattttttatggtattgcttttgtgtattctaacaaaccattgcctaattagtatcatggaaatattctcatatgctttcttctagaggctttatagttttagtttttagggtaggtataataaccatcttaaattaagtgtatggtgtgaagaagaggatgaagtcccttttctatcccatttattcagttgtattgggtgcctttgttgaaaatcagttggatatatatgtgtggttatatgtttgaaatctctattaggtatatgtctctatttatttttctttatgtcaatatcatactatctggattactatctgaaatatgatgatgtgagtcatttgcattactatggaagttttatcatcaattgtcaattttgacaaaaacaatctagaatttttattaaaaatttgttgagtctgtaaattattatacaatcaactaaccaatttctactgaaaaactatttagaatttgagaatttgctggttgtacaaataaattatttgaatctaaaaatacatttttctcaacatggtatttatttacatttattcaggtcatctttaatttgtctgagcaatggttttatttttcagtgatgctgacatctttcatgcctgtaaaatttattattaataattttatcttttttctattataacaagtgctttctgtaaacatgttttctgctactacatagaaattcaatttatttttctatattgatgccttggatcctgtgaccttgttaaatttaaccatcatgatattgacaagcaataaagagttttaatatttttttccaatctctaagacttcaacattttgttgctgttattgctgccttatttcaatggcaataagtaaatgggcttccagtaacatgttaaatagaagttattaaaacaaacttttgtgctttgttatgatgttaggaagaaagcgttaagtatttcaatgtaaggtatgaagatagttgtagttttcttacagatgcaccttatcacactgaggacatttgcttctattcctggattgataaggtttgatattgagaataagtgtggaattttgtcaaatattttttctccatctgttgaattgagggagcttttttctcctttattgtgctatacgatggattatacttgctgattttgtaatttaaaccaaatagaagtatacattaaataattatataattatttttatatactgttgatttgctaagattttctttctgcatttatgttcttcagaaatattgatatgtaattttcttttttattttccaatattgttgtcagcttttgctattggagtgccaatctcagagaaaccttaagtctagggctaattttgccttacagctaaggcaatacccttctgagtactctatctaatgacctgcatattacaaactttttcatttcagttaagaattactcttagaataattctcttttagaataattactctcagaaataagaattactcttcttttctgtgtgcgttccagaagacattgcaactgttcctttccagtgattctttagtagccttgaatagtttcttcacacacatgccataatgaatgctcagacataaaataatccctttctctctctctccctccctgcagttgtgttttccatgcagctttctcctctctagtatctgcttgtgaattacagccactgcagaatccaaatatcttagctatgtctcttcaactcagagaaatcagttgtgtctttgagttcactctccttgtattgcaacccagaacctctagccagtaagctacgaaaatgacctcatttcccaccccatccccccaatcaggaatcactgccttgttctgcctcttttataatgtctaaattttgttttacttttattaattctgcttttcttttagttgtttaaggatagaggcaaatctgacccctatttctccatcatggtaagaagcatatttctggttataagattttttgcctacacattctttcctttattttcttgaaaaacgttgctccattattgtcttgctttctatcttactgctgaaaaatctaatcctacctggttttctttccattataaatgccttgacaaatgtaaatgagttggttgtgtagcttagaggcttgctgaatattttatctttaaagtggtatcacatatgtcttggggttatcaattcttggtaaagtactcaagaattactgaagaaattcagaaaaatcactcgatcacttgatatttcattgcatatttaattttaaacagacatagggaatatggtgtaagaataatgcataaatgttatatattgtgataatgtcaaaaaatacccaattaaaaatacaagaagatagaaagggggaagtagtctaagtttgtatatctacaccatatagataataggtgtaagtcacagactattatttaaagcaaaacagacatcagaagcaaagttagaaaacaggactaatgaaataaagatgattgtaaaaggtaactacttaaacaaaactgcaagagttcctaaataccaaaatgaatataagaaaaatatctgcaaaactactagtgctatggtttgaatgtttgtcttttttaaaacccatgttgaggatagacatggtggctcatgcctataatcccagcactttggaggctgaggcgggcagatcacgaggtcaagagtttgagaccaacctggacaacatggtgaaaccccgtctctactaaaaatacaaaaattagccatgcgtggtggtgcacacccgtaatctcagttactcaggaggctgagacaggagaattgcttgaaaccgggaggcggaggttgcagtgagctgaggttgtgccattgcactccagcctgagtgacagagcaagactctgtctctaacaaacaaacaaaccaacaaacaaacaaacacacaaaacccatgttgaaagataatccccagtgtaacagtattaaaaggtgaggcctttaacaggtgactggatcatgaggcttctgcccttgtgaatggattaatccattcatggattaatgggctaatggattagtgggttatcacaggaggggttagttatcacaagagtgggtctgttataaaagttagcttgactctcttgtgtctttttagtcttgtgatgccttttgccatgttgtgatgtagcatgaggccctcaccagaagccacccagatgctgctacctgatattggacttcccagacttcagaactgtagaaatacatttctgtatgtataaattacccagtctctgtattctgagatagcaacagaaaacacaccaacacaatcacaaagggaaatataatacaatgagcaactttctaaatcagaaacacagaagatgcaagaagtcaaaattcctaataataggggcctttaattttcacagcccaatatagatcaagaggccaaaaattgccaaatatcacagcagtaaattgcataagtcaagaacttttagagacataagcgcaggtttatgaattcacttcacaaacacagtgaaggaaattaatattcttatctcagaatttcatagtttcaatagtttaaacattagcaaagacagagaatataaaaaatccaaagttatcttttagaattttaattttggtgtgagttttggtcaacaaagcacatatgataggtagagattaagaaagaatattttctgcctgaccatcaaccagtataattcagaatattacaacagaggagagaaccacattacatgagagagatgttgttggcttataatagtatagtagaaaacgggatgagagaattgaagcaagttaattcctaggtagtaggatagggccaataggtagccatttaaacttatattttaaatccatagacactgtaaaaacattagtaacttagggtcccagtgtaaaaaaagtatgttaatataatttgcgaataatactgattactaggaataaacactatattgaacatggcagacacaaactcaccatcctttaccagctccaagtgttaaagtaaaactttggtctcaaatttgcaaccaggtgagcacaccctgataatataaacttccatgtcacatgctactgcctgaaaatagcaatcacacaaatgaagatgagttacttgagcaggagatcttggttccatgttcaaataacattttatctgctagaattttttctttgttttggaataatattacaaaggacaagtacgtttttcttttaaggtcatgagttgattgttacagattaggtttatttgaaaagtcgtaactcatattatattatcatgatttgagtgaactatttctcaggatgatacatcatctttatatacccttaatgtcatagacatttgcttgctaacggcatatcccacgatactttttatttctgttacacccaatgggaaatcctgagcatatttttttactaattatgttgtgttttcaaaaacagcttcatcacaagtttctgatccaaggctattgattacagaacacagttatggaagcaaggctataacaatatccttacttctctgtaccaaatacatgcagcatttgcatgtctggttcaataaggcttaagcagtttttgtttgggaacagaatcatatgcttttttaaagacctgggtgaggccaggcgcagtggctcaagcctgtaatcctagcaatttgtgaggctgaggcaggtggattacctgaggtcaggagctcgagaccagcctggccaacatggcagaaccccatctctactaaaaatacaaaaaagaaaaaaaaattagccaggagtggtggtgggcgcctgtaatcctagttacttgggaggctgaggcaggagaatcgcttgaacccgggaagcagaaatttcagtgagctgagatcgcaccattgcactgcagcctgggcagcaagagagaaactccgtctcaaacaacaacaacaacaacaacaacaaccaccaccaccaccaccaccaccaccaccaccaccaccaccaccaccaccacctgggtggtgggcctggtgcagtggctcgtgctgataatcccagcactttgggaggctgagttgggaggattgcttcaggacaggtgtttgcgaccagggtgggcaacgtagtgaggcatcatctccacgaaaattaaaaaaaaaaaaaattagccacggtggcacatgcctgtggtcctagctacttggaagactgaaagactgaggtgggaggattgcttgaacccaggcattcaaggcttcaaagaactattatcacactactgcacagcctgggcaaaagagaagtaagaccttgtctcttcttcaacagagaagtaagaccttgtctcttcagaaagagatgaatgatgaatgttcatttacatgaaagtaatacttcaaaatataaacattgaaattattttgaagtgatactgtaccaagtaatttttttttggagacggagtcttgctctatcgcccaggctggagtgcagtggcgcgatctcggttcactgcaagctccgcctcccgggttcacgacattctcctcaagtagctgggactacaggcgcctgccaccacgcccggctaatttcttgtaccaagtaatgttttaaatagaaataaatcctttcactctatacttcccctcataaaagattattatatatgaatatatggataaacatactaacatacaaaatgcatattatatattcatgcatttacatttaatttatacataatgtggcatatattcctatacatataaataaacaattatacatatataaatagagctatattcacttataaatctgtgaacgtgtactattctttcgtaccatttaatactggtcctacctgaattttacctactgtttacaaaccaccaacaaaaagaacatacggcttttctagtgtcagtcaggtccacagaatcttagtgaaaaaaaaaaaaaagactttcttagtaaactcttttctctcctactcccataaatattatcattttccatcattctattcaagcttttcttctttttctttgttacaacatttttggtattacatgacttctcctacaatcatatttagagcttcagctaggactccttcctgaatcccagtctcagtttttgaataatgactattctctttacctatttttctgctgaccaataaaacacaatgcatctaaaactgtaattttcctttcctgcctgcttctccttccagattcttatttttggtaggctcagttttctcagggctaagtttatagcttctattctctcataattagaaacatgccaaaccctcttttcctcaatatctcacctgccacaatgtttcctgttgagttctcactgccataatcaaagttccggttaatacttcctttaattttggcaacggcattacattactgatggttttccctacctgttcatcacaattttgaagcatcaacccctaaaccggaactgggaaactagttttggacgttccatccctaaaccagaagtgggatgatccgcccttgaggagagatcttgatccatttccagcctaggagcttcaagcagatgcctgcttgaggatgttaatgcgggaaaggtaacaatcctgccttgctgtgctgcgatgtgaatcaagaaggctgcctgcaaatgatctcagttaacccagtaagaaaccgtcatggcaacatcgcgtgttagtgtgaacgtcagccagccctgttcagagctcgagggggaggtcctttcaggccaggctttcccctgacctcataatttacgctgtgaaaattgtacagaagtcggtctgttttcaccctgctgttggcaagaattgggggaagaaacctaatgccccctcgaaagtatgtatttttcagggcctggaatttgctgagtttttatttgtactctgcattttatgaaaaaaatgacaatgaggagcgccaaggagtacttggggacgtggagggcttgaacaatttattattattattattttttattttgagacgggatctcttgctgggttggagggctcaaatgatcctcccacttcagcctcctgagtagctgggactactggcatgtgccaccatacccggctaatttttctttatttttcattttctttctttctttttttttttttttggagaggtggggttttgccatgttgtccaggctggtcttgaacttctgagctccagtgatcagcctcagcttcctgaagtgctgggattacaggtgtgagccaccacacccggcctctgtgtcctacttctgttttttcacttctgaggtgaaataaacaaagtttgttctgttttgtaatagtaagaatggttacattaaataataataaggttggtgcaaaagtaattgcggtttttccgcaattacttttgcaccaatgtgtgtgtgttttccgctaggaaatgaaaaaaaggaactggggcccagtgtgctggaaactggagtgcttctagcactgtctccctttgctgcctcccgacaagctgtttgtgctgtggtcatgccaatcagctgggctttgaagaggaactggaggaccagctgtgaatgcactgtgagtgagcatctcccatcttgactgtacggaaggcagaggtctggcatcctttgtgtaaggacactgaagtttatacagattaagtataacctttgcccaaatccacctggctggaagaagcacattgcacagttgccaccacagtaagtctgggattgcttgagacagaagctttagcaattgctgcaataactggaggaagaaatagaaatccttagcagcttcatgtagagagtttcaagatggtgactcaggggatctgagctgtcaactccaatggtcccctctgatttttaacgaccttaaagtgctttcatttagtgccttgcttgtatataatctcacatattttgtaaatgcaaagcaagtaatcacattcaaggactattgaccaattacttttatttctttgaggttctgcacaattgagcatccctgtgttttggacacgtgaagctggtaggtgagtggtagtaagtatacaattccaaataaatgggctacattgctttctcatgcacagcacctaaactactattatttcacattgaacgccagtggaattattcataatcttctaggtggctcaaatagaataggcaaggactgagatttgcttgtaggatgaacaggaaaaaaagaaatcaagcataacttaaaagtaattacccgttttggtaatggtgccccaaatctttgatgaattgccatcacatatcaacgaaatgcactcaactgggacaatcctttttctagaaggaaacactaatgcagtttattaggacactactctaaaagacaaatgcgatgttcctgtgccatcaagttttgtcacaaggttgaaatgacctatcccagtgaaatttaagagccagaagattttcaaatatctatatggaaccagaggaagatagaatgaccttgccaggacttggacttgtttggcaaaagccctggttgaagccagacctaagctgtggaaactaatattttgtgcagacaggatagttccaaggaaactgcattttcgtgataccaacgttatcatccctgtgcctgaatgtgtctcccgggaaaatgcagcagatacctaggaaagttctgttggactaacctttgcaattcagaattgagtggtagcagtcctgtattcaaggtaaggccacttaacacagaagtaaaaaccaatctgtgtgttagttctggatttcccacctctgattagaaaaatttagggattaaactacttagaagcacataaagctgagaaggatgttattggtgcaacacagtgcatattctttctcaaaggcctatgtgtaaatttttttttttggtatgcagacaggtttttctacacaatttctttccaccttagatgtgctacatttctgtgcattagcttcagaacagtaatgttctccacatttgtctctcattttaatatccatggatttgctctcttatcaattctctcattttaaaaattaatttttaagtcaccaaaatgttaccgtattactgatgcctctgaagcctaatttcagtcaaaagttgttgttcacttttttgaactcataccattgagttcatatctgtacatctcttagttttcttaatactttctacttcttagaattgttatctgtatgttttatttcaccttggattctgatcttcttaaatttgaaaacatttaaaaaaaacgtattatatcacttgagtactcagcggagtgtttaaaaagattgcaactaccactgtggtttgagtgtgtgtgtgtatgtatgtgtttacattgcaggaatctcgaactcggagctataagacaaactaccagccatgaagatttgtatttattatctacagcatggtactcttgaaaacttgcttaagagtttccctgatatgacccagatctgtaatgttattttggggctctttaattgaaaaaatgcaaatgagcacatcaaacttaactttgtctactaagaaggaaccatacatttctctttattcgtttataacttatttaagtgagaagtgaggataataccacttgttagtttaattacataataaatataaatatcttttaactgctataagtaaacatctttaaagatattaaaaaaggtaacgaaaaaatattgacactatgtacagttagaagatgagcatcaaaactgagtactgggggaacctcaaacatgtaacctaatctgtctaatatcaaaattcagatatggtgcaaagtttgagaagccacgcaatttagggacagatatttttggaatctgctgggccatctacttatcttcactgccttgtacatatacatatatatgtagagaaataacatttttaactgtttgtcattggaacacaatgaatctctattatttacctctaatcattgctcatgaaggcagataaagtattagttgtacaaatgttattacatttcttcttgggaagatagtgtgtgggaacttgttagttttcatcaactcaagaaaaatgctcatttattaaggaattgatgctgatatgaaatgacaagtgaattattacactgtagagtgctttgcttagaatgcatatgactgtgcatgtaatcacaaattcctccggtttctggagtgttacttggactacatgcaacaaaccaccaaacattagtgatctcagttcttttccttcaactcttcagggttgcacttcctcagtgcaaattattctgtggccctaagtagaggtgggaaagaagaaaaacaaaattctacccatctaaatgaaagtggcaacgttaatctaccccaaggcactaaactgtaacattttatttaatcatttatattaaaatcaacagaatacaacagtaaattacattccccaaatcataagggcttatattcaacacttaacctcacgtcagggaaaacatgaaagaagtgttgcagtcaactcttcatctgtctgacatgtgccactgtatgtatctgacttgctttccttgcttttttaaatgcttgtccaatttgtttttttactttgttttgtggaaggctgcatatgccctcagggcagtattcggtactttctgatgagcacaaagaatgttgctgacatagcaaaatcttcagaaagccagaaaaatgaaaagtttttccgaaacatcattataattacattgggtacaaaagtctcagatactggtaagagcacatgtaattgttttgctgtttcatatttttttacagtcccaagttgtatgttcatttatagtataggtggtaatgaaatagaaaatatattacatatataaggagagagagagagactaagtatcctacaatgatgcccagcaagatttacattaagtttcactttaagcttcaacataaatagaaaatgtgtggcattgacaggattgagatttcctgccactgattgcagaaataataaaacttgagatgaggattgggaagagacagtaaactcttccaatattaaagctaattgagacaagttatgttgtaacttatttaccaacttctcttttacagtatcattctcttaaatatatatataaatttttttctgtgagctgaaaaagggcctggttagaatagaatcagtagtagcaaacattgaactaactatgtcagcaagagtacaggaattaactcgttctgagaaaagttataactgtgaacactgttttgatttgtcgtggggaagagaagagcgacaatgatgatgaaaataacttaagtctttcaaagggctataaaatatactttgttaaatcctccataaaactcatgaggtaggtaagaatatattcgtgattattcttacactataaatacaaactgaactaagatagttttagtggtgtgccccagtataatagatagcaagtatgctgtcatacctatgtatgataaatggcaattcggtttaaacacaggcctttgtaaatatatctctgatgttgtatgcatcctagtctacacagagtttatcagagagataaacattaggtgcttcaaagtcaagttaaaaattggttaagcaattaatattgaagaacactgggaatcatgtttccaccttaatgttaagacataatacatgctgttttggttactgtagcctagtagtatagtttgaagtcaggtagcgtgatgcctccagccttgttcttttggcttaggatagacttggcaatgtgggcttttttttggttccatatgaactttaaagtagttttttccaattctgtgaagaaagtcattagtagcttgatggggatggcattgaatctataaattaccttgggcagtatggccattttcatgatactgattcttcctacccatgagcatggaatgttcttccatttgtttgtatcctcttttatttcattgagcagtggtttgtagttctccttgaagaggtccttcacgtcccttgtaagttggattcctaggtattttattctctttgaagcaattgtgaatgggagttcactcatgatttggctctctgttggtctgttattgttgtataagaatgcttgtgatttttgcacattgattttgtatcctgagacttcgctgaagttgcctatcagcttaaggagattttgggctgagacgatggggttttctagatatacaatcatgtcatctgcaaacagggacaatttgacttcctcttttcttcattgaataccctttatctccttctcctgcctgactgccctgaccagaacttccaacactatgttgaataggagtgttgagggagggcatccctgtcttgtgccagttttcaaagagaatgcttccagtttttgcccattcaatatgatactggctatgggtttgtcatagatagctcttatacagtaaccaaaacagcatggtactggtaccaaaacagagatatagaccaatggaacagaacagagctctcagaaataatgctgcatatctgcaactatctgatctttgacaaacctgacaaaaacaagagatggggaaaggattccctatttaataaatggtgctgggaaaactggctagccatatgtagaaagctgaaactggatcccttccttacactttacacaaacattaattcaagatggattaaagacttaaatgttatacctaaaaccataaaaaccctagaagaaaacctaggcaataccatccaggacataggcatgggcaaggacttcatgtctaaaacaccaaaagcaatggcaacaaaagccaacattgacaaatgggatctaattaaactaaagagcttctgcacagcaaaagaaactaccatcagagtgaacaggcaacctacagaatggaagaaaatttttgcaatctgctcatctgacaaaggggctaatatccagaatctacaatgaactcaaacaaattcacaagaaaaaaacaaacaaccccatcaaaaagtgggcagaggatatgaacagacacttctcaaaagaagacatttatgcagccaaaagacacatgaaaaaatgctcatcatcactggccatgagagaaatgcaaatcaaaaccacaatgagataccatctcacaccagttagaatggcactcattaaaaagtcaggaaacaacaggtgctggagaggatgtggagaaacaggaacacttttacactgttggttggactgtaaactagttcaaccattgtggaagtcagtgtggcgattcctcagggacctagaactagaaataccatttgacccagccatctcattactgggtatatacccaaaggattataaaccatgctgctataaagacacatgcacacgtatgtttattgcggcactattcacaatagcaaagacttggaaccaacacaaatgtccaacaaagatagactggattaagaaaatgtggcacatatacaccatggaatactatgcagccataaaaaatgatgagttcatgtcctttgtagggacatggatgaagctggaaaccatcattctcagcaaactattgcaaggacaaaaaaccaaacaccgcatgttcttactcataggtgggaattgaacaatgagaacacatggacacagtaaggggaacatcacacaccagggcctgctgtggggtggggggaggggggagggatagcattaggagatatacctaatgttaaatgaagaattaatgtgtgtagcacaccaacatggcacatgtatacatatgtaacaaacctgcacgttgtgcacatgtaccctaaaacttagagtataataataataaaaaagacataatacataagatgattatttttccttaaaggatggtataagcatttatgtacaaccactagtatagtataaaaggcaataacatattgtctcaataatattgccacacatttttactgtacattttcatacagtaatagatcaggtaaactaacttgaattcagtactaccaaataacaaatttgggtggatttaatgcatatattaatatatttttacattgaagtaaaatgctcagattacgaatcattttcctgtttaagtgttgtttttcttaagcttgttattaaattctaaaaataataagaattttgttattgataaatcattaccattcatttattatttcactcaaacatttattgagtttatactaggtaccagatacctgtgctatgcacaatgactgcaatttaatatgcagcttaactagaacagaaaaatactacagaggaaatgcagtaaaaacacatgttgtggttagaaatgcttttaatactttcctgatagttgttatgaagaatttttaaaaaacattttaaatggttactcagtctgtattgcccaagacattaagtattgccttagttctatctccacttactgaagccctactatgcacatggcattgtgctagaaagaaaagtaaagattaatttaaagtccatgttctgtctgtgcctggtggctcaccgtctgtaatttcagcgctttgggaggctgaggtgggaggatcgcttgaggcccggagcttgacaccagcctgggcaacgtagtgagaacttgtctctatgaaaaatgataaaaaataattgctaggcatgctggtgcacagctgtagtcccagatacttgagaggctaagacagaggatcacttgagcccaacagttcgaggttgagccatgattgtgccatgcacttcagcctgagtgacagagtgagaccctgtctctaaaataaaataagtccctgttcttgcactaatgtctagtgcaaggcaaaaggaaggtaaatgtgcccaaaagtagatccataaattgttagaggcatgatgttacaaaaatgcacaggttataatagaaacataaaatagggaaataagagacttttctacttgagagttggctgttttcagagaatattacatagaggagatgaagacagacagggagtaagataagagtaggaaagacccgagggtaagagtacagcaaaaaaacaaagtgacatacagagtgtaacatttctatattataaagttgttgatttttcctgttttcttaaaatctcaccaccatctgagcagaaatagtttaagttaatacattatagagctcatgataaacaaaatgaacagcctggttccagacttctattctgtaataattttattaaatgagaagataataagaaaataccttgaaatttttgaagggaaatgttatgttattgttccataattgtagttcacaaaagttctctttattttgcagaggcaaagtcaatttttttttctggtatgtaaggtcttcagaaataaagtattgatttatttttctctttagaaaataattaaaatttccaccaagtcgttttagagatgaattaagaaccaagaatggagagactatggtgaaaagtgactgcagttttttttcttacttaattttgattccaaattccagaaaccagtaggatttaggtatcctcatgtttttaaagccaagtggtgaagctagattttatattaagtactatttaagactttatattaagcttggatcctgttttgtaacttcaaattttgtagaatcacgaaatatattatatatattatataaatacttacgtaatcatatgtttatattttacaaatatttattattatataaatataataaaattgcatccaagcttcaaatagaacacataatactgttgtttgtagccacttgaagcagtaactagctttttttccattcatgaacttactgaaattgactataatatttgcatagtttggagtctacaagaataattaccaagtgtttgttcttgtttatcccatttagaaagttagagctgagttgggcaatttaaaggtcacttccatgtagagaaacttgagaaatgatttttttctttatctttaaaattcttcctgaacaagcataatatgtatcaaaaaacctccacatattatcttgcatctaagacctctaaatgttcttatatgtttaatatgtaaaactttaactatgaaaaaaatgtatacagagaaagattaaagaactacaatgacatattaatagtgatagtatgcattttgtacaattatggatgttacttttttctttatacctttctatattttgtactttttaaaatatgcatatacccattaaccatcccttctttccagcttcaggtaatcatcattctactctgtatatgcgtaaataacgttaaactggaatacagaatagaatgatggttctacttttgactcttccttttgtcttttctcaattaatacatttttttttctatttcaaaaatatgcatatagcttatatttggaacaatgcatttgaaaaactcctaaaattctgtatatattatcaaaattatgcaaaaaatatagagcaaaaattctggaagggactagttctaaagttaaaaattgtcttctaagcctaacagggttttgtttctttccctttctattttgtaaaattactgctcttacattgattttatagaagatataattttcatttatataaagactcttaaagttgcactctaacatctgaattgacaaatcaggccacaaaactgtacatcatagtgcatgaatgacaagtaatttcaggttaactcaaggtggtaattcaagtttaagaagaaagatgtcattggcgataattcagataaaagaagaaaaatgtcattaactatcctacagcctactcccaatgagattgaagcagtcatttccatagtcaaatggtcaaatgtgaagaataagtatctgtgttctagggacatttatagtaatggtataattaacattttaaaaatgcattttaaagtgtcaattccctttattcgagttatcacattttaaaaatttctaatacccgaactagttttttttttctattttcagcctcttaagtttaggattaaaccttgttatattaacaactatatgacaatcttgattcatttggcttaacttcggatgaaaccagaattcaaatgtcttttcctcttggtcacagattccttaaagtaaattatcaagtgatttttataaataaataactgaatttaaaaatagaaataacctagatttattaccaggtccctaaatataatttttataccaatatttcagcttatctttttttcaattccccccatggtataaattacttattgattaggaaataagttatggtttgagagcataataaaaatctgcaatgaaaaactctttttagaaagaaattaataatttcaacagtgaaaatcaattttcctatgttcaatcttgtaatctattttgcattatttcccttgtgtaatcgaaacatcattgattcatggcattatgtagataataaactaaaatgaaagaattacataaagtatatttctctatggctattccctagcagtctcatactaaaatacttaaatttctatattcaataactaaagatgtcatgagagaattaaacagttttaaaaatttatccattgttgaaaagctcataaaacaatattttttatatgttgtttcaaatatttataacataaagatagggaaaataggctattaataaaagctatgaagaaacactaaaattctaaattctaggggaacttattttatgaaaggctgtgggactgtctacatgcattatctattttaatcctcctaggactccaattactagatattatcatatctatttatttattatggaaaaaatgaagctttcagggatgtttaatgaacttttccaggatttcataactattgggacgaggtgtatctgactccccagactgtggtgtaagacattatgctatgttgtctctcttcaaacagtgaaagtaattaatcatcaactcaatattaatgcttagggttcctgatatatacatacatatatgtttttaaactgctaaatggttcaatattagtgaatgtacaatgatacattatgattaatacttataatactatagatacatcctgcagttatgatggtgtatttgtgtcacctgtcctgaaatttcatgttcttgctaacaccgaaatttttaaaaatactgtggtaacaaagtaagtgtccaagtcctattcataaggagtggggatataaaataagaacaattttacttttatttttaattacataagcaatgcaagaatgtagaaaaaatagaagcagttgaatgttctcctctactcccatcactgtaattcctactactgattaccattgctgctatagtttggttttttaggaccttttctctgcatgtgcatgcacatgcacacacacacagacacacacacaaatactaaacacacacacacctatttaaaaataacacatacgttgaaccatatcatgtttttgtttctttcactatatcttgaaaatctttccatatcagcacaaatagattcactttattttttcaaattgctgaatagtctagttgaaacatgtttttatttaacccactcccttagttccaaatactatcttacaaaaatgatgcaattaaaattcatataagatatctttgtgcctaattttttgatataaatatattagtaaaattgatgggtcaaaaagtagtctcatttatgagagatacttccagctccccttagtcttgtaatatattcttgtgtattgactgtaacattacaagtagttcagtgtttattttctgcatttcaaatagatcttcccccagtaaatttaagcagatctgagatattgctgttgacagcttagttaaatgagctttctcagctcttccaatctgtgtgtgtataatttctctagagtccagaagattactaaaagggatccttttcaattaaagtagcaacagtgaagcatttgtgtatcgtaccatttactaagtggaaggtaatcctcatagaaaatacacatgttgcaatctatttggatttcatttctaaagtcattattaactagttctcagtatactataagtaggtccacattctaaaaggaaaaatagtgacaacacataactacaatgaatcattattaggaaatcttcaagaaataacgaatttttcactatcacagtgtacctcacttcataagcaaactgaacatacagtgtcataatagaagaggaaagggctacctggagacctctgggaagcacattcatgggtattttcctggctgttggctcttctgataactaaacttttgctgtattccatgttttctcaaagacaatggctgcgactaagttaaaatatcctagcataaagcattatttaaagataatttaaaatttttatattttaaagtaattttgttacatttttattttaaaaattataattttctgttttattggctactctaatattgaatgtttaattacttagatcaaatgttatagtatgatgtactatatttctggcccagagaacagaatagaaaaaatttattttaaaatacacatggtttttcatgaaattcatatgatgaaaaacattaacataaaatataggtcaatatacactacaaaattataactattttatctgattaagaattgtggtccagttaaaatagtttggttaatgagaaattatccattttaaagtcacattttggagtttatgtgaatacatgtaatgctgaaatatgttaagcataatttaatatgtcatggtttatcaaatagttcaaaagctttcaatgccccatggccctcattatagcttttactataatgttccagagatctaactaatttctaaagttcacttcactttgctaaattcatcattgaaataacagtgatgatccatcatttcattttttctaaaaaatatattttatatatacagtaattatttatcatcagtataaaatattatagatcataatagcttctcaccaacataatattgtattttatacattttccattgacctaagttgtatacattctccaggctttgaaaatcaagtgtatctagtcaagaaagtatcaaacacatgctgttaaatcttccatcaactaccttttctaaataataccttgcatcttctggatccctttgccacactcctctgcacagtctttcttacaacaaatctgaccatgtccttcccaagcatgagacgttccaagattccatctgctgatggaaaaaagttcaaaatctttttcattattattaaaagctcctattaccttctcttgccctagtaattgacagcattcccaacaccatgccctttgtctgctgacatacgttgagctcctcatcatggcagggcaagtgatgctgtcactatgaagtattgctgatttctctcctataggtaagaagtgatcaacacttttttggggtctggtgtctaacttgtagtttgtccatcacatcacttttaacattttcttactcttatttctttacacaacttttttttccccagataaactctgggctcattgaaggcaagaaattaggcccaggtgtacctcagaaatgttccctaacagttttgattaaaattttaattgataaatttaccatttgagaacacagacaaagccatctctttaattaaaatttgagaaagctttagtagaacatcaagaaaattgtttctggtaataatacactatggtgctattctgtcagctatgttgtgtggaaaaatcaggttaggttttgatcctggttcctagagattataaagattgggggtaggattaccttattaaaacaaaagcactgagaaagtaaataagtgggggaaatccatattatgactaagaaatgatataagatatctcattacatattccaattatctatattttcactgtacatgtaattattgtgcttactattttattgttttatcaaactggagtagtatgcactgtcttctctattttctaattattgtttacagtatttattatcgagatggtcttttgactgacatttataaaagattgaaatgattaaagacaaaatatagtaaaatgcctgatgctatttaatggacaatgttataagcagtaaagcctgatgatctccgatattatatacataaccatcatatttagcttttagtgtgtgccaggctctgtgtaagaagtttacatctttctaattttcatagaaaacttgttatatgtcaatatcagatcaaaaaagacagagtcaaactctagagtgagtcatgggaaagaaaggagtactaaacatcagtgtgcagccaatttgagtgtaaggctggatctactctcacgagaaaaactgtaacagaaaggttgctgataaaatactgaccttactatgctttttaaacagtacatttaaatacatacaaacttatgtaaactggttggacagagatctaacatgctaaaaaccagcagagtaaaatctttttacagtatgagaatgagaatacaaacttctgtttcagcttctttccttagtcacaatttcctgccttaaagaaaatgtcagacggctgggttcccccaaaaaagtagagaggagaacctgcttaaatatttcttgaccattataaattaatttattattttctctattttcattttcttcaacaaggagggagctactcttctaatttaatactgttgcccatgatattagtgatgacactttatttatacctaatgaggaactttacaggatagatgtattgcaattagatcctgtctcagagttttctctttattcgttgatgaatgtgtgtaattcaagaacattaaaaacaactgtgaaagtataattattacagaggagaaagtgtctggggattaattttattacatataaccatatttggagggacagtatagaaacagttatttaataataaacattaagtttcttaacaacaagtagcaattgacttaggcaaatgcctattaaaaagagcacattaaaaatcaagtaaaaattacatcaaacacattttttttcctgtgttgggaatatcgtatttcatgacaaagacttataaatgaaggaagaaaagagatggcaataggtgtgggtcgtgccattttacaagagagacacaggagtctcagcgattgaaataattttcccatgtagatacaactcttaagtgacagaataaaatttgtacttaggtttgtacatttggaatctcatgccaactggttaaaaaaatttatgtgaacaatttgtatgatgtttatgtgtatagaatgacactggagttgaaatcagtatgattgtggaattgaaaagacgacagtatatgccagaaatcttcactttatagcctaaatatgagatgatgcctatactatggcttaatgttagtgagtatgactacatgtacagagttctacatgagataaaacacattaaatgaaaaagttcactggtacacttgtatcaaagaccaacaataaaaaacactgaaaaggtttactagtatcaagcacttgttgagaaatctattaggtgtaaaacattggattgggactttttaaaaggaggttaaagaggcaagactgaaatttgattagtatatatatttatgcattgttcccaatggaatattacttatattctaatccagaaggaattgtttatcatttactcagtagttcaaagcacattttattattaaattatgcaaaatgggctaaaactgataatcacagaatattcaagccagaaaaaaatgtaaagattattagttcaattacaactttatgcagaagaaaaattcaatgccaaaataatccaagtgaccgatttaatttgttattgataggacaaagactagctgaaggtttcttgaagtttgatgtagtatatctgaaagaatgcaaaattgtgcttagagtctacggtgatagtgtttcatgtaaccattacatttagtcaccaacaaaagcataaaacacatataatcaaatatgggagtagtagcatgttggtgccacacttaagattgacattctgtctcaaactgaatctatcatagtcagtggttctcttcacattataaataattttttttttcttttgagtacaaaatgtagtcaacttgggtttcaaaattatgtatgaaatacatgcatcttaagcactagaatcacagtgtggtaagaggttaagtaggaactaataataactgagtgaatagtagattcacatcccacatttaattttcagggtcacagtgggataaaccaagtgaaacgatggccaaaatggtctgcatagaaatttatataaaacattatttccgtctctgctgcattctttttctctggttttgctgaccttttatagtggtatttatttcagttaaatttgcttacattgttcttacactttaatgcatgagagtaaaatattacataaatatttaaagagtcagactagattatgaatatgtatgaatatattaacatcaataacaaagcaatatatcagttggaaaaagacatgaaaataggaattttattacaacacctgcaatgttcaaatgatgtaaggttcacaaaaatagcaaccagaaggaaaatcaacgttctagcagcattgatgtggtctacacagtatgcaaaaatggagcaatttcagataagtttctggatttctcttgaaatctttgcaattgtgtttttactttattcaattttatttatttatatatttacttgttaacttttatcttaagttcaggggtacatatgcaagtttgtcttataggtaaattgtgtgtctctggggtttagtgtagagattatttcattacccaggtaatacgcatagtacctgataggtagttttttgatcctcatctttctcttaccctacacctcaagtgggccctagtgtctgttgttctcttatctgtgtccatatgtgctaaatgcttagctcccacttacaagtgagaacaggtagtatttggttttctgctcttgtgttagttcacttaggataatggcctccatctccatctgtgttgctgcaaaggacataaactcgttgttccttatggctgtgtaagatcctgtggtatatatctaccacgttttctttatgtattctaccactgatggacatttagatttattccatgtctttccttttgagaacagtgccacaatgaatatatgtgtgtctttatggtagaatgatttattttcctttgagtatataccaaataataggattgctgggttgaacggtagaattaccattttgagatatttgagaaatcgcaacactgctttccacagtggctgaactaatttacattcctaccaacagtatacaagcgttcccttttctctgcaaccttgccagcatctgtcattttttgactttttaataatagccattacgactggtgtgagttggtatctcattgtgaggttgatttgcatttctccaattattagtaatgttgagcattttttcatatgtttgttggccatgtgtatgtcttcttttgaaaagtgtctgtttgtgtcctttgcccactacataatggggttgtttgttttttgcttattaatttgtttaaattccttatagattctggatattagacttttgctagaggcatagtatgcaaacattttctaccattttttggttgtttgtttaactctgttgatagtttctttcactgcgcagaagcttttcagtttaattaggtcccatttgtcaatttttgtttttgttgcaattatttttagcatctttgtcatgaaatctttgccaggtcctatgtccagaatggtatttcctaggttatcttctatagtttatatcattttaggtttaacatttaagtctttaaatcatcttgagttgatttttgtatatggtgtaaggaaagtgtctatatttagtttttgaaatatggctagctagttatcccagaaccatttgttgaatagggagtcctttctccatagcttgtttttgtagacttttttcaaggtcagatggttttagctgtgcagcattatttctgtgatctctattctgttccttggtctatgtgtctgttttgtagcagaaccatgctgctttggttgctctatccctataagtatagttttaagttgggtaatgtgatgcctccatctttgttctttttgcttaggatggccttagctattcaagctcttttttatttcatatgacttttcagatagttttccccccttagttttgtaaagaatgccatttgtagtttaatacttgaatctttagattgctttgggcagtatggctattttaaaatattgattctttctattaatgagcatggaatgtttttccatttgtttatattgtctttgatttcttagagcagtattttatctctcactgtggaagtatttcacctccctagttagctgtatttctaggtaattttttttctttttgtggctattgtaaatgggattgcattcgtgatttggctctcagcttggatgttctatagaaatgctactaattttggtacatttgttttgtatcctgaaactttgctgaagttgtttatcagatcaaagagttttggggaagagactatggggttttctaggtataaaatcatattctctgcaaaaacggatcgtttgacttcctctctttcaattactatgcctttatttctttcttttgcctgattactctggctaagacttccagtaccatgttgaataggagtggtgaaagagggtatccttttcttgctccagttcccaaaagcttccagctcttgccctttcattatgatgttggctgtgggcttttattttattttttgatggctcttatttttttaatatattccttcaatacgtagtttgttgaaggtttttaatatgaaggaatactgaattttattgaatgcttttttctgtatctgatgaggtgatcatgtgtttttgtttttagttctgtttatgtgacaaatcacatttactgatttgcatatgttgaaccagccttgcatcccagggacgaatcctgattgataatgctggattagctttagacgtgctgttggattcagtttgctagtattttgatgtggatttttgcatctgtgtttaccaaggatattggcatgaagttttctgttttcattgtgtctctgccaggtttcagtatcaggatgatgctagcctcctagaatgagttaggaaggagtcccttctcttcaaatttttggaatagtttcagaaggaatagtacccactcttctttatacattggtagaatttggctgtgaatccatctagtcatgggctttttctgatttataggctttttattactgatcttatattggaagtcattggtctccagggattcactttctttctggttcaatttgggaggttatatctctcagaattgaccaattttttttccagattttctaccttgtgtgcatagaaatgtgcatagtagtctctgagggttttttgttgttgttttttttaaatttttttttattatactttaagttctggagtacatgtgcagaaagtgcaggttcattgaataggtatacatgtgccataggggtttgctgaacccatcaacctgtcatctacattagatatttctcctaatgctatccctaccctagcccccgacaccccaacaggttccggtgtgtgatgttcccctccctgtgtccatgtgttctcattgttcaactcccacttatgtgtgagaacatgcagtgtatggttttctgtttttgtgttagtttgctgagaatgatggtttccagcttcatccatgtacctgcaaagaacatgaactcatccttttttatggctgcatagtattccatagtgtatatgtgacacattttcttatctagtctatcactgatgggcatttgagttggttccaagtctttgctattgcgaacagtcccacaataaacatacgtgtgcatgtgtctttatagtacagtgatttctaaccctttgggtacatacccagtaatgggattgctgggtcatatagtatttctagttctagataaattgccaccgtctcttccacaatggttgaactaatttacactcctaccagcagtgtaaaagcatttctatttttccacaacctctccagcatctgttgtttcctaactttttaatgatcaccattcttactagcatgaaacagcatcttggtatctcattgtggttttgctttgcatttctctaatgaccactgatgatgaactttttttcatgtgtttgttggctgcataaatgtcttcttttgagaagtgtctgttcatatccttcacgcactttttgatggggttgtttttttcttgtaaatttgttgaagttatttctagattctggatattagccctttgtcagatgaatagattgcaaacattttctcccattctttaggttgcttgttcactatggtgatagtttcttttgctgtgcagaagctcttcagtttcattagatcctatttgtcaattttggcttttgtggccatttcttttggtgttttagtcatgaagtttttgtccatgccaaagtcctgaatggtattgcctaggttgtcttctagggtttttattgttttaagtcttatatttaaatctttagtccatcttgggttaatttttatataaggtgtaaggagggaaccccatttcagctttgtgcatatggctagccagttttcccaacaccatttattaaatagggaatcctttccccattgcttgtttttgtcaggtttgttaaagataagatggttgtagatgtgtggtgttatttctaaggcctctgttctcttccattggtctatatatctttttggtaccagtaccatgctgtttttattactgtagccttgtagtatagtttgaagtcaggtagtgtgatgcctccagctttgttcttttggtttaaaattgtcttggatatgcagactcttttttggttccatatgaaatttgaagtagttttttccaattctgtgatgaaagtcaatggtcgcttgctggggatagcatcgaatctataaattactttaagcagtgtggccattttcacgaaattgattcttcctctccagccccatgggctgagacgatggggttttctaaatatacaatcatgtcatctgcaaacagagacactttgacttcctcttttcttaattgaatagcctttatttatttctctttcttgattgccctggccagaacttccaatattatgttgaataggagtggtgagagagggcgtccgtgtcttgtgctggttttcaaaaggaatgcttccagtttttgcccattcagtatgatattagctgaatcttattattttgagatacattccatcaatacctagtttattgggagttttcagcatgaaggactgttgagttttgatgaaggcttttcctcatctattgagataatcttgtggtttttgttattggttctgtttatgtgatggattacatttattgatttgagtattttgaaacagccttgcaaccccagcacgaagccaacttgactgtggtggataagctttttgatgtgctgctggattcggtttccagtattttattgatttttgcatcaatgttcatcagggatattggcctggaattgtctttatttgttgtgtctctgccaggttttggaattaggatgaccctggcctcataaaatgagttagggaggtgtccccctttttctattgtttggaatagtttcagaaggaatgataccagctcctctttgtacctctggtagaatttgcctgtgaatctgtctggtcctggactttttttggttggtaggctattactgcctcaatttcagaacttgttattggtctattcaaggattcaacttcttcctggtttagtattgggagggtgtatgtgtccaggaacttatccatttcttctagattttctagtttatttgcgtagaagtgtttatagtattttctaatggtaatttgtatttctgtgagatcagtggtgatatcccctcgatcattttttattgcatctatttgattcttctctcttttcttctttattagtctggctagcagtctatcgatttcgttgatcttttcaaaaatccagctcctggattcattgattttttgaagagtttttcgtgtttctatctccttcagttctgctctaatcttagttactttttgccttctgctagcttttgaatttgtttgctcctgcttctctagttcttttaaatgtgatgttagggtgtcaattttagatatttcctgctttctcttgtgggcatttactgctataaatttccctctacacactgctttaaatgtgtcccagagattctggtatgttgtgtctttgttctcactgatttcaaagaacatctttatttctgccttcatttcattatttacgcagtagtcattcaggagcaggttgtttagtttccatgtagttgtgcagttttgagtgagtttcttaatcctgagttcttatttgattgcgctgtggtctgagagagtgtttgttattatttccattcttttgcatttgctgaggagtgttttacttccaattatttggtcaattttagaatatgtgggatgtggtgctgagaagaatgtatgttctgttgatttggggtggagagttctgtcgatgtatattatatatgcttggtccagagaggatttcaagccctggatatccttgtgaattttctgtattgttgatctgtctaatattgtcagtggcgtgttaaagtctcccactattattgtgtgggagtctaagcgttggggtgatcagacccaacaccaggtcatgggggtgacgaagtccagtggagtcaaaggaatgggaaatgacagtttgagagagaatgtgggtccagggggccaatgctactatggaggctgtgaaggccctgagctctggaagcccacactttttattggtgatcaaacaaagaaataggtggtgagaatgtgggggtcgaaagggcaagtgcatgatctacaggtgtgatggtttagcatttcctttgaagcatatgggacatattctgctagttgagataatggggagcatgttcttctagtttaagctagaagcaaggagccagcaagtctagactcattccagatgccacgagcggtttatgccctgagccctggacattatgtcagacatgcaagccctgtctcagcttttttcccaacatttagctttttcccaacactaagtctctttgtaggtctctaagaacttgtttcatgaatctgtgtgctcctgtattgggtgcatatatatttaggatagttagctcttcctgttgcattgatccctttaccattatgtaatgcccttctttgtctcttttgatctttattgtttcaacccttgctttatttatttatttatttatttatttttttgctttccatttgcttggtaaatattcctccatccctttattttgagcttatatgtgtctttgcatgtgagataggtctcctgaatacagcacaccgatgggtcttgactctatccaatttgcaaggctttatcttttaattgtggcatttagcccatttacatttaaggttaatattgttatgtgagtttgatcctgcctttataatgctagctgggtattttgcccgttagttgatacagtttcttcatagtgttgatggtctttaaaatttggcatgtttttgcagtggctggtaccagttgatcctttccatatttaatgcttccttcaggagctcttgtaaggcaggcctggtggtgagaaaatctctcaggatttgcttgtctgcaaaaggttttttttctccttcgcttatgaagcttagtttgggaggatataaaattctgtgttgaacattcttttctttaagaatgttgaatattggccccactctcttctgtcttgtagggtttcactgttagtctgatgggcttccctttgtgggtaacccaacctttctctctggctgcccttaatatttttttccttcatttcaaccttggtgaatctgatgattatgtgtcttggggttgctcttttcgaggagtatctttgtgatgttctctctgtttcctgaatttgaattttggcctgccttgctaggttggggaagttctcctggataatatcctgaagagtgttttccaactgggttccattctcctcatcactttcaggtacacctatcaaatgtagatttggtcttttcacatagtcccatatttcttggaggctttgtttgtttctttttactcttttttctctaatcttgtcttctcactttatttctttgagttgaccttcaatatctgatatcctttcttccacttgatggattcggctattgatacttttgtatgcttcatgaagttctcgtgctgtgttttttcagctccatcaggtcttttatgtttttccctaaactggttattctagttaacaattcatctaaccttttttcaaggctcttagcttccttgcagttggttagaacacgctcctttagctcagaggagtttgttgttactcaccttctgaagcctacttctgttaatttgtcaaactcattctccatccaattttgttcccttgctagcagggagttgtgatcctttgaaggaaaagaggggttctggtttttgtaattgtcagcctttttgcattggtttttcgctttctttgtggatttatctacctttgatctttgaagtcagtgactttaatttgggttctctgagtggatgtcctttttgttgatgttgatactattcctttctgtttgttagttttccttctcacagtcacatccttctgctgcagatctgctggagtttgctggaagtccactgcagaccctgtttgcctgggtaccaccggcagatgctgcagaacaaccaagattgctgcctattccttcctctagaagctttgtcccagaggggcacctgccagatgccagcccattacagagctctcctgtatgaggtgtctgtcagcccctactgggaagagtctcccagtcaggattcacaggggtcagggacccacttgaggtggcagtgtatcccttatcagagctcaaacactgtgctgggagatctgctgctctcttcagagctgccaggcagggaagtttaagtctgctgaagctgtgcacccaatcacctcttctcccaggtgctctgtcccagggaggtggggcttttatctgtaagtccctgactggggctgctgcctttttttcagagatgccctgcccagagaggagggaatctggagaggcagtctggctgcagtggccttgctgagctgtggtgggctctgcccagttcgaacttccccatggctctgtttgcactgtgagtgtaaaactgcctacttaagcctcagcaatggcggaagcccctctcctcaccaagcttgagtgtcccaggtagagttcagtcccaagccagaccacttggctccctggcttcagccccctttccagggcagtgaatgattctgtctcactagcattctgggcaccactggggtatggagaaaaaacaaacaaacaaacaaacaaaaaaaaaactcctgcagctagctcagtgtccgcccaaactgctgctgagttttgtgctgtaatccgaggatcctggtggtgtgggcactggagtgaatctcctggtctgtgtgttgcgaaaaccatgggaaagcacagtatctgggccggagtgcatggtacagtcctaatggcttcccttggctaggagagggagttccccgagcccttgtgcttcccaggtgaggcgacgccccaccctgcttcaactcaccctccttgggctgcatccactgtccaaccagtctcaatgagatgaatcgggtaccttagttggaaatgctgacatcacccaccttctgcattaatctggctggttgctgcagaccggagcttttcttattcagccatcttgcccatttttttttttcctgttagctcagtggtaatgtcccatttaccatttctgattgtgtttatttggatagtctttcttttttattagtgtagctacttgtttgtccatcttatttattctctcaaaaaacaaattcctaattttgttgatttttttttatggtttgtgtgtccccagttccttcagttctgattttggttattttttgtcttctgctagctttgaagttgagatactttgctgttgtttctgcagttcccctaggtctgatgttatgttattaattttaaatctttctaacttttgatgtggctgtttagcaccataagtttccctcttaacattacttttgctttgtcccagagattctggtatgttgtatctttgttctcataagtttcaaagaatttattgatttctgccttaatctcatcgtttacccacaagtcattcaggattaggttgtttaatttccatgtaattacatggttttgagttatcttcttagtattgacttaaattcttatagtgctgtggtctgattctgtggttagtgtgattttgcttttttagattttcctgataattgttttatggacaattatgcagtcaatttcagagtatacccgtgtgcacgtgaaaagaatgtatattctgttgtttttgggtggagagttctgtaggtgtctattaggtccatttggttgagttcaggtcctgaatatcttcgttagttttctgcttcgatgatctccctaatgtgctctgtggggcgttgaaccctcctcctgttattgtgtagctatctcactctcttcataggtctcaaagcacttgctttatgaatctgagtgtgcctgtgttgggtgtatatatattcaggataattaggtcttctgttgaattgattcctctaccattatgtaatacgcttctttgtcttttttgaactttgttggtttaaagtctgttttgtctggaattaaaatagcaatgcctgcttttttgttttccatttccttggcagatttttctccatccattaactttaatcctatggatgacactgtatgagagatgagtttcttgaagacagcatatcattgggtcttgcttctttatccaacctgccactttgtgccttttaattcaggcctttagcctggttacattcaaggttaatactgatatgtgtggatttgatcctgtcattgtgttgttagctcgtttttatacaaacttgtttgtgtagttgctttatagtgtcaatggtttctgtagttaaatgcgtttttgttgtatctggttgcagtctttcctatccatatttggcactaccttcaggacctcttgtacaacaggtctgatgcaaggaattcccatagcatttgcttgtctgaaaagaatcttacatgtcctttgcttatgaagattagtttggctagatacaaaattctctgttggaatttcattaagaatgctgaatgggagttcgaggtgggcagatcacagggtcaggagattgagaccatcctggctaacacggtgaaaccccatctctactaaaaaaaatacaaaaaattagctgggcgtggtggcaggcacctgtagtcccagctactcgggaggctgaggcaggagaatggtgtgaatccagaaggcagagcttgcagtgagccaagatcatgccactgcactccagcctgggcaacagagcaagactctgtctcaaaaaaaaaaaaaaaaaaaaagaatgctgaatataggcccccaatattttctggcttatagggtttctgtcaaaaagtctgctggtagcctgatggtgttcacattgcaagtgaccttctctccagctgcatttaacctttcttctttcatttcgatcttagagaatctgatgactatgagtcttggggatggtcatcttatgtagtatctcacaagggttctctgcattttctgaatttgaatattgtgtcctctctagtgaagttggggaaattttcatgggtgataccatctgtattagggttcctagagagacagaactaatatgatagatgtatatataaaagggagtttattaaggagttttgacttaacacagtcacaaggtgaagtcccacaataggtcgtctgcaagctgaggagcaagtcagtccaagtccaaaacctcaaaagtaggaaaactaacagtgcagccttcagtctgtgacagaaggcctgatagcccctggcaaaccactggtgtaggcccaagagtctaaaagctgaagaacttggagtccaatgttcaaggtcaggaagcatccagcagaggtaaaaggaggtcagaagactcagccagtctagtccttccacattcttctacctgcttttattctagccacactggcagctgattagactgtgcccacccagattgagaatgggtctgcctttccttgtccactgactcaaatattaatctcctttggcatcaccctcacagacacacacaggaacaatactttacatccttcaatcaaatcaagttgacactcgatattaaccatcacatcctccaatatggttttcaagttgtttgctttctccccctctctttcagggatgtcaatgagtcaataaatttggtctctttacatttttgtatcacttagaatacttgaattgggttttgactttctcctgaatcttctttcctgtccatgatctgaattctacttctgtcatttcagccatttcagccttgttaagaaccattgctggggaaccagcgtgggtcattttgaggtgagaggacactttagttttttgagttaccagagttcttctctggttttttctcatctgtgcaggctgatgtttcttcaatcttagaagttgctatcctttgaatgggttttgttgcttttatcttctttgttgcccttaagggtttgattgtggtctaaggtggtttcagttgactggatttctttctggaagattttaggggtctaaggctcagttcagcattcttgagctgtgtgctctaactttgagggaatgatcccaggctcccagctttgttctcaggaccctcaaggttaggaatctgtggttctggaggggctgagctgtttccagactgcagtccataacaatcccatggatggtgccagccaaagtgctttgtctgagtggtgatagaagaattcatgtttgtttgcacatgccagcagcagtggcagcatggtgggttacatgttcattggtcgggctgggatgctggtgggtttgcggctgccagcttctgtgcacatgtttgctctgtgggcagtagtgtgaggggatgcatgcacacacatattctggcagaggaggggaggcaaggtccactcgcatgtgtgcacgctggaaggacagtggggtgagtgacagtgggcaagtgagtgctggcaaagcagcatgggggaggctgtggtcaggggaaggggcaggtgagctggtatgtgttagcagcagccgatctgctggagctctctgatggtcaggcacagtcagctgttgaaggagctatgatgtgggcccctgggaagcaccttggttgtctatccatcacttgcactgcaagtgggctctgccaggttggggccctggagcagacctagctatgttttactgcagacgttcccacaccataccccgtgagttcagcacaggatagagtcctgctcctatcaactctctacacagctttccctgctagctcaagtgtccatgggtgttgtggtatctcaggtttccaggattccagaggttcatggtgagggcaggttgctcctcacctgttcaatccaccccttccccaagagttgttgggggccaggaataagttgtggtgcatggtagtcccgttcagggttcccagcctcctcctcctttggcccagggtctgtgtcctccttctgtccaccctcaatgccttccctctgaagatctgctcatagtgcaccagttttccctatgtctcagtcacttggtggcagatgttcctcctgggtgtgtctggtcaggcatcttactgagacaaccttcttttgtttttaaaataaaaatatagagtaataatggatcttcattcctacattgcagcgattggctggacctaagtaaaagctaatactatttatattgggaaggcttatcctagttgcctacactcctctctctccacaagtacttcacattttactgctgaaccatgtcactcatatgcattacttgcatgactctagacatttgaggaacatgtaacatctgatccagaggaaagggagccaagctatacaattttgatatttctcctcttaatggtgtgattatctttgaggtggagagaaatactttaagcattttccattctgttagaaaaagaaaacacaaaaacaaaacccccaaatttttatcactaaatacagctttcttagcttgatgttattaaatttttacttatctgatctcctactgtctattttgataatcagagaacaacaatctgatttctatatttgtctatgtgtaaggaggaaatgtgctcaaatatgtattttgtttatttcttgtctccgtaaaagtgaattaatgacagcatattcataacatgcttggtgttacttgactatgtgagagattttgctgatttccacacaaaattccatctcaagtaatatttaccttttttattgtgaattaaaaattagtaatgttaatattgtcatcagtatcaatttatcgtgtattttattagtgtgatcctgtctctcaaggtctggttatacccaaggttatggttttacctgaacacttgcagtgtagagccaaaactaatgaattttaggtgacagcagtattacttcttaacatgtccctacagatttctgtagtattcacaatggagttaaatcatttgaagatgaggaaagaaaactttaccttgtttccatgttgagaacataagatgttgtggaagactgactgacacaatgtcttgtatggttcatgttgtgtatgtaccccatttctggtatgactttgtaacctctcccatcaagaagtgaaatctgttccccactcatgagttcaagctgactttttaatatgtttgcaccaaaagaatgcagtagaactgacagcctacaattttaagcctaagactcaagagtcattttatacttcaactctcccttgtgaaacccttccctgactgccatgggaacagaccaaggcatttttggtagaggtacagagtttacatgaagtgaggtcctaatcattttagccaagatcattctagagcagccagcctttagacaacccaatagctgactagaaacacattagtaagctgtgtaagatgagtcaagtccagcccagattgaattaccaggttcagtggaattacccacgcaacctatagactcatggggcaaactgttgtaagctattaagtcagtagttttcaaagtgtgaattggggtctcctggggatcccaagcaactttcgagaacaactgcaagatcaaacttatttccacaatgatactaagatattatttgtcttaattctcattctgtcacaatacacagtgaaggttttcaaaggctacatgatgtttgatatcaaaatagagtggatacagtagcaggtatgacactccagcagtcttctattgagttttctattgaatcatacacgaaagaaattagcgaaaatacaaagcactgctaaacttctcattaatttttgttttgtttaaaaaatgcagttatttttcataaaaatatactatctctgttacaggtaatcggtttattcttagtggtagaggaaataaatattttaaaatttatattttagtttacaatacagcaaatattaatagatgaaaatcgccaaaacaaagccctttggagtccttaatgattctcaagaaactgatattctgaaagcaaaatgtttaagaactgctgcactttttttctgcaacatttctttattctaggcatagcagttgtttataaagataaatcactataattttttcttcgtgactgtccgcaaaatgtaaagaatcaagtattagcatctttagaaatcaaaaacatttacttttctgcttcaagactgcatattggatctatctaaccagagtaaagttactgatgaaaaacaattaaaataaaattacatacacacacatgtgtatgtacattataagaatctttcattttgcatgaaagaaaaaattctacaaatactatgataataataaaaacagaaaccctgagaggtgaagtaatcaccaaagccagcttcctgtgtgaaaattcctaccaaaccttagaatgtttgagattacattttgactgcttcatgatgaacagaatgcaggagataaaccttgtggcccacccatagtggaaagtataatagcaaatgctctccctcataaaataagaaacaaacctcatggcgaaaaagggtctaaaaagaaatattcattcctgagtgctgcctggagaaaataaaagcaaaactaagaacttatccttattaaagatctgagatctgaatgaattcatgctatttgtttgctcaaaaaccaaaagcaaagcagttagtataaaattggtcttgggttgatattgccccttagtgattggcaggagcaaaaaatttaagagtagaacttcaagtctcgcctcaaagaattttcataaataacattttatgtgtgtgcaatcatagttaaaacaacagcaaaaacacacacggaaaataatagtccatgaatgaaattgatcatgaacaacacagagtgtaaatagaatcacaaataaaatagaaacttggattgaacataagaacaagaaaaaaaaagatgactaaatttttaaaagactcaaacagaatttcttaacacaaatggaatactctgtcaccataaagaagaacaaaatcgcgtcctttgcagcaacatggatgctgctggaggccattatcctaagtgaattaacaaaggaacagaaaaccaaatactccgtgttttcagttataagtgggggctaaacactgagtacacatggacctaaagatatcagcaacagacaccagggactactagagcagagagtgtgggagggagggagtgagggttgaaaaactactaaatcgggtactatgcttgctacctgagtgaatgtgatcattcatataccaaacgacagtgaaacacagttcacccatgtaacagacctgcacatgtacatcatgaacctaaagtcatatttgaaaaaatatgaataaaaattagaatattaaaaaagattaaatgaaaatatatcagctatgcagataaaatcagtgaactggatatagattcaaagtaataaataatgaaatgatgtgaaaaaaggaagagatatggaaaataaataaatggaagatattacattaaaggagatgctgactgaggagttccagaattgctggaaacatctattgacagtttcaagaaggctaacaaatctagagtgggatacataatatatccagtcatattacaaccagttttagatcactaaagattaagagaagactttaaaagcagcaagaagaaatgcaaattacccagacaggtgtaacaactgtctgagttgttacaatgaaaacaattgagttttcattaataaatggaatccaggaagcaatataataaactattcagtggtgcaagcaaaattactgacaatctagattcacaatgggggaaattatttttcaagagtaagagtaaaataaaaatactttcagacaaagaaaacttgacaattctttactaaaggaaatgatacagtatatacttttagcagatagacaaggtgtaaagtctgataagaaatggtgggaaaaagtagtaaatgtgtgagtaaatctcatataattaacttataatacaataataaaaattgctaactcttggaataataaagaagatagagcaaaactactcattaacacaacaatctggagggcttgtgagaattgtaagattctaatgttcttgtattttaggagaaagttaccaatattaattaccatcctctctgtgtgtgcgcctgtgtgtgtgtgtgtgtgtacctgcacaagtgtgtgcactctctgagagatgccttaattgtattagttgtattagaatgttttgctgttgttctctaacttgattttcttatatggttaacacatttccaagttttaatcaaagtatcacgttacatggcttgtactcagaaatgttcaagaaatgttgttaagagtttatcatgaaaacaacactattgaagaaataacataaaactgatgagaaaatattttcaatttaggcatgtgtagctactccaggacaattttacttattaaatatttttgataatacatttaaaaagtgtagtaccttagaatactaccatgaatgacatagaatctcaccttaagaaagacgctgtcataatctgtgctgtacagaaaccgttgataccctggaaaaaagaaagtctaatattactaatacaacccactggtttcttgctgataaaagtaaaataaaaagtattctctgtaataacttgccattttccatctaactgcattaggatcatatttataaaatctttctaaattgacagaaaaatatagaccaaatattttaacataatttatctgtgtatgcatgtcacagaatagacatacctttgtattaagttaaatttttcatttaaagtatcaaattaaatatttgaattatatataacataatatagagatacacacatataagtctcttttaatattactattgacgtctgttagtaaataaatatattttataatattccacttaagcataaagttattttccttaagaaagtacttcagtccgtatcactgaacttcacttcaccaaaaaggtgcacaggctagtctgttacacatttatccatgttattgatttttccatcacatataaaaggttacaacattcaagagattgttcctgttacaacagtataaattcattgcctggaacacagtttgctattgaatgtctgccagactgtgttaacaagggtattcagaagaaaactgtgaaggtataaaacaataaataagcgaataaaattctctaaagataacatgcctttaaaattatgtgtattttctttaagcaaaggtagtttgagaaaataaatatattcttattttgtattatcttttcccactatacataaacacatatttatatttttaaaaactcagtgctactttgggctatttaagtaactctaagtagaaccaattatgttgtttttcaaagtttggtgttatgtaaacattattctttcagacaagagtcaactgtgaacatttatatactcttgaggcacagattcctccagctctcctgatatctccatcagcatttctctctctacttaaatgtgccgtggtcagcttctgtggtcaacaacacctccattggaatttccacatttttcctctttgtcttcttccgtagcttccacagacagcaagaatagttgcaattggagactgacattttgaaacagtagtaggtattttgggattctcatgtcacataaactcattttttaacatgaagttatcttcacagccagttagtcatatcacagaacacagaggctaggacctaaaaccagatttcattcactggcatggagcagaagaaaagcagaacttaaagagacccaactatagatcccaagaaatttgttattcagaaggctgtagcaacaatcggttgaatcccatgcaagcattgtgtatttggtcacagcaaggtgtttggtttatggagtttatgttttcaatattatacatttgaaacatcgatgaagagaatctaaacattagaggtgatcaccagatgatcaggcaaccaggaaaaacagcattggttttgaaaatattataacaatgttcacgaccagaactcttgtaattggtcttttgactgtacttactagtgatgtacctttaaatataattcaggatacattttaacaggatctgattttttacaactagttcatgaattttgtgaaagactgatgaacaaaatggaattgcttattcatctttgtatggctatcatcaactagaaactttaacacactgtaggcacaggactttagaatcccattagtgatttatgaagtttatatttggctgataatttctcatagacactgatgaaaaatatcatgtacctgagaagagatatatatattaagccagatattcaattaaataaaaagtaattaagcaaagataatttcatctggttaaattaaattatatattatttttgtaaatattttgttatcaaatcaaaataattatgtgttctatttaggtagaaaaagagtatgaatgaaaatgaatattttagttttctaattattaatatttaacaaattaggtggtatcttcaatgtgaataatagaattgtactagatatatagtattagtactatatatctaattagtattagatagaattataatagatataatttagttgattttggatccatttttgtgtgactgtctcctttctgaagcattattgttaaaatggttagttttttgtactattgctctatagcatgatgaaaaatattttgagtcaagttgcaaataattgtgctagcataaaatatttcaaagagtttttaaaacaattggagatatgtttcatgtagaattttctataaattggctaatagaagtattttattattttcaagaaatttctaatattcaaatatctcatagatacttaaatatatgttcctaaatatatgtaatataatacaatgaatcaggttgccataataagataattatacatttttatcatttttagattttataaatgtaaactttgtttctgtgtaaaatgaaaatacatgtttaaaaaatttcagattaatggtaattgatttgctgcctcaaaaagagggccccaaattttttcattaaaaaaaagaaaggtaagtgaccaagccttctacagagatagtaatctaaaaattattgttgatttgtaatggttacagaaaagttttcaagataacaaaacctaacaagtgaaagtgaaattctacattaatatatattttgaatacacattcaataaatttctaattttgagataaacaaattatttcaatcatataaatgtcaggtattgctaaattgtatgttctattaaataataagaaatgcatacttcctgtattattctcataaaagcagtttccttcatgagcacatgaacagcttcaagaatcaaattgaccacactacatcactcagcaaaatgtattgcagattgggaacacaaaacatgaaagaaaatgaaagacagaaagataatctttccctcaaatctatgctcacctgaatcttaaatcatgtattattttccctttatatagttcttgatgggaatcttacagaaaaaaaaatgggttaaactgacaattcttcactgtcaagagaaacctatggtcagggatatatataattcccaaagctttcatcattaatattttatgaatcttgctgatctgtcccatctggaagaaaaatatatctttcatttgtgcaagcggtgcctgccaagtaataggtttcatctctataagctgagtggtgaaatgcaaacggcagcaaaggtactaggaggcaaagtgttcactttatttattttactggagtctggctgcactttattggagttgcagagtcagccaagcaaagcgaaagatctttggggaagtacgagtgtcaattccttgccaatatacctcagcctacacatgtgaatgcccacgtgttcaatctgacttttaaatgaggtgattagccacggtgactttttttttttaacataaatatatacaagaagctttggtgactggaacattggaaaaccattagctgagtatttgactttgtgtgtgtgtgtgtgtgtagatgagatgactaagagacaaattaataatttttggacacttctaacttaaaaggcaggatgttctgtcccttggttgggcatgacttgccttagctgaactaagaattttgtgtaggctcatctatgacactggagctgagtatcccctgggcagtattcaaacacagaagagcaaacagagaaagtgttctaagaccccctttccaagacataaacacagggcataatctctataatactggtctggaaaatgactttttgggggagattaagaccccaaaagcatagaaaccaaagcaaaaaatagacaaatgggattatatcaaattagaaagctctaaacagcaagagaaacaatggataaaacaaaaagatagcctgcaaaatggcagaaaaaattgtaaccgtgtatctcctaagttactattctaaatgtataaggaactcaaacaaactattagcaagaaaacaaatggtccaattaaaaatgggccaagtacaggaataaacatttctcaaaagaagaccaacaggtatatacataaaatgaccaacaggtatatacataaaaaatgctcagcctcactcattaccagagaaatgcaagtaaaattcatgatgagttatcacctgacctgttagaatggccaccataaaaaaagatgaaaaataagtgttagggaggatatggagaaaaaggaaaccccgtgtacactgatggtggggatgtaaattagtacagccgctatggaaaacagtatgatagtttctcaaaaattgaaaaaaagaactaccttatgatctagccatcccactactggttacataatcaaatgaaatgaaatcagtatgtcaaagagatacctgcactcccatgtttattgcagcactcttcataatagccaagatatggagtcaacccaagtgtccagcaatggataaatggataaagaaaaactattcagtcttaaaaacaagggaatcctgtaatttgccacatcatggatgaacccagaggatattgtgctaagtgaattaaaccaagcacaaagagacagatatcacatgttctcactagtatgtgggagttattataaaaaagctgaactgataaaagtaaaggacagtaggatagtagttaccaggggctggaatggaggtgtggagatagaaagatgttctttgaaggttatacaatttcaattagataggtgaaataagttcaagagatctattgtacaacagttcagtgactatagttaataacagcatattgtatacttgaaaattgctaagactgaaaaatgataagcatttgaagtaatgcatatgttaattagctcaatttagccattccacaatgtatatatattttaaaacatcatgttttacaagataaatatatccatcatttatttatcaattaaaaataatgaataaattagcttaaaaaaacaaaataaaacaatgacaacaaaagccagaaacacagtgggtttctgtctgttaggtttatctagttcataggtccaccatgagtgaagtgtgggcctctcatttggatgaaaataatttctgtagtaatgtatttagtgcataatcagaaaaaacatctcggttttaaaggagaattttccttcactaaaaaatctaaaatttaaaactccttgaaacggtttcccttttcttcagcaaacttatttcaatttttaatgaaatattaaggactgtgattatttaacatctttctgatcttttagaacataagaccctttctattttgtgcaaaattgtatccccagagtcttgcacactgttgacaagcagtaaatattcagtaagtttttgttgaaagatttgcatatttttcatttttatcagtagcttccaacatgttctaacatcataagcctcaacaaggcttggggtaagagtgatgatttattcaaactacagctactaatcataaatttacataaagcactgtgttagaaattgagtgatactaaaatgcctaagattaatttctgggcttcagggagttaaccgtctagttgagggaataagatatatgtgtaaaaataatgccaaatgtgaaatattaagtgactagagaatatatgagctgaaattgtacattagacaaaagaaataaaaggacattcctgataatgagaaccacatgagtaaatacattaatatcaaaagtctctaaaccataaatcatataagtgatgttgaggatgatggagcttagaatgactgacaaaagaacactatccctgtctataagaattatctaatccctgatctttaattgatttgtctatttactctttgtcatagaaaagcatgtgatttccatgtatgcaaaggatcaacactggatacacatgttaatataatattaccacaaacatataagggttttttttttctgacactcaactggcagctgggtgcttcaaactttttaaatctttaccatcctaaaatgggtgagggtaaagggagaatagtatcttgttttcatttgatctttacttatgattcaagtatcttttcacgtcttcattctctctttcagcctcagctcttttttcattcccctgttatccagttcatttgcctgactccttggcatcagcttccaggctatgcaatcacaagtggagcatatattcattttcagagaaaagtagccattcattgacactctctagctaagtaaaatacttgctagttgttactcttcaatggcttgactataccactagtttcaacaagttaaaaaaaattattccaggcattcttctggataattttaatgagttctgtactcactaaagcctttactttgccattaacttgttagctctattatgagctaaactttatgtcagtttgagaaaactattatttgagcttataaagcatgcagtatgtgaaatgagtgatctatttatttttattttttaattatactttacgttctagggtacacgtgcacaacgtgcaggtttgttacatatgtatacatgtgccatgttggtttgcttcacccattaacttgtcatgtacgttaggcatttctcctaatgctatccctcctccactcctccacccccttaaggccccagtgtgtgatattccccaccctgtgtccaagtgttctcattgttcaattcccacctatgagtgagaacatgcagtgtttggttttctgttcttgtggtagtttgctcagaatgatggtttccagctgtatctatgtccctgcaaagcacatgaactcatccttttttatggctgcatagtattccttggtgtatatgtgccacattttcttaatccagtctatcattgatggacatttgggctggttccaggtctttgccattgtgaatagtgctgcaataaacatacgtgtgcatgtgtctttatagtagcattatttataatccgttgggtatatacccagtaataggatcgctggatcaaatggtatttctagttctagatccttgaggaatcaccacactgtcttccacaatggttgaactaatttacactcccaacagtgtaaaagcattcctatttctccacatcctctccagcatctgttgtttcctaactttttaatgaatgaatgatctatttaaagtgataatataaaaatttaaagttaagtaggaaaataaacatactaatattggagaaaatatttctgtatttccttgattttaaaatcaaagtaattttctttaaagctaatatcaaactagttgaacttatattaattttatttaaaaaaatttcttttatatcctttagacctcaaaatttttgaaatttgcagattccataataatgtatttctaaaattatgtaaactcttttactaattattattattttcttttttagagacagggtctagctctgtggttcaggctggagcacagtggcacaatcatggctcactgcatcctcaaattcctgggctgttatagtatctaccgttttggtcttttcagtacatttctatccaattatgtaagtgaatgaaactctgctgccaaaaggaaattctggtcagatccctcttttttctgatccctttattggtttctcattgtttgaataaatacatttcttagccatatattttactcccaccaataattctatcctgcaactacactgaactacctgctattttccaaacacatttcatgtgagctttcatgcttcagtgactttgaacatatattccattttcctagacaatactttgattaactgtcacctctgcaggaatggctgtgacccctatagcaatattggtctctctctcttcttgggacttcaattagaggactaagtccatcttactgcaatctttgtgtgaatgtcagtatctacccaacgctgtaacctcaagggcagaaatcatagcatgccatttttgtgtttggaatacagtagatcttcaataattgtttgctaaatgactagtataataaattcatataagattttcccactaattggagcttttaagggaaatactttaattcaacaagatttctatagcagacagaactttgacttctatacactgctatttaagaaactaattttgatttggcagttgtttctggatgtctcaaataatatattattatagatttacttaaatgtaaaggctttttaaatctagattttaacctacattaccacacttctttgcttaatgattaaatgaacttttgcttagatttttataaaagagagagtaaataaaatgtacatttaattaacacagtgaatattttttgtatctacatatttcaattgttaatgggatttcatgacctaaattggccagaaaactgtaatattattttattacactcatgcatataaatgctataataaatctgctagaaagagataatgcaatcaaattaaaaagccccaccagaaagatgacagttttctttctggtcatttctttgagtagtttgtgtaagtggtataaatctcaaaaaatctataaaatattttacagtctgccaaataagatgttcaaattcctctcatgacttctttcagcaagaaaaatgaactcaatattatgctaatagtaaaaaatgtttccctagtagtttatataatattcaaaaaagcttacagttaattatgccttacaatttacagttctttaaaattgggaaatgctttaagcatattattgtcatcgactcatacaatagtcttatgaagcaagtataacaatttgtgatattaactttatttttttattgagaaatgaaatcctaaaacatttggtaacttatccaaggcaacatatatatgtcttctaggtttgaaatgaaattaattcatggtatatagtgtagaaaaatgtctttctctcttttgttgacatggtgtttctatgattttagtaaaaaagtaagagttaattcaactacaacaacacatgcttgaacatctaatttattattttatttatcttttagatgtaaaaatgtcttgtttttttcaagacatttgaaattctccccaattccaatcttactaatcaatggtcttacatgtatacaaacatttacaaagatatgcacatttatttaggaatataagtagatttaaagaatataatattttacaccaacatcttattcaattcatatgccacaacactccatatccctgaaagatctaacatgttttttgctttttatttgttttgttttgtttttcgaaacagagtctcactttgtctcccaggctggtcttcagtggcatgatttcagcttactgcaacctccacctcccaggttcaggcaattcttgtgtgccttggctgactgagtagctgtgattacaggtgcctgctaccacacttgactaatttttgtatttttagtagagatggggtttctccatgttggccagtcttgaattcctgacctcaagtgatccgcctgcctctgcctccctaagtgctgggattacaggcatgagccaccgcacccagccttaacatgtcttcttaatgttcacactagccctttcttcatcatttattcatctctttgttttaatatttgattatcccttcgttgttttcttctcctctcagaagaaaccatagttctctgcaggagctgggctcagaccagtgtttccggtttcctttctgctggttggaaactgacctgtcttctgcgttctctgtgagctacaggtagcccaggctaccccttttctcccttttggaagatacatccctgctatcagagcagactaaggatattaaaagcctcaatctgaagtggcttgtatagttgacagaggctacataggttgtagtaggcagatcttttagcacaaccacagtgggaaacttcaatgtagctgattacaaggagctaaagtgagaagggtcctgtccctttggttgttgctcctttcacttgcccctttctctgtatcaagaacaccagagcagcagcccctaacacaagactctaacaccgtgtaagataagttttcaaccccacactgtctaccttaaaatacaagtcagcacactgaaactaaccagaggaataagagacgaagatcttatacagaatgagaacgggaataaggcagaaagattaagaaaagacagcattttctttcaagacttttcttttgttatttcttggagggagagagggaaacacgcaaacatggctatctactaggaataatttagttaggtataatatgaaatgaggactagaacttcagtttttccaaaaaaagtgaagaacttggggtatgacagatctatttataggtcaagggctctactaagctttctgacacacaaaggtaggcccctaggtagactgacctcttctaaattgtcacttcattgaaaggataaagaattgtttttcaattatagaattttctgaggcctccaagtattttttgtttgtttatgtaaacaataaaagtatttaggaaaagttcaagcaacttttacaattgttttataaagagttaggaaaagaatggcttccacagtttaaaatatatctagttgtttaattatgcaaaatgcctgttatagcttatgtttatggctggctatttagtcgtatcatgatacaatacttgcaataaaatacaacctaaggggtctaataaagtagaaataattaattcatacaatcctaattaatcaataatatttaattataaaattatatcctaggaattaaaattttatgaaccctcgcattgagcaaatgtgtataatctttcaatttgcagctgttaaaatctaagagagatagcacaaaatgactgaagaaaataaatagaaacatttattgcttagattctgtatcttcagaggaaaatttatctgtagaattcagcccaaaagtggactcatttcttttttcaggaattagttgtaaggagtgaaatccttggtttgaagaaaaatcataagaaaaccccgtggtgggcagacatttcttggtgctcctgggggactgagctggccaggaaaattccattctggaaactaataggggaaatttcatatgcttcttgggggaacatgtagggaggaaggaaatcctgcgcccatcatttcacccagttttttcatccccaatatgggctttcaacttggtgacagagtagaggaagaaagccttggttaggtgcttcactttcaagaaaagagacagacactgtctgtggtggctgaatgggaacagctttggtctgcagctcccagcaagatcaactcaggaggcgggttatttctgcatttccaactgaggtacctggttcatcttattgggctggttggacagtgggtgcagcccaaggagggcaagctgaagcagggtggggcatcccctcaaccgggaagtgcaaggggttggggaattctctctcctacccaagggaagccgtgagggactgtgccttgaggaacggtgcactccagcccagatactgtgcttttcccatgactttcacaacctgcggaccaggagattcccttggtgcctatgccaccagggccctgggtttcaagcacaaaactcggcggcagtttggacagacactgagctaactgcaggagttttttttttgtttttttttttccatgccccagtggtgcctgcaacgcaagctagaaagaattgttcactcccttggaaagggggctgaagtcagggagccaagtggactggcttagcaggtctcacccccatggagcccagcaagctaagatccactggcttgaaattcttgctgccagcacagcggtctgaggtcaacctgggatgctcgagcttggtgagggaaggggcatccgccattactgaggcttgagtaggcagttttaccctcacagtgtaaacaaagtcatcaggaagtttgaactgggtagagtccaccacagctcagcaagtccactgtgttcagactgcctctctagatttttcctctctgggcagggcatctctgaaaaaaaggcagcagcctcagtcagggacctatagataaaacccccacctccctgggacagagcaccttggggaaggggtggctgtgggcacagcttcagcagacttaaacttccctccctgacagctctgaagagagcagtggatctcccagcacagcactccagctctgctaaggaacagatggcctcgtcgagtggctccctgacccccacgtatcctgactgggagacaccacccagtaggggccaacagacacctcatatagtagagctctggctggcatctggcaggagcccctctgtgaggaagcttccagagaaagtaacaggcagcaatctttgctattctgcagccaccgctggtgataccccggcaaacacggtctggaatggccctccagcaaactccagcagacctgcagcagagggtcctgactgttagaaggaaatctaacaaacagaaagggatagcgtcaagatcaaataaaaggacatccactcagagaccccatctgaagatcaccaacatcaaagatcaaaggtagatcaatctatgaagattaggagaaaccagtgcaaaaaggctgaaaattccagaaaccagaatgccttttctcctccaaaggatcacagctcctcaccagcaagggaacaaaactggacagagaaggagtttgacgaattgacagaagtaggcttcagaagatgggtaataacaaactcctgcaagctaaaggagcatgttctaacccaatgtaaggaagctaagaaacttgaaaaaaggttagatgaattgctaactagaataaccagtttagagaacataaatgacctgatggagtgaaaacacagcacgagaacttcatgaagcatacacaagtatcaatagccaaattgatcaagcagaagaaaggatatcagagattgaagatcaactcaataaaataaagtgagaagacaagtttggagaaaaaagaatgaaaaagaacaaacaaagcctcgaagaaatatgggactaggtgaaaagaccaaatctacatttgattggtatacctgaaagtgacagggagaatggaaccaagttggaaaacactcttcagaatattatccaggagaacttccccaacctagcaagataggccaacactcaaaatccagaaaatagatagaacaccacaaagatactcttcaagaagagcaaccccaagacacataattgtcaaattcaccaaggttgaaatgaaggaaaaaatgttaagggcagccagagagaaaggtcgggttacccacaaagggaagcccatcagactaacagcagatctctctacagagatcatacaagccagaagacagtggggccagtattcaacattcttaaagaaaagaattttcaacccagaatttcatatccacccaaactaagtttcataagtggaggagaaataaaatccttcacagacaagcaaatgctgagagattttgtcaccaccaggcctgccttacaagagctcctgaaggaagcacgaaacatggaaaagaacaagcagtaccagccactgcaaaaacataccaaattgtaaaggtcattgagactatgaagaaactgcatcaattaatggggaaaataaccagctagcatcataatgacaggatcaaattcacacataacaatattaattttaaatgtaaatgggctaaataccccaattaaaagacacagaccgacaaactggataaagagtcaagatccattggtgtgctgtattcagaagatccatcggtgtgctgtattcaggagacccatctcacatgcaaagacacacataggctcaaaataaaggggtggaggaatatttactaagtaaatggaaagcaaaaaagagcagcggttgcaatccttgtctctgatgaaacagactttaaaccaacaaagatcaaaagagacaaagaagggcattacataatggtaaagttatcaatgcaacaagaagagctaactattctaaatatatatgcacccgtgcaggagcacccagattcataaagcaagttcttagagacctacaaagagacttagactcccacacaataatagtgggatactttaacaccccaccatcaatattagacagatcaacaatacagaaaattaacaaggatattcaggacttgaactcagctctggaccaagcagtgctaatatacatctacagaactctggaccccaaatcaacagaatatacattcttctctgcacctcatcacacttatcctaaaattgaccacatatttggatgtaaaacactcctcagcaaatgcaaaagaatggaaatcataacaaacagtctctcagaccacagtgcaatcaaattagaactcaggtttaagaaactcactcaacctgtagtcccagctactcgggagcctgaggcaggagaatggcatgaacctgggaggtggaacttgcagtgagccaagatcacgccactgcactccagcctgggcaacagagcgagactacgtctcaaaaaaaagaaataaaataaaataagaaactcaagcaaaactgcacaactacatggaaattgaacaacctgctcctcaatgactactgggtaaataatgaaatgaagacagaaataaagatgttctttgaaaccaatgataaaaaagacacaacgtaccagaatctctgagacacatttaaaacagcatatagagggaaatttatagcagtaactgccacaagagaaagcaggagagatctaaaattgacaccctaacatcaaaattaaaaagaactagagaagcaagagcaaacaaattcaaaacctagcagaaggcaaaaaataactgagatcagagcagaactgaaggagatagagacaaaaaatcccttcaaaaaatcaataaatccaggagctggttttttgaaaagatcaacaaaatagaccactaaccagattaataaagaagaaaagagagaagaatcaaatagatgcaataaaaaaatgattaaagggatatcaccactgatcccacaggaatacaaaccaccatcagagaatactataaacacctctacacaaataaattagaaaatctagaagaaatggataaattcctggacacatacaccctcccaagtctataccaggaagaagttgcatccccgaatagaccaataacaagttctgaaattggggcagtaattaatagcctaccaatcaaaaaaagcccacgaccagacagattcacagctgcattctaccagaggtacaaagaagagctggtatcattccttctgaaactgttccaaacaatacataaagagggactcctccctaactcattttatgaggccagcagcatcctaataccaaaacatggcagagacacaacaaataacgaaaatttcaggccaatatccctgatgaacatacatgaaaaaatcctcaataaaatattggcaaactgaatccagcagcacatcaaagcttatccaccatcatgaagttggcttcatacctgggatgcaaggctggttcaacatataccaatcaataattataatccatcacataaacagaaccaatgacaaaaaccacatgattatctcaatagatgcaggaaagggctttgacaacattcaacaccccttcatgctaaaaactctcaataaactaggtattgatggaacgtatatcaaaataataggagctatttatgacaaactggcagtcaatattatactgaatgggcaaaaactggaagcattccctttgaaaaacgggagaagacaagggtgccctctctcagcactcctattcaacatagtattggaagttcttgtcagggcaatcaggcaagagaaagaaataaaggtattcaattaggaaaagaggaggtcaaattgcctctgtttgcagatgacatgattgtatgtttagaaaaccccatagtctcagcccaaaatctccttaagctgataagcaacttcagcaatgtctcaggatacaaagtcaatgtgcaaaaattacaagcattcctatataccaataacagacaaacaaagagccaaatcatgagtgaactcccattcacaattgctacaaagagaataaaatacctatgaatccaacttacaagggatgtgaaagacctcttcaaggagaactacaaaccactgctcaaggaaataagagatgacacaaacaaatgaaaaaacattccttgctcagggagaggaagaatcaatatcgtgaaaatggccatactgcccaaattaatttatagattcaatgctatccccatcaaggtaccactgattttcttcacagaatcagacaaaactactttaaatttcatatggaaccaaaaaagagcccacatagccaagacaatcgtaagcaaaaagaacaaagctggatgcatcatgctacctgacttcaaactatactacaagtctacagtaaccaaaacagcattgtactgctaccaaaacagatatatagaccaaaggaacagaacagaggccttagaaataacaccacacatctgcaaccatcttacctttgacaaacctgaaaaaaaaaaggcaatggggaaaagatcccctatttaataaatggtgttgggaaaactggctagtcaaatgcagaaaactgaaactggatcccttccttacaccttatacaaaaattacctcaagatggattaaatacgtatatgtatgacctaaaaccataaaaaccctagaagaaaacctaggcaataccattcaggacataggcagggcaaagacctcatgactaaaacaccaaaagaaatggcaacaaaagtcaaaattgacaaacgggatctaattaaacgaaagagtttctgcacagcaaaagaaacttttatcagagtgaacaggcaacctaaagaatgggagagaattgttgcaatctatccatctgacaaagggctaatatccagaatcaacaaagaacttcaacaaatttacaagaaaaaaaaccaccacatcaaaaagtaggtgaaggatatgaacagacacctctcaaaagaagacatttatgcagcctaaaaataaaggaaaaaaagctcatcatcactggtcattagaaaaatgcaaatcaaaaccacaatgaaataccatctcacgccagttagaatggtgatcattaaaaagtcagaaaacaatagatgctggagaggatatggagaaataggaatgcttctacattatttgtgggagtgtaaattagttcagccattgtagaagacagtgtgccgattcctcaaggatctataaccagaaataccatttgacctagcaaccttattactgggtatatacccaaagtgttataaatcattctactataaagatacactcacacaaatgtttattgtggcacttttcacaatagcaaagacttggaaccaacccaaatgcctatcagtgatagactggataaagaaaatgtgtcacatatacactatggaatactatgtagccataaaaaggatgagttcattttctttgcagggacatggatgaagctggaaaccatacttctcagcaaactaacacaagaacagaaaaccaaacaccacatgttctcactcataagtaggagctgaacgatgagaacacatggacatagggaggggaacatcacacaccggggcctgttggggggtggggggatagcggaggagtagcgttaggagaaatacctaatgtagatgacgggttgatgggtgcagcaaaccaccatggcacttgtatacctatgtaacaaacctgcactttctgcacatgtaccccagaacttaaagtataaaaaaaaagagacagtgaaagtgcaaattgccaaatgtttctttagtatttatttcattatatttcatttttgatgacattagaccatctttttcatcaacataaggcatgtagtagattatgaatcctgctggtctctgttgatgatcagatgccaaagcaggagtaaattttcttgacatgcagagcaagagttggagcagaaattgaggtgttatctcgtcatcacagcatgtagatcctggatccgtgagccctgtcagatggatttgctcctcaccaaaaaatctggaagatcctcaggtccttttaagcctctgctaaatgctgcacagatacctctccaaaatttcaaatttgacatccacttcagttaatttggaaatgctgtgtatgttcttttctcataccttactaaagtttctctgaccaacctgtgctatcaaacatatatcacacattttgttatcaagggcaccaaagcagatttttaaggaacaaataattatttgtttgtttttgttgttcttttaaactttggcttgcctttttggcagatgttctactcttcatgtcttaatctgctttgcaactatctctaaactatcctttccctctattaggaaaagtagcaagttttgtcatcatcattgatattagtttgtttttcatttattgttataattcattcattatgttactaatgaagctcttgtacttcactttcagggtttgtattttctgattccaaggatgcattcttatttttcagagttgatgtaagtcataactgcttctgttttcttttttaggaacataaatatatagataaatatgaatataaatatatataagtatatttatatgttataaatataagcatagcatatttatattatatatatatatttatacacacacacacagacacttccaggaaatgcctattctttcctctgtttgcttgtgtgaaggcttgtgccaatctaatctatagtcgagctggctctctgggctttgggagttatgaggcattctctttactattccagctttttatgcctctgaagatctctctctactttgctgccctgtccccttttacctgtagcagtacagtctatgaaagcccagtaaaccttggggtgggctttctcttctctttgttgcaatctttgaaagggtgtggccttgcactctgtgaagtccctctgtaagagttggttgataatatagtattgctttaggtgggagactccttaaaattcgaattcaccactccaacctatatgtggtcattaatagtttgttaaaaattggactggtttgtcctcatttctgtctaaagcagattgtctcctgctgctgcggtgccctcagggatgaaaacagtcatgtgagtcctttattctgggaaggtgtcatttttttctggaatttggtcatgtcattttgtaccttcagttttcggagttaaaaataatataacattatagtgtaccttgcttattgttaagtattattttaataagtatctccccacaaaactcttctgtttatcttaaatgaggacagccccaccaacaaatacagtaattcaagtcaaatctgagataatgtagatttactcctcaaatgttgtattcagtagcactggtgatccttccataagtgactgggttaataacaacactccaagctaacagtaaattaaaatatatgtgtgagttttagattttacatgggctatttatttgaaactgatatctatagtggaaaagtctccaatcttaatattctatgtatggcactaaggtggaagtgaacagtgtgaactatggcagattgggtaagaaaatgaatctacacaatattcttattctcagttgatgtctatccttccagttccccaggccaattacagtcattcttaactccatctttaaatccatgcccaatatattaggtaactgtgctggccccatattcaaaatatatccataacaatggctcactaaagttactactagcatcttggtctcagtgactatgatttcttacctggttttaactagtgtgtttttaactcatctccattcttttactcgggcaatgttttttttcccctccccacccccaatatattctaaatagagcaactagaatgactttattaaaatggaagtcagataatcaagtttttctacacaaaattaaataatatattctcatttattgctaaacagttgccaattacaatggtataaaaggcccttcttgacctggtgccttccttgaactcatctcttccatcagcagcagccacattgtcttccttggtgtcctgtgaattatgaggtcccgatgtaggaactttgcattggattttttttttttttggaaatctggaaatcccttctcctaaatattcccatggttctaacacttatcctccttaagtcaaatataataaacttaacaaagtctattctaactattaaactgcaaatttctccctccaaacaggcattctaatatacctgaacttgatcaatatttttcttctctatagcatttatcatcttttaatatgccatatgatttacttacttattttctgtcttctcacatttgattgccaagtttataaaaacagtaatcttttttttcctctgattgtttgctagtcacctggtaaatacttataaaaatatttgttgaaagaatgaatcaacagggaggtaaaagctagtacactactaatccacttttttgtgtacattcaaccaagatattcagcagcaaatatttttttctcaagttgcaactttaatataagttgatgatctataggaaaaattcccttggtgatctgaaatttgtacaggtggcagcagtttttatgggttgtggctctattatttttaatgagctgggatttcaaagttctatctatctctaaagatatttctagaaggatattcaaattgtatttgaatgaagtatatcccataatacagggatatacttaccaggacagagtagtaacctttccaacaggtccatgagcaatcagattcacaattctaattttgtagttgagttctaacaatgtagttaattattgatttttaaaaaaacatttgaccaagcaagaagcaaaatcattattttgccaaaaacagcacgttcctaatttgcctatggaagagtatgtaatgcttttaaatggggatgaaatctacattattatgtagaagattgttccttattctaaattgcagctaaagcagaaattcaaagcttatgaaataagacagatagtctcaagttaaaactcctaagtaatattacttttaaatacagaggtaggcaatggacaatatgacatggtaaagcacaaaaagagtaggacactgcactcaatcttattaaattcgctgtgaaaataccacagccagaagctattcaatttttggagaagttgggaaagtaccaaggtatcatgggaaaatgtagacagggaaaaaatatagatccaaaatgaaagtcaaagttaaaaagggtcatcctgcttgaaggaaaaaataaatctgataggtactagaaaccaaatccagaggatcagataaggcagaaagattttgttcagacagacccaattgttttttgaagaataatacaataatataaataatttatgaaatgtgctttgtagttggcttataacagtattgtttaggccataaaatatttgataactttacatctggctattaacaggtagctatgttgctcttcataagaacatacttttatggttaactttgttgctcttatgaaggctgctaatttgtgcaactccaggagcacattctattcacatgtaacataacactatgtgaatgatttcttttaacatcaggtaatatggtagcaatactacttactatgcgtcatagctttacatattttaaatcatctaatcatctcaacaattgtatgagttaggaatttttattatcccattttacatattcaagaaataaagcacataattaactaacttgcacaagttgaacagtaaaacgtgttagatccagaatttcagtacaggaaatctgtcttcatgatcagtgttcttaactagggtattattctgcctcttcaaaagaataattattgaacaccttcaatgttttggtcaccaattcttagtactaggaaatggcaacaaacataaaagccaatctcttgctctcattagctttcatttctgtgaagatgttcagactataagtagcagttaatgcatagggttttgtgtgtgtgtgtgtgtgtgtgtgtgtgtgtgtgttccaaccactattgaaatctctttataaatattaacacattctgtcctcacaacagccatttgagatagttgccatgattattcctcttttacagatgatagaacggagggcaaaagggttaagtgatgtgcctgaggttacagagctagtaaaacacatttttccctactctcaaatagaggactgtcactaaactaattatacagaaaagtctttctgaagaaagcaaagtaagagcttttttagaatttcctaaattttttttgttagctgtttttttttccccaaaacactttaaaattccaggtcaaaccatgcttttttattgtcatccacatgaaagaagagaagaaaaaattacaggtaattaatgaaaaaataaaaagccaagtgtatttacaagtatacaacatacatctgtatgtatatttatatctgtaaggctctttctagatagaaagacacagacaagtcaaacagatgcattttttcccctttttgttcacctcatatattttaaacaacgaagcaaaggatagatgaaaggatctttggatagatggatagatggattgattagatgagtaagcaggtagatggagagcgaaacagagtggaggaggatggaatgaagaaagttgtgagggagagaaatttccagattgaacaaaagaaatacgcaacagaatataattgaaaagtaactatactaatattttttacaccccttttatattgtgataatagatttatgaaaattatctagtttcttagatccttacttaggttgttttcttgtttggagaagaaaaatttttgagattcattaatctttacctgatatctgacatcattaacagtattgtgattttggaacacacgagaggactaggagttacatttctattcctttatgcaatgcatactccaaaacaagtgatatgctttggctgtgccctcacacaaatctcatcttgaattttagctcccgtaattcccacatgttatgagagggacctggtgggagacaattgaatcatgggggtggttttcctcacactgttgttgtggtagtgaataagtctcatgagatatgatggttttaataggggaaacccctttcacttggttctcagttctctcttgtctgctgccatgtaaaacgtgcctttcaccttctgccacaattgtgagggcttcccagccatgtggaactgtgagtccattaaatatatttttctttataaattaccccgtcttgggtatgtctttatcagtagcatgagaactgactaatacagtaaattgataccatagattggggtgctgttctaaagatacctgaaaatgtggaagcaactttggaactgggtaacaggtagtagttggaacagtttggagagcccagaagaagacaggaaaatgtgggaaagtttggagcttcctggagacttgttgaatggcggctttgaacaaaatgcttatagtgatatggacaataaagttcaggttgaggtagtctcagacggagatcagaaatttgggaactggagttaaggcgactctttaaaaatctgactactccactggattttggacttgcatgggccctgtaaagttctttgttttggccaatttcacccatttggaacagctgcatttacccaatacccataccccccattgtacctaggaagtaactagcttgcttttgatattacaggctcataggtggaaggcaattgccttgtctcagataagactacggactgtggacttttgggctaatgctgaaatgagataagactttgggggactgttgggaaggcacagttggttttgaaatgtgaggacatgagatttggaggggccaggggtgaaattatatggtttggctatgtcctcacccaaatctcagtttgaattgtacctcccagaattttcatgtgtcatgggagggatcgggggaggtaattgaatcatgggggccagtttttctcatgctgtgctcctgatagtgaataagtctcacaagatctgatatgtttatcaggggtttccgctttcacatcttccacatttttctcttgccaccaccatgtaagaagtgcctttcacttcccaccatgattctgaggcctccccagccatatggaactgtaagtccaattaaatctcttttagttctcagtttcgggtatgtctttatcagcagtgtgaaaacgaactaatacatgggaccttgtaatcatgtgagttaatacttaataaacatatagatagatagatagatagatagatagatagatagatattccattacttctatccctctagagaaccctgactaatacaatctccattactgaatagtatatcttaataagcatttggagtttgcattttgtagaataatccatatttttatagaagtgagtgcaagtataatgacactctatgtaaaactcttctatgtctcttacagtgctttagagccctcaaaaatggaatcactggtggtttttcttaattctttcatatggacctgtattagcttgttttcatgctgttgataaagacacacccaagactgggtaatttataaagaaaaagaggtttaatgcactcacagttccacgtggctggggaagcctcacaatcattacacaaggtgaaaggcacgtcctacatggtctcaaagaagagagaattgaaggccaaggaaaagagattttcccttataaaagcatcagatctcgtgagacttatttactaccatgaaaacagtatgaggaaaactgcccccatgattcaattatctcctaccagatccctcccacaacatgggggaattatggaagctacaattcaaaatgagatttgggtggggacacagccaaaccatatcgttgtgcccctggcccctcccaaatctcatgtcctcacatttcaataccaatcatgctttcccaacagtcccccaatcttaactcatttcagcattaacccaaaagtccacagtccaaagtcttatctgagataaggcaagttgcttccacctatgagcctgtaatatcaaaagcgagcttgttacctcctagatacaatgggggtacagtattgggtaaatacagccattccaaatgggagaaattggccaacgccaaggggttacaggaccatgcaagtctgaaatccagtggtgcagtcaaattttaaagtcccaaaatgatctctcttgactccaggtctcacatccaggtcatgctgatacaacagatgggttcccatggtcttggtcagctctgctcctgtgtctttgcagggtacagcctccctcctagctgctttcccaggctggcattgaatgtctgctgcttttgcaggcacatggatcaagttctcagtggatctaccattctggggtctggaagacagtggccctcttctcacagctccaccaggctgtgcctcaatagggactctgtgtgggggctctgatcccacacttcccttctgcaatgccctagcagagattctccatgagggccccacccctgcagcaaacttttgcctgggaatccaggtgtttccatatgtcttccaaaatctaggcagagattcccaaaccgcaattcttgacttctgtgcatctgcaggctcagcaccacgtgcaggcttggggcttccatcctctgaagccacagcccaagctctgtgttgccccctttcagccacagctggagcaactgggtcacagggccctgcccacaaaaccttcttttcctcctgggcctctgggcctgtggtgggagggactgctgtgaagacctctgacatgctctggagacattttccccatggtcttggtaattaacattgggctccttgctacttatgcaaatttctgcagtcagctgaatttctccaccaaaagtgaatttttcttttctaccatatagtcaggccacaaagtttgtgaacttttgtgctctgtttcccttttaaaactgaatgcctttaacagcacccaagtcaccacttgaatgctttgctgcttagaaatttattttgccagataccctaaatcatctctctgaagttcaaagttccacaagtctctaggatggggcaaaatgacaccagtctctttgctaaaacataagaagagtcacctttgcttcagttcccaacaagttcctcatctccacctgagaccacctcagcctggatcttattgttcctattgcaatcagcattttgggcaaagtcattcaacaagtttctaggaagtttcaaacttttccacattttccttttttcttctgagctctccaaactgttccaagctctgtctgttacccagttccaaagtcgcttccacagtttcaggtatcttttcagcaatgccccactcttggtagtaccaatttctgtattagtttgtttcatgctgctgataaagacataccggaaactgggaagaaaaagaggtttagttggacttacagttccacatgactggggaggcctcataatcatggcaggaggcaaaagccacttcttacagggcggtggcaagagaaaaatgaggaagaggcaaaagcggaaacccctgataaacccatcagatctcgtgagtcttattcaccatcatgagaatagcatggaaaagaccggcccccatgattcaatgacctccctctgggtcacaaccacaacacgtgggaattctgggagatacaattcaagttgagatttgggtggagacatagccaaaccatatcatcacacaataagccatctgcaggctgaggagcaaggagagccagtccaagttccaaaactgaagaacatggagtccaatgttctaaggcaggaagcatccagcacaggagaaagatgtaggctgggaggctaggccagtctctcttttcacttttttctgccttcttacattctagccctgctgccagctgattagattgtgcccacctagattaagggtgggtctgcctttcacaacccactgactcaaatgttaatttcttttggcaacactctcatagacaaacacaggattagaactttgtatccttctgtccaatcaagttgacactcagtattaaccatcacaagtccaccacttgtcaacttgaacccatacacatctcctgagattatacataatcttcaaataaagaaaataataagttcataataatatctgacataatacaactatccttcatgcaaccagaaatgcaccatttcccaacccaaatactattacaggaagtcaacaatacttaaatgctgatgtgaagtcaataaatcttacattacatgataaaaaagaaaggaaataaaacgaatatattttcttagtacaagcatataaatgcacaaagatgtttttaacaaaaggagtaggaaatactcatgacaattacagtcctcatttctggagttgctcctcacttctgcagctggtcacatggtcatagctggtattgatgactactttcttctactacccattctgaatacactttgccttcagcaagcacctcagcaggtcatagttttttcctgatggagtgacccaaaccttcatatctgaagggtccaagccatttgtagtcctgcctggattgggctgttgtagtttcccattgaccttaatcacagggcacggtaataatatgagattccctaatggatctcctgtactccatgcacactcttccttacctctgttatggagtagtagactgatttcttcctgatagcagaggtcaatcaccccagccaacactgtatctttcatcttagcctgttgacttaaatgcagaaggagcccaaaatgtccaggtggtaatcttaacttccagtttaatggaatcgttgttgttctcctgatggcagcgttcctccctctggaactaagacctctaggccagcaaaacataatgttgcgggaacaggaagcaaaaattttgctggtggatcactgggggtgatggtgagtggtgccacttacacctccaccccttgattcctggacccataaatcatggctatgggagaaacaatattatatattggatgctgattcagagcatcagccttctagagaactttgccccagccctgctaagtattgtcacctagctggcattgtaattgtgacttcaaaaggccattccaccattctgtcaatcaagctgcttcaggatgaaggggaacatggtaagaccagtgaattccatgagcatgagcccactgctgcacttctttagtgagtgccttgatcagagggaatgctgtgtggaataccatgatggtggataaggcattctgtgagtccacggatggtagtcttggcagaagcactgcatgcaggataggcaaacctatatctggaataagtgtttattccaatgaggacacactgctgccctttccatgatggaagaggtccaatataattaacctgccaccaggtagttggcttgtcactccaaggaatggtgctatatcgaaggctcagtgttggtcgctgctgctggcaaattgggcactcagcagtggatgtagccaggtcagccttggtgagtggaagtccgtgttgctgggcccatgcataacctctatccctgccaccatggccactttgttcatggcccatcgggcgatgacaggggtggctgggcaaagaggctgattgccgtccacagaatgggtcattctatccattagattattaaaatcctcctctgctgaggtcacccattgaggagcactctcatgggatacaaatattttgacatctgacatgcaccttcttagtttattactacttttatgtatagaagttattttgtaatacaagcaaacagttaaactcattgtattcatatcttagttgaatttctttttaaaattagacctagacgagaacagagcttagaaggaagaccacacaaagtagaagaggcttactaataaaaatatggtgtaagatgaaaaggcactgattatttgagaaaagaaaattaatgttggtgtagtggtggcagcaggtggaatgccctggttgaaaggagtagcatttgtatgttgggtatgtagtcaaatcctggcatagatgtagtacttagttaatatgggtttttaataaatcagaatagagggatttactcaatggaataaaaaagcacagaaaacaaccttagtatctcttagagttgtaaagggcccaagagactttttctccttttaattcatttaagagttgttcctagatatagccaacctcaaggcaaagtgaggaaaccctggtggacttgctgaaggtttaggaagcagcctcaaattctggactatgagatcaaaagagcaaggacaaactgtgagtccagaatggcacatttggaagtcttaaaatatctaaggacagccattggtcatcattaagtatcactatatagtatggtcttgtctgatgagaggatgcgggttggaatgagtgtgagttctatattcagcaaggaaaataggaatttccctggaaaattaccctgaaaacattcctatttactcaaaaactccataatattaatgatttatgtatataagtttaacaataatgtatatgggtaaatggattatttgtataagtgtgtaaaaataatatatataaaatatatttatatatacaaatacaaacatatttctgaatctttaaacactaaaaatattcaaacattaagaataaagtgaaatggagactactgggagcaaatttacagctcttaactcactgtcattccaggtcgtgctcattgaaatgattaactcatttagctaggcctctctctctctctttctctgtcaccttctttccatttttctttttttctttctacttgatcccctactctactcctgcctagacaggctctgaagttctccctgctgtgttctgttacgctagagggccatagctaagattccctcaccaagcatgacccatagtgccagtgctatgctgccatgccatctgtttatctcattttcgcttttgtttctgcctatttttccttctcctcccctctgcattttgtctcctgttgtatctattaataaacattctggctttagttatagagattgctatgttttaccaaatccaatatatttcctgtgtctgggcaagcagttgtactcactattctgggtaatttatttgtattattttaacccctagtaactaactccagcttttatcacacacttttttaatgttttctttatatttttagcttttctattctatcttgattactatagaaaataggcaacatatattttcacactggaaattatcaaatagagcatttaagaaatacctgaaaatatgtgaagtgctataatagcaacaacagaaggaacataaagtatcctcccaactgtgctttaatctggttataaaaacatgtcagagcgcacacacgcttgtgcacacacacacatgcacacgcacccacacacaccggtaccatgaattcaactggtatcaagacattgcaaccagagtttcatgtctagtgctgtaacaatggctgatgtttggagttatgtattctactcaaaattaataggcatgaaagaaaaaaaggagggacttattaactgaaggaaggatatattcaaatcaatatgttaccccatgaagttatcttcccagcgtgagcataattaaaaacacaattatggttttccattaccagaaaatatttttgggtaacaaaattaaagtatttaatttttagaataagcttatgtgttcagcatgaaaatacattttcaaaagaaattatacattaaatcaagtctataagtaatgcatatgttttctgagcattcaacttaaagaaaaaaggtataaatagaatggcatttagttgatgtgaataggttaccatttgtttctctgtgatccaaggggaaataaccagaggaagtatgcattttaacatagttttagcattccatgtctaaggaaacaaacatggttattgtggataataaaacaatagtagtgaaatataaaaaaaagacacttgaacagttcctgaatagtgaattttgctcccaagatgcatcctggcacactatagatggtaaggaacaataatgaattgacttttattgtcattgatttgttgctatggtgactttttgggatgacagaagtcagcatagtcaaagtgactctaattcgggagtctgtgatccaaaccagagacaaatgaacattgtacagaaattagggacctcattttaatctcctatagatgctgtttattataatattacatttgttttgatagtttttgttgttgttgttgttcacagaaatttacaaattcaccatgaatccactctggaatattcaagagctagtgttcatctagcacaactgataacactaggaaacaatgcctaaaatagcttttggaacatagaatggagaatatttattacaagaattgaatgaagtctggggggtgacaacttagtgacaattttccctgttgctgtgcatgaagcttgcacattgaggccttgttcagttgctgaggtacagaaaggaccaaaaagaacatgctgatatataaaagaaaaaaggaaaaaaatgtgctctaaacaaataaggccaactatctggaaatatccccccgttgtcctaagatataacattgccgaatgtgacaggctgtgggtcctgtctcatgggatgtgttgcaaagagtagacaactgaaatgcttgcttaaaatcttcattaaaaacatctacattataaagcctccatgtcactagagaatggagacattatgtagctcattacagtttgtgcagcatactgtctagggaccccttgcccagtgggagctcttagtagcagaatccttggcaggcatttttctgcagggaaagtatttctgttggaaacactgtgaatcatgcataagcacttcataagaatcccctttcagaaatgtcacaaaatggacaacagcacagtataataaaaaaccactagcctgagaaccagaagacagtatttctaagtctggcaatgccattaaacagtctagatgaccttaagtgaccttaggttggcctcactttcctcagctgcaaaatgaaggctttggattaaaccatctctaagcaatttcacctcaaaaatcttacggttctttttagcattgctgtgtctttctttccccagagagtgattccttggactaattggaaataaggtaaaggtttatactgaaaaaggaattggtaggcgacaattcatttgtattactgtatttcttcagagacaatctggagcatatcttttttgtcaaatgtgagatttatttaaaagagatttagtgcaacacagatcaaccacaatttagccatcttcagggaaaagagaaaataaacacagcacagttgtgagtagtaaatggcatattgtaagtttcagcacaaaatgatccaacagaaagtctaatataagtatcaaactattacatatgatatgatatctatttacaacttttctctccataaaatacatttctattggggtttattcattataaaaattagtgttatgggaaaataatggaagggtttttacaaatccaaagttaatttggatttttcaatggtaaaataattctaacatgttttattgatttatacttttatttttttttgcattttactctttgtcaagaataccttttatttaaattatcagtgccaatggaaaatgacatgaaaattattttcagagtatatcatatgttcatatatctataatcacatacaacctacaattgtttgtttcaaagacaactcagtctcaatctacccacaaatgaactcaaattatccttcccaagcatcctcttacttatgtgtcctttaatggtgtcattacctacctgtcatctagtcagaagcttcatttagtcataagcctctctttttgctccattgccatttaaataattgacaacctaaggccaattttaactcttttacaaattttaaatatatcatctcctcttcattcataggggcattgacttactctagacattcataccttctcatctgaaataattaaggcctttacctagctgatctctctgcccctggactcaaccttctctcattgattctcagtactgctaccagattgtttcaaaatataaaatgatcatgccactatttggcttaaaagtgtttgatggcttactattccttcaggataagattcagttttatagtactgtccgcagggttctgtatgatctgtctgcccctctctactgtcctttcctcatttcctgtcatttcctcacaagtatctgcactctagttacaataatcaggaaatcctcaccagcttgtgagtacaaataaaatcacagagacacgattgaggatgggctgtactagataacaataatcattgatggttagaacagaatggactcatacacagagtgaattatatctgagctacatcctaaatcaacatatcctggcttatcaccacaatgttccttgccaagtctttctgctcagctacatggctgtctcattatctgattattagctttcattcatgttcagaagacttatttctctggtagcttatgagcaatatgaatctctagaatctaaggttggcaagttgcaaaaagagaaggaatattcaacacctgtccaggatctatgtcttccaagaataattgagagaagagatgtttaccacagtcagtaaaaattctactcatgttgaacagaggtgtagctctcccatggaccccaaaaaagaagaatgtgagggaaagctcccaagcacatggcttaagcatggaagtttagtactgaggtgattttttcattcaacaactatttctgagcatcaactatttgtaaaatattgtcctaggaactgaggatagaagaagtccctgcgctcaaaaaactaacatttcatttttggagactaataggataaaaataaagcaataactctaatgtcaggtagtggtgagcattatatagaaaaataattttgggcaagggtttagaacctggtagggtaaaaaacaaggcatttatttttgaggaggtggttaggaaatgaagtgtgaaattaattttcctgcagtatatgaagtattgtaccagagtattaaaagatatgtaatattttattgataaatctattctttaaaaggaatacattttaggatgtcatcactttgatgtgaatcatgtaaatgttgataatattctgtgtattacacatttagtgtttcaagagattcacttaattgcctttttgccatgtatattatgtggtctatttgcaactgtttttttaaaaaagatattaaaagaatagttacatagagaaacattagtggatgttaattgtctccccacctatatttatgggtgttagcgcaactgctttgctagttgcaaagctgtattatcagagtaaaagtgtatttgtatactgtatgggaactaaaaattaagaataaaaccattttcttattaaaaaaaaaaagcaaaaggaaaagaggcctgagcaaatgaagtttgagcagatgactgaatgaagtaaggaagtcctatgagactatttggggtggctggattttgtttggaatgaaaagttagtatatatttctgaaacagaagtaatctttgggtgtttgaaggatggttgtaaggccagtgtaacctgagtagaataggtcacagtaacgaaaatagtaagagaggtagtgaggaactacgtgatactgggtctgatagacgttggttaagattttgggttttattctaagttataaggatgtgtgtgtaatactttttaatatctgaaaagccatgcactctcacaatttctatttcaaaatatctatacattctctcatatagtttattttttatttattttttaaatgttttctgttttgttctttcttaaaaagttatggacagtttcttttactgtgcagaagctctttagtttaattagatcccatttgtcaagtttggcttttgttgcaattgcttttggtgttttagtcatgaagtccttacccatgcctatgtcctgaacagtattgcctagattttcttttagggtttttatggttttaggttttacatttaaatctttaatccatcgtaagttaatttttgtataaggtctaaggaaggggtccagtttcagttttctgcatatggcaagccagttttcccaacaccatttattaaatagggaatctttccccattgtttgtttttgtcaggtttgtcaaagatcagatgattgtagatgtgttgtgttatttctgaggcctcttttctgttcctatatatctgttttggtaccagtaccatgctatcgtcagagtgaacaggcaacctacagaatgggagaaaattgtttcaatgtatccatttcacaaagaggtaatatccagaatctacaaggaacttaaacaaatttacaagaaaaaaacaaacaaccatattaaaaggtgggcaaagaatatgaacagacacttttcaaaagaatacatttatgcagccaacacatatataagaaaaagctcgtaatcactggtcattagagaaatgcaaagcaaaaccacaatgagataccatttcatgacagttagaatgatgatcattaaaaagtcaggaaacaacagatgctggagaggacatggagaaataggaatgcttttacactgttggtgggagtgtaaattagttcaaccattatggaagacagtgtggcaattcctcaaggatatagaactagaaataccatttgacccagcaattccattactgggtatatacccaaaatattataaatcattctactataaagacgcatgtacaagtatgtttattgcagcactattcacaatagcaaagacttggacccaacccaaatgcccatcaatgttagactgcataaagaaaatgtggcacatatacaccacggaatactatgcagccataaaaagaatgagttcatgtcttttgcaaggacatggatgaagctggaaaccaccattctcagcaaactaacacaggaacagaaaaccaaacactgcatattctcagtcataagggagttgaacagtgagaacatatgggcacagggagaggaacatcacacaccggggccttttgcgggtggggagcaaggggaggaatagcattaggagaaatacctaatgtagatgacgggttgaggggtgcagcaaacccctatggcacatgtatacctatgtaacaaacctgcacatctgcacatgtatcccagaacttaaagtatagtaataaaaaagttatggatacataatagttgtacatatttatggggtatatgtgacattttgatataagcaatatataataatccaattagtgtaactggggtatccattacctcaagtatttatcatttctttgtgttaggaacattccaattccactcttttagttttgtgaaatatataaaatatttttaactatagtcactttaatgtgctactgtacactagatattatttctatctagacgtatttttgtattcatttgtcataccctctttaccctcctctcccattacatttccaagtttctggtaaccatcattcttctctatatttccctgagttcagtttttcttttagctcccacatatgagtgagaacatgagatacttgttttcctatgcctggtttgattcactttacataaggtcctccagtttcatccatgtcgttgttaatgacaggactttattgtttcttatggctgaataatattttattgtgtatataccccacattttctttatccattgaaccactgatggacacttaggttgattccatatcttggctattgtggctagtgctgcagtaaacatgagagtgcagacatctcttccatacacgcatttcctttctattggatatatacccagcaatgggattcctgggtagttctatctccagtgtttttgaagaacctcaatactgttctccatagtgactataacttaattttccagttattttatatttctgttaaaattgtatcttttaatttttttctcatttcagttattttgttgcttctgtaaaatattcttggatttctttatcatatgttcaatacattctaatgcttatactatttctagtatttaacttattttacaattccaccatatagtctataagtaatgataaattggtctcttcttcattagaatttatcacttattttgacttggctctcagtttggacattgttggtgtacagaaatgcttctgatttttgtacattgattttgtatcctgaaactttgctgaagttgtttatcagatctaggagcttttaggctgagactatggggaacacaacggagttcacagtatgcacaaaaataataaaatacctaggaatacagctaaacagggagatgaaagatttctacaatgaaagttatgaaacactgctcaaagaaatcagagattacacagacaaatgggaaaacattccatgcttgtggacaggaagaatcaataatactgcccaaagcaatttacagatttattgctattcctatcaaactaacaacgatactcttcacaaaaatagaaaaaaaaactatttaaaaattcatatggaaccaaaaaagagcttgaatagccaaggcaaccctaagcaaaaagaacaaagttggaggcatcacattacccaacctcaaactgtattataagcgtacagtaattaaaacatgggactggtacaaaaacagacacatagaccaacagaacagaacagaacccagaaataacgccaaatacctacaaacatctgtacttcaacaaagttgacaaaaacaagcagtggggaaaggtgcttcaataaatggtgctgggataactggctagccacatgtagaagactgaaaccggagcccttccttatagcatatacagaaatcaactcaagatgaattaaagacttaaatgtaaaacctaaaactataaaaactctggacaataacctaggaaataccattctggacacaagccctggcaaagattttataacaaagatgccacaagcaattgcaacaaaaacaaaaactgacaagtgggacctaactaaagagcttcttctgcacagcaaaagaaactatcaacagagtaaccacacaacctacagaatagtggaaaatattatatttgcgaactatctatctagcaaaagtctaatatctggaatctataaggaacttaaacaaatttaaaagcagaaaacaagaaactccgttaaaaagtgggcaaaggacacaaacagacacttttcaagagaagacatatacacagagccaacaagcatatgggaaaatgctcaacatccctaaacattagagaaatgaaaatcaaaacggcaatgggataccatctcatattaaaagggccaactatgttaatagggctactattaaaagtgccaaaaataacagatgctggaggtgttgcagagaaaagggaacacttatacactactggtgggagtgcaaatgaattcaaccgttgtggaaagcagtgtggtgattcctcaaggacctaaaagtagaacttattttgctgtctttttcttttatggcttaaaatcttcaacttatagtctgtattatagcaattgtaagtattattgtcttcttcttatttcatcgaggtgcactttagatttaagccatttcatatgtttcatgtttgctgatggtttctgatgaatactcttctttatgtcaaatattatagtaaaagagatttaatactaacatagatgaatcacagtttaggcatcttcaggtgaaagacaaacctcagcaaaattataaatggtatattttaagttcaatgcaaagttatcaaacagaaagcctaatataagtataaagctattagaattatgtgaaatacatgtaaacacttccttttgctcttttgtttataacttgtttaagtaattgttgaagaatattttgaaaagtgtttcttattttattgtatttttataaaaagatgtatcctctatctgttaatacattgaaaatgtattaaagttttatttgtgggctattatatattcagattttgtgtctgttctataaacatagtacaataacatgtacatgcagttatagattgagcttgttgagtttttctattaaaattgttcatgtctttctcctcctctatcccactggttgaattgtcaatgctcaggaaaacatcttaaaattttctattatgtttattgatttagcaatttctctgtttatttctaaagtgttttgttttgtttatgtcttgtcctgctgattatcttgatgggttgccctattattaaaattattcatctttttaccatttaagcttttgtccttaaatgacattatatcaaattgaaaattaataaccattttttttgcctatcatttattttcaagtcacattttgccattttgctttaggtgtgtttctccttggcagattttacagtttgtatttgtttagtcaaaactgagtctttgtctttgaataccatattatttacccactctttttcataggtgatgtagttgatttcatttctttgataacaggtatttgttcccatattttaaaatgcactataaacatattatttatttattttttctttcctgggaaaatattggctgattgatcgggttttctaaagttctatttatctctacaaatattactgctcacaaacacagtattctcttctatttgggattaaccaaaattttgaatatacaattataatatagaattgtaagtgttattgtcttgttcttaatttcattcaggggcactttagattttagccatttcatagaatgtttgctgatagcttctaaggaattatctgtttatgtcaaatattatgttaaaagagatttagtactaacatatatgatggtactaaacatatttttcatgccatattcataaagtttatgcatatattcatttaaaaactttataaatttatatttatcataaacactatttctcatactcagtgtattctaccttgagatatttcatcttatttaattttcatttgggtggagcaggtcttctagtaattatcacccagaaaattcaggagtgatatactttctgaataattttacattatgttgtacctacttttagcccttaaatatgtatgatatattggttgagtgtaaatattaatgttgcagtacttttctctcatgtttctgtaaatattctttacttttttctagattctaataccgcaatgagaagtctaataccagtctatgtattttttccagagtgacaggtttagttcaaggctagcaattcttttgtgaccatatatacctctaaacaatgacaatttactcacactctttcttgaaaacccaaagccacagtgagcttggacttcttctccagattcattagttaattcacagtttaactataattttttaatacttttttttgtttgtttagaaaggtaggaggataaggaataatgagcacatgcttgggctaccttcctagattctttctaaagtatatttttaaaaatcctgacagccaaaaccaattgtttaatttaccatttaagaagaataatttagaagaaaacaaaactcaatttatttacttgtaatgatttatataaaaaattaaacatgtagttttatcttcccttttcctgtaaaatgtcacataatgtaccaagtgaaatgagaaaacaataaaaatgttaaaaactgaaaggaaagaatctgaaatacgttgaactgcccacacaagaaatattctaattcttggagcttcagtagaaatattttaaaataaaaaaatgttgccttggacatttctttaaaaaatgaatttattaggaaggaaagaataaaagcagtatccttgaataataacaacttcctaagatttgagtaaatgaggcagaaacacaaaacctcaatgtataattgtcaacatttcataacatgaatattgtgatgggctgttaaccattttccccccactggcctcagatattaacattaccatgagaatacttaggatattttttgttttttatgaagcattaatgcactttgatatcactagccaaatacaaaagaaagcagagcataaagtggctaacaggaggattaaaagcagagcataaagtggctactcaggcaggaggaatttaaataccaatgtcagcatctagagaatattagatttttgttctgaaatggctgaaagtctcaggcaaataataaacagcaaactcagagaaatgctgagggattgaaagtcatagctttataatacctcttttattttatgctattctattgaaaagtgacttaaatatagaatttcagaagaaaataaaaatgatgctccttgatacaaaggtatgtttctgtatatctcttaactcgatggagagcccttgaagtatatcataacatctctgtattaacagaagcttcacataacctgcaagttcctgcctctggcattcaccagagacacaaagacattacgagaggaaagctacccttccctttatctaataacagttcccttgagagaatcccaaaggcactaaggcatgctttctagtatcacaggaagaaccagaaattgcctttccttttcttttttaactccattctctgcaacaataactaagtatagtttttctcttgtcaccctaaagtaacctttggcccttcagtcttctctgatatacgacaggacaaaaatacctacaaaaatgtcaagtgaccttttgtttttcattgcagatcagaattctctcaaataatcacacagctacctcatgctcaaacagaaattagtgatggttagctacaagcaaaatttttaaaattgccagttgacatgcagaagcaatcatggccttatagcatacttcattctcaacatgtttgattaagtaataatatttatatatcttggaaggagctggaagaaaggtggagataaattactattatcctgttgttctatttatcctagttatttatataaattactatattaccctattgttttaaattactattatcctattgtttatctgaggcccagagggtttaaggcatttatttcacaagaacacagttataattagtgatctaaaacactaaaaaaagacgctaaaatattatattattaacattggaaatatgaatatgcaaaatatgtgtgccccagggaaatttagtacttagatttagtgctaaaatttcaactaaattctcaattaactctgtttttcatttatttctgagttccaagaggacgctggatcttaactttaaccttaaccattattctcaagcatctagacccatcgtctctttatcattatatttaatttaactgacacttaagtgcctgcagggcataggcctctaaagagttatgacaagaacacacagtatctaggaggcatatgacggttcctttaactcatcatttaaagccatccctccaatcaccctcttttttttattattatactttaagttctaaggtacatgtgcagaacgtgcaggtttgttacatacgtatacatgtgccatggtggtttgcttctcccatcaaccggtcatctacattaggtatttctcctaatgctatccttcccctagctccccaccccttgacagacccctgtgtgtgatattctcctccctgtgtccatgtgccaatcaccctcttaacctcactgaaactttgtctctattcatacttttatctatctaccatataatgtcagaaagaaatgaatatgtccttctttcaaagctgaccctgagctttcatctgttccccttcaaaacatcacttcccttattactaaatcttctttcgaattttatcactatgttcctttctactgactctttccactctgacatcatacagctaaagttctcatatttttaaaaattattttactttcttgattctgcataagcaactttctctcttaacccaggattctatctaatactttgacagtatgctttcagtaagcattcctaaatgcttatgtaagttattcatagcccttaaaaggcccttttaaagccaggtgcagtggctcatgcctgtaatcccagcactttgggaggccgaggcaggtggatcacctgagctcaggagttagagatcagcctggccaacatggtgaaaccctgtctctaccaaaaatacaaaattagctgggtgtggtggtactcgcctgtagtcccagctactcgggaggttgagacaggagaatcgcttgaacctgggaggtggaggctgcagtgagctatgatcgcaccactgcactctagcctgggcaaggcagagtgagactccgtctaaaaacaacaacaacaacaacaacaacaacaacaacaacaacaacacctacaaggcccttttaaattactcttatttacctgggaaacgtttcatgttttctcattctacaaataggtcacctccttaaatgtagtcttaaattccttgggcaaacttagttgctactatttctgtgcttcttcaatatgctataaattttacatttcttgcatattcttgtaattattagtttacttttatgtcttactcatagacactgaagtttcacacgtattcaatgtatttatttcaaattgcaaggtgaataggatattgccagatttagagattgtgtaaaatatgttcaatgagggaaatgaaaaaggggaaaacaggtaatgtgttgatgcaagtgagagttcaatgaaatattgtgtgaatcatggaaggacagaagaattgagcaatgttatatgtacaaaactaagggagagaaaataaggttgtaaaattacactgaaaaagaggatcttgaagatattggccaaaaaaaggaactgtaatcttggcatgccacgatttttgttccaaaaaattgacagaaaagatcagtaaataaattatttttaaatattctcaaatgggtggaaaggaagttgtcatgcataaattatccccaattgaaagtaaacttgacaaaaactgttgtatcttcgtaaatgccatgtatatgttataataatattgatagatgtgaatatgtatacatatgccttatacactgctaaatattttatatactattttaaaagacaaaagtatatcccagaattaagctattcacctaatgtactggcagatatcctaatctttttaaatctcttttattattaaaaataggattacacgaagcctgctgctcagatgaattttacaaagatatgttttcattaaaactagtttttgtaagtatctgtcttcttttctttcttttatttctcctgagtatgaggccttgaaatttgtgattgctgtttttttgcttggtatcatcttatgccctttgcccctgtgaggaatgatgtggatttattcttcttaaaaagactcaattagcacactgtctctgaatccttctaactttccttgtacattaagttatagattaaaggattacagagccaattcttcctttagaaagagacaagagtagaggccaagatagctgctcactgtcacagcattcactcagcaaaagctgtggtggcagagaatgttagctatgttcccaatatccattctccccttcttccttagtttcagaaatccaagttgaggaggtagtggcattgtactcagatttaagaacaatacattttctagatttacatactgatataaatgatgtatgtttaagttttgactaatgagatgtaagttgaagttgttggttgcacctttgggaaaaactttataaagagacttgatgactagcgcatgctcttcacatgaacaatgcttggagatccaggagttatcttgaaagaatgaggaaaaatgccctactttaaagtatatatactcccagatattaatacagtccaattaatatttttaaaattaattaaaatatttttgtctggtatggttctgaatgcatatttaagtacattttgttatcttattttttatttgaaaggatgctttctaattgctttttacaattatggacaatatttacctggttttggaatctttattctttgaacatatttccttttattagcaactactttaaaatgcttaaatgagtttttaatgcattatttaggcatgattgcattttattctaggggctacctatctactcatgctttatgcatgcttttagctttccttttctttttgagtagagaggactattttcttttttttttttccttcttgtaaggaatattggaactcgttggcaacttctttttactacttctctccctctccatatcatctaatttgaagtaatgtcctactcctattcaattcctgtaaatcaaacattaagcttattctactttacttatattcatctctgtgatttttgatatttgtgttcatcgtgtcagaatatacaatcattccattttatattgactattacttagtcttaaaatataggcaaatacatatttaattattatcaacactgcttacattgatatttctctaatcctttggttgcctaaagggtagagctcattagaacaatatttctgaaattctccatgtttatagcagtttgtctgtcacctatatacttgaatcaactttggctagttacaaaattcttggcttatattttatatcccttgttatctaaaatatattactccattgtttctggcaaaaagaaatgtttgctgtcaaagatttagtagcagtctctgttttccttataagtatttcatcatttttgccttaatgcctttttaaaaattctcttaagttcagtagtcttactagaactggtgttatttctggccattataggtcacatacatggcatgacctatcaatatgtagtttcttatttcagatttttaaacatttatttatatttgttttgctcctttactttggtattcttctattacttgcctatcttctatattttttacttcttgaattaactcctcccctcccctcccctccccttcccttccttttttttctttctttcatattaaaaaaatccccattccatcttctaattatcttaattggttgtctgttgttttaagtcactcttgtgtttcttcaagttttaccttcacttgtgaaatatttttctaaaataatttgttttggattacttttttttcctcgaatcttttttttatgatcaatttgtcattgagtttttctaattctgatttacgttgttcttttatatcctctatcactttttacatttagttacttgaaaagtagagggttttatttttcctgctgttgggatgctattctgttccttattctcttttctttataataatgtcataacaatacgactaaaatccttgtaaagttctattaccctagtttatctgtagaggggattcttccacctaaatcccatataatatatttgtggttgtctcagtacctgcaatcatctgtttgcaatgctgatttccctgtcttctcagcctctttgtcttttttaatatctcggacttagttcatttcttttgctacttttccaatttatatactatacatatgttgtaggttcatatttcttcagaactgtatgtccatgaagcatacattcatctaccagcccttataaaaccaaactgtgagctttctttcaagttcgagtatattataatatattatctccagctggcatgtttgcatacaatcttggtctcaaaatttcatcattttaaattgttttgtcactaaataagtcctgattcaacagtctgttgctataaagagtgttgtagcttattgtgaatatttaatttaagtgttgtattgcaagaaccattgataagaggaaagttgtaaggagaaaaataacatatgttaacttttgtagaaaataatttggcttgaattgatcacttgtttgccagaaaggcaccacattgactttagaataacaatgaaattggcatccttgctataatcctggatactaaaataacatgttgattaattactggtatcaacatttcttctggacattactcttttcaatatcacatttttagtttgcttaatataaatagttatgacataaaaatactccatttgcaaagtttttggaagatttccatagaaatatactggaaattaccataagaccagagagtatacatctttgaaacttgccatggatttagaaatttcattatatttcagcatttgcttatcagagttatttagtatgtattgaggaaagaaactacataggtgtgtttaagtacttttaattcatttataattagcctattatttccattattacaagtaattttatgataaattttattcaaactaatttctacaacaatggaaagccccacgtacctattaagtaagaaatattctctaccttgaaatgcttgtgttatatatgctactactgcatcttcccctgaaaaaaccttttagcttttcaaccagctaatgtctcatttccaagataatgctaatgagaattttagtaaaatagagggtagcaacctgtcatttgacactcatcctgaaggaaggaacacctgcctgaattacatttagtatcagttaatagagtctttctctacacttttcaaatggctctatgtttagaaaaacatttcctaagagaagcatttcctgtactcaagtcatattatatgtaatacataaattataatttacagtgtttactaaaagatgacaatgttcctatgaaaaagttaaaatgattacagtttattgtccttcatcctcctgctatgtggcctctcagcaatttttccttttttatcctttaatactggaatatgtattttcaaggtaatttgttattttgtttcttggtaatttgttattttgtttctttttgctatcagttatgaatctgtctgaaatgatttggccacatactatgagaaaagttttgatgcaactacctgtaaatttacattaagttggaaccattgaggcatgtgtgactgagtgccaatgagacatatgctggcaccatcatatattggcttctttttgtgcattgtttcattttggttccccttgtttccacagtgtgtgaatggctagaaggtagaaactatatattagatgctttttgcaatcctgctatttctgctacagttttaggtgacatattaagtagtcagtcctccttaacctcctgtccttgatcactaatttctccataactaacatagatcttttaaaaatataaatggaatttactatgcatgtgtgtatgtgtgcacatacataaaatattttggtgcttctaaacttatatattgcatgtattcttctgaataacttaaaattattgcacataatgtttgtgagagctgcatttatatactaagctaattttatttttcccaagtgaatagcaattttctataataattatttacctttttcatagacaatgtcatgccaacctaagaaaactcaaattgtaaaatattccattcaattacagataacctttcttctcacttaaaactacttagaatagttagaagagaatagttaggcatttatagaaattctacctttttaaaataaattgtattataattcatttataatttatatgagtttatatcagaattctctaattatttttaaaatgttttatatatctgtctcaataactcctttatttattacatgtggtgtgttatatttttatggtttgagcttagaaaaatttatacaactttccaaattccaccagaaagtgattgctcaccattttaagattttttgtctgtcagtgaagatcgacattttcttttttcatatagaactttcatcttttcttctgagaattgttcctcactatttcatagtttggctggattccatggttatttttattcaaaactttttggttattaatttctttcttttgggggggggcaaaagaagctttctttctttttctttttcttttttatttattatactataagttccgggatacatgtgcagaacgtgcaaattctacaaagaacttaaacaaatttacaagaaagaaacaaataactccatcagaaagtgagcaaaggatataaacagaaacttctcaaaagaagacatttatgcagccaacagacatatggttattaatttctaaagaagctattgtcttgacttttttcttttcttaaagtaagaaatcagttaaaaggaaatttccctttgaatttttatagtgtgtatatttgttgtttattttgttcatagagtcacattctaatttttagttgtgtttttgccacaaaatctgaaaattgtagtttcttcaggatatgttgcattttttgtggcatgaaacatggccaattttcatgaatattttatgatttattttaaaaattaaaactttctgttagttaatgttttagatgtgttcttaatctgatttaggggaaatgtaagtttttctattaaacatgaattatcatttaccattttctcatttcatctatattagtgtctgctctctacattatgaaactacattataagtgcacaaaaactttttactaccttagttttttgaatcttttattctattaaattcgaatagcatttctattttattatctttatgtttaatctgtatttcactttatttcatgcatgtctccagaaaatagtgtatgccagaaattttttatcctaatgtaaattttcttaatcagagaattaattcatattcaggtttattactgttacaatgcattggactcagcaatgacatcctgttttatattacttattcactctttcctgtttttgctttcttttttcattttgtttgattgaccaaggaatttgaagtagtaacttattttatttggataatttagaattcctacaactaattcctgctcttcttaaagttaccattaaattattaaacataaaattttaaaatagattttacatcaacattcaaggttaatgattttttacaggctaattccaaaaaagacaatattttccccttttgcctgcccccaatgcccaccaccattccatgttgagatcagctataacatttgttaattaaaaaaatataatgttatggaaattactttgacatatacgatggtttgctactttcattattctccactattcattgtgtagagtgtatatattcataattggtaaatttaaatgtgcatacatttaaaatttttatgtaactatacttattttctatctctagggtccagttctagttaatgtaaggaacaatactgtcacttccagacaaacatggtcaaataaaattttggatttttttccacctgtttctttactgataaatattcataactggggctagcacagtaattgaatgttattagagaaaagggaggaaaaagatagactatatacttctagatacttgtggcatacataattgcaagattgtcttcataatttatgcatcaaatctaaactactgcataaaaattaagccgttcacattgataaagcgataactaacaacaggcaagtgtatttttcctattttttttctattcacttctcaactgtaatgtaaaaatagatttcatattctttttcattctttactaaggagacactatttttttcagagattcattgaaaataaatatttactaaggatctacagcattcatttttactctgtaagacatggttgctgccttcaagatacttagattttgttcagtaagataagggataagactgaaaagtcaatgaacaagggcttaagtaatattttggaacatcaatgaaagaactcatgtgaacattcataatttactgtgacactgttatttacacagagggtgtctattagtggagttcaaaagagggcaagaccattggcctttacaaagaataagtattaaaggaaaaattcttaactgctgcttgaaatatatcaaggatgactggggattttttagatgagggagttgagatagtaaagtaaagataaaataattcaagagattaaaaaagtccataattctcagtgtaaaattatcttttaaagacatctttctaaacatagagattgctaattacacacagccctccttagagacacatagtatcaacctgactgctcctgtcagattaaatcacagtgggtactttacaatcatctatgtaggtaaccaaaatggtagtacagtaaaagctgcatttactttagggtggtgctggtttgagagaagtgtagcagagatatgatttagtctaaatactcagaaaattaatgcacccctgctactctaccaactgactttgaatttaatgagaatgtgtatgcatacagatttaaaggctatgcattatgaatttttgtctttgtgaactaaaattaacaggatcaaagtcttaaattcccaagttgaaaacctcctactgaatttcagataacaaacaatatttttcccaatcctttttctgatgaaaacttctctttggaaagaataatgtttcttatccaaaatataggctgacaactggcctaattaatcacaaatgacagagaagagaaataaaataaattataaatatttaatgtctttcatatcttatttgaaagatttaaccatcgcacttcattaaaatataaacagttagtgggagaggaaccaaatgctgatgtaaacttgaataactaaaatataggatatcaacaaatacctgcatattgatgtagaaatggaatgaacacttttttttgtaatgacaaatcaaacttctttaaagctgaagataaattaaagagccaaaggtttccaaaaaatgtagcattagctgttctagtgatcttaagtatttctttttacttaagaaaaattactttaactgcagtaatatatgttatgtaaaggcatatcattaatctagtgaaaacaaaacaaacgaaaagcacagaaagtgtatttacctttatgagaaattttcaaagcaactcaaaagtaacacctattggaagtaaaaattaatgaatggaatatggcactaagctaataagttcatattaggccatcaaagtagtttagaagtgaagtatttttagttctctaatccattaatttgacaaatggtttaatagctgaaaagagaaatctcccggacagtatcagctaacccaaaaatcaaatgtaagatctgcataaaggagaaaggggtgaaagatatcattctaatataattattcttagtagtcttacccaacactaatcaatctttacaaaacagtattttttatgttgaagactgcattacaattctcatacatctaatgtttaccattttaacatttaccagtttttatagtcttaatttttttagaatagccatttaaatttaataattcttattttttttgcaacatgcaatagagaaacaggaaagttagcacaaatgtatcagatattttgcaattgcttatattggcaaaaagggcaaatataataaagtatttataaaaagaaatacattcctaatattacgtatttttattttaagaagaagagctgcatttcaagtatttttggcattttgaagcagtggataatgcctgcattggctccatattctgattggagatacagctggtaccttgactgacttagataatataggtcagctagggagttaaatcccagtgggggctaactggtgatcacaaaaagctgtgttccaaaccctggaaactaggaatgttaccttataaggcaaaagagtgaataatattttatgtggcagaaaatgtataatgaaatacaataaagcagattgagacaagggaattatccagtggccccaagtatatgcatggatttctttctaagagggatgctaagcaagctttgagacaaacacacagaatagaacacacacagaaaaggaacagacaatgtgactacagagccagagactagggtgcaacaagtcaagaaatgccaactaccagaagctggaagaggtaaagaacagattattcttcagagcctctgtagggagtgccaccttgctgatgtcttgattttggacttctgatcttaagccaccttgtttgtaccaatttgttatggtagccacaggaagctgattgatacacatcctttttgtttttttcttttgtctgtctaaactaatatacccttgtgtcctgtggtttgaactcaagctgccatcatctcaagatggggaagggagaggacatctgacccaagctataccaataatagtattcttccctcgctcatgcagccatagtcgattaggcgacctgcttaaatttgagatcctctaatataagattcttacattattcatctttcatttattgttgcatctctagaagttagttatgccagccatatagtaggtatttaataaaaatttgatgaacaaattatttgtctaaattagtttttcttcagtgtgaattctggctttgacaaattattggaaggtcttttaaaagacctcaaaaagtaaacatagacatttaaggggatcccaagtccagaggtctgaatttcctctgtctgggcactttattttttatcagctttattggacaaaacaggagacactaatccaaagttggaaattgggatagatcacattttgaaaacattgtctctaaagcctgtaatctcagcactttgggaggctgaggtgggcggattgcttgagcccaggagatacagacaagcctgggcaacatgcaaaactccgtctctacttaaaaaaaaaaaaaaagaaaaatacaaaaagttaggcgggcatggtgactcacgcctgtagtcccagctactcaggagatggaggtgcgacagtcaatcgagcctaggagacagaggttacagtgagccgagatagtgccattgcactctagcgtaggtgacagaacaagaccctgtctcaagaaaaaacaaacaaataacaacaaaaaaattgtctcgtaatatttaatattatttttctaaaactcttgagtaagttgatttctggggagcaggagatgggctaaaagaggtaagatataacaagctggaagaaaaagataacttttgttttcagtcttaatatcttcagggttcagtttcacaatactctcaatattagatattcatatttacccttagcaattgaaattgcaattttacagaaaatcgaaataagccatagtatttgttgaatagttcatatataagtgaagtatgttttctgaattgaaaataacctttccattaatgcagattatgtatcatcttctaattttatacacgttagttatcagaacacttaggtaacatattaaattcaaaattacacggcaaacctgatttttttttaacagaccgtgttcctgggttgatgcatacttaatagactccaatacttttaacagggttcagagttagacactgagttttgtctcatgtatcctcaccttaactatccgtggtactaaatttagaacacagatggacttaattacaaaggccgttacatcttatttaaatttacattcctttttcatgaaaaatttatatgtaaaggcaggtaaaatgtgatattctaaatcaatcatatcaaggcaaatggtaaaattacatcatccacattttttgcaacgatttcatcttggacttaagaatacattgtttaaatatctgaggagtgatcgttttgaaatttagggaatctattttcttcctccaataagatttggctttataaactctggggtgaagggcaggggagtctgattgaatatcagagaatgtcttaaaaacaaaacatcatgaacaacaaaaccaaaaaccacataatcttccaaaaccacattaagtatatcatcttataggaaaagaattacatgtatgattttctaatttctcacacaggcctcattagcatgtacatgttatcaaaaacaataaattaatagcagtaaaatttttatctcaaataacctatattgattgagttacacatattgtgcagcatctatctcacgtttcctataaaggagagggaagaacagaactgtaagaaataccagcaagctacatatcagaaaacgaattccatactgtactttttattaatgcaagtacaaattaaggaaacattattagccacacacaactcatgcttttatcttccatgttaattactattcctttacgattcaattcagtgagtaaatttttatagattatttgccatataaagtaatatatttctactccattaggataatggttggcaaagaaagtaaaatatggtggaatattctatcaacataagggttctgccccaaacagttaaacgcaatatttattttgtgcacttactttacaaatatcttctatcacttattttacacatattgagtaaactgcagtgggtttggggagtgaaagacaacaaaatacttttaaagtctgaacctaaatggtaaattatagctgtaatcttcaacatcatcttccgaaaaaaattttagtgctatattctttctagtttgaactccaaacttctcacaaattcctttatgcatggaatatgtactaatagtgcttccccaattgttttactttcaggcattatttttctttttctcagaattcctgaactctggatgatgctaataggttagtttttatctttttttgactgatttgccatctgatttggtgtttgatatatttctcttctctttttttcattgaaagcagcactcgtttagtttagtttagtttagtttagttttttaggttagtttagtgttgtttctgagatacagtgtctgttgccccggctggagtgcagtggcacaatcccggctcactgcaaactccgtttctcaggctcaagcagtcctcttacatcagcccctctagtcgctgagactgcacgttcccgccaggatgcctggctaatttttttacatttatttggtaaagacagggtttccccatcttatccaggctgttcttgaactcctgggctcaagcaatcctctcgtctcagcctcctaaactgttgggattataggcgtgagccatggcacctgccttttctcttaaagagtattctcttgttctcttgctttgaaggtgtatatggtcttttttttttcctctgagtgacctaatttttgccctaatcctttagttatgtgtttgtttctttccatatgtgaggtgttgacttagacaaatttactgtcatttcaatgtctactaaattcaatttcttccattggtcatgaaaaataatacatcttctgctaagtaggaccatgcttgatgttgtatttgaagtagattgagaataatcagtttttcatattttccaaatccacattttccttagagaaaaagcaaggagaatcaatatactgcagagtttttgtgaagtggagtccttggcttctccagacagtggcctgagtcaccatgaatgaagagcactcttgtgttaggtctactaagccctcaagattcacttttgtggatctgaaacataagtgtttttctttagtaaaatgaaaaagctaaaaaaaagcttttatacttacagattttgcttcagtaaatgtgtatcttgaaattgagaatttgacagggctggataatctagctcgcatcttcaggtaatttcaaattagaagttttaattgtatgagccttgtactttaaacattcttgtttcaaatatattttaaaatcaaatgctttggtaactggggtcaaaggctgagtaataacagtttatgaagtcaaagccagttctcttttttgaagtagaatcctgaaaatcattgtatgtgtgtgtgtgtgtgtttaatttttaaggaacaagatgataatccatatgtaatcctgacatatacttaaaactacagaataagggtaaatcagttatattattttgagcaaacaaaatataacagaataaaatataaaacgtatatgctctgtttttcagtattcatattttcagcacagttgaaacaaaagatgtcaatataaaaagttttttcttaggctttgtaactagtccctccgttaattagagaacaaaatgtacaacatctcatgtatttttggcttggtagttgttactaatatgctatattttctgaatttatgtaaaattgttcttagtaaatggattaccttttctggttactggcagaaccaattgaagttgatgacagattttcttaatgaagtcattgatgaaaattgcatactaggaaatttccaataaatctattgaaagtgcttattttaaatgactaaaaattttatatatttttaaaatgtcttaagtgtctttggattttggaattctcacaaatgttactgtggaaatgctattctgattggattatattaaataaatttattatagggcaaaccaacatgaagttgaataaagcagagggggaattaaccaactgatgatgtttttttccctgtatggaaaagttgaaaagcttaaccctctagagtagcttacacatctcagctggagaattggaaaaataaactaaaaataaaatctaagccctcctattcactgaacaaactgccttgtggccaaggggaccccagaaaagccttaaaactgaattctcagcaataatgagatgggaggtcagacaagccccctaataccctcttcctttggcatttagacacaatgactggccctcattaatgttaaaatagagattataagactgacagaagatactctttgtaacaataagataccaaattataaacagggtgtgaggccatgccaggcaaaggttaagtcacacactcctacatttaaagaataaactatattctaactccttaaggcttctcttttcttttttttctttttctagaagctaaacaacactggcctcaaaataaacagtattaaaatgattacaactcactcagcttacaaaggctgactaattgaccctctgttctgccagccataattacagacaagaaactgattttggtaactctctccagataggaagaatacccaccatggattggttctggccgggtttacagaggctgacacttgggtgacttcgtgtcctgaaaaatccttttgacatatagggcctaattgtagtatatttaaatgttaagtctccactccaaggttaacatggatgtatgaggcatggatgtttcattcaaaatgcatgcctcaggaccaccatcatgaatatttatagctcctcttataacctgttgaatatgtatgtttagccaacctgttcagcataagcttctaccccaactcctgctccttcaaagtgtctgtcttcggtcttcaccggagacacacttcccagcctacagtttggccacctgtaggctgtaaaccttcacaagaaataaaatctcctttctcaatttataaattattatttttttaaagttaacaagaatcacacagatgacagtatagaattatctgactcctgaagggaagcagagatcctgtatggtcagtaaatctacaacatgggatttaaatcagcactattgatcatctaaagatcagcagcagtcataaatttgtcaaatactctttctatcaaatatccttcaaaaaatttgtaattaattagacactagcaccaaaattgttctatttgtgtcttctaagacaatttgtaataacaacaacaacaaacaaattaataggtctcctctttttgtggagagtttccagagaaactgatatatagcgtggtattgtaaattaatatagtcttttcagaaagttacttgtggcaatacaaagaagtcatattcttatactagctattgtttctgagttttcttaaagagttaattaaacagaagaaaacagaaatctacatgaagatattcttatcaatgctatctataaggtcagagattaatgtttaattcaaaattaatgttttgaatatctaattatatagattagctttgtaaatgatgttatgtcagtattattattatcataattatcactattattctgattcattcatttaaagggatgataactgtttacaagcatggaaaaatatttatggtataatcctaggtagaaaaaaggagaatgcaagttatattgattcattattttgacaaatatttattatgtctaccatgtggctagtcacacatttttttaaaaaaagtggtaggcaaaatgtatgaaatccctaactttatggagcttttacacttgtggtggatgcatatgtaaaaaaagtgaccacactgagttaatccattacaagagaactgagtggtactgaggaaagagacaggacctctggagtggatataacaggagaatctaaatgagcctaggatgaaaaaaacttcgtgggaaaggtgcctggagaatgaataggagttattcagatgaagaagtatggaaagtgttccaagtagaagaaaagtcatgggcaaaggccctgtaaaagttataacttcaggaattttgagggtcagaagaatgccaaaatgactgtataatagacagtcagggaggactgctgttaccccaggtaaagctagatcaagcaagatcttttacgtaacatgttaggagattagtatctaaataatagtggcaatggaagtatcttaagcaagtatatgcattatgattctacctctgtaaaacaataaatgaatatatatatagactatatatatagtctatatatatatagtctctctatatatatatatatatagtctctctctctgtatatagtctctctctctatatatacacatagtcaaggggttgaagtgaaattagcaatgactctaaaggcaaaggcagaatttgggttaatttctttttataagagaaaactaaattattatatatgatgccacatcaactcttcaattacatttatatttgaatgaaaaaatctggttttctaaacgcatattaagtaattttaaagttctttaatgtcatttttaggacattaaacattatgagaaattctaacaaataacggtttctaaaaaataattcctaagccttatagtcgatttcttcagttgtaataaaacgtttctctaaaaagtatgtatttgtgtttttaatgtaaagtataagcatgaaagatttgaaaagtctaaaggaactttgagatcaaagctttgtttataggatttataatactcagttgaggataagaattacagttacattactatggtactattgtacagttgtacatactaatattaatttatatgatgataactatgaaaatgtataactattatgccgttatatgtactactgtgaatttgagctatgcagactgcagtgagactattttttgttacattgtattctcttaaaaatttaaagatgctaaagatatttttcatgtatatgaaatgaattatttttatttcattttaaaatataagcagtagaacactttgctttaacaaatactaatttattttatgaatttaataaaatgttaaagtaacttttatagtttttaaaccatagaaagtttctggcattttagggagactaattttctctatatatttaaagcaatggtgttgtcacatcgcacaagaaattttattacacaggtataaaaatataaatgcatcagtaaactaacctaaaagttaatggcataagaaaatgaggatgggaatttgtgtagtgtctatcaagcatttgtcaggatttcataatcaaataagaaatgttgctatttgtggctatgcaaataacatcatatctcactatcctgttgtatttgcaaaatgatatcagtgttgtacatgtatacataatacaagactatggaacaagaatttggctcattatgtttgaagttatataaattcagatttcatttctcagttttccagagagatgacaaatatgcctagcaatcctctatttaattattttagagaaagagattttaaaaaatattttaaacaaaagtactaaagattacttttcctgcactgtagatatgtgcttgattcccttgattagtgagaattatttgtgcatgttaaaggaagtctataacctaagccttaatttcaaacctttcctaaaaacactttttgaaagcttaactagagtggctacatgcttttcacccacgcttatgttcaaacactttcaaggggaccgcacttactttaaaaacctaaaatcacagaagcatgttacattagccaagttcaataaaagacaaccacaaatggaatgcaaaatatcttttcgatctttctgtaatcacttcaatagtaagacagccacctggggctgaatgtgtatcaccagtcatttcaataatgcaattatttgaaaaatataactactggaaaatgctgttggcataaaatgccaaatatgtatgtacatgtgtatactgtgcaagtatacatatgtatataagtagaattcagaatctcaatacctgtgggagcaagtaagtataagctaaatacaatagaaaaaatgaagactgaagtgcatatcatctatgcattattcatacttgaaaaatcttataatcaggaataatagttattgaagtgagattcaggtttatggcaacatttagctctctgtagataaaatctctatcacctttagagggtggatgacatttcaatatcccctaaatggtgctatgtaatctcgcctctctcttcctcatttctagtggtttacttcccccccacccttttttttgtttttacattaaatgcaatgagacgtacttaatgtccttgtaggctcatctttctctacagagacagttggaaaatgccatgagtatcttgggaaataccaatagtggcagacagcattgcccccttccttattcacattttcagggaagcttgatactgattagccagaagttatatattaaagcatctattatatgcctcttattgtgctcaccactgagaacaatagaaataagaaaaatggtttctactatatgctatttatttttagcaaatgaatgtgcataaaataatgaccaacgaagtattaactgggtaataaaaaggacacatacaataaaagtttgacaattagggagacgattgtgggttatagtagccatgaaataattaatgaactagatgtgtcctctgaaatagttaggaggaaacagagtgagtaaaggaaggaagatggcattggtgagtgacaatggagtgataagtcttttgaaacaaagcttatattggggagcaccatattataggaaacaaaaagaaaggtagaggcttgaattgcaagggtgtttgggggaaaattggaagccagtgaaattctagtgaggtagtgattactaagtgttttcctatcattaatctaggagtgtaagagaaaatataactgaagctggaaacaaaaaataaataaataaagagaccaccataataatcttggcatgaaacagtgagatcctggcctcaggtggaattaatggaaattgccaaaataagggaaaaatataaccttgattaacaggaacaaaattgtttgcctacgtgttcaggtcatactaagcaaaataaacttgttccttattttatttttaaactctaattttgattcagaaacatgaggatataaatccatagcagttttttgaaaaaaatgtcaagaacaaatctttaagaattatcaagagtgacttaagcaatattgatgtagagataatattgtcacaaaatctaactgtggtgcaacgtttgcttttctgcctgagctgattattaggcataaacaatcaagagcaagtccttttggttaaaggtgattttgggggattttttgtgtggatgctaaaaaaattatattcaaggatggaaactctttaggtaagatagaagaaatattacagaataaaaaaattaaagcataaaaaagaatgcaaacatgaaaaggaaaaggagaagtagagcattaaagccaggaaaacgatgtagtttttactaaaatttggagatttggagtattgtgagaatttagaacagaaagagaagtgaactagtagaaaaactagatgtatccttgtctgtattcaagaaacttgggtgaacaagggtaaaatcaactgctcattagtgaattaagattcctgcactagttgatttctaattgtctcattttaattaagattttacactgcaagaaactgagatgcatgcaggttagttcagttaatggattgaaaataacgaaacaaaacagaaacatttccaggaaagcaagagagactggaaaagtctcaaaagacctatagtaagtctcatgaggaaaggaaaaatcactcattcaccttttaaaatacaatagaaatcttagcagtccaaagcatgctgtcacctctaaaaccttttagtgggttgataagattgtgagttctctatatctgcttctgtgtctaccttttgcacctgattatcaactaacttctgtaagtattttttctaggtgaggaactctgcctaatcacacatctactcttatagtttcaattccctgatgattgatttttgtgtatttttattaatatcctggtgtgtcgtcccttctctggcctcacgttctgctctggcttcttcttttggtattccttaaatggttttgtcagtaatcaaaaaggacacctgttaaatctggtgtacctcacaagtcaataggtagtgtacgggtatgaattcttattattgtgatctgagtagagggactatgttctccagagcatggcaaacaatctgtgttaactcttcaacagaggtttgcgagcatgacatgcaacatgacatttattaaaaataagtaaaataaaaaattgtagttacaatgaacaaggccatgatacaatctgtttcatatgggctctcttgatttttttttcaaaatgaaaagcaataaaaatcatcattaattaggcatttataattttttagacagtatgttaaatgcttcaatgtataccatctgcaatttttatagcaacccatgctaatttattttactcgtgccatataagaaatgcagaaatagtttcagagttgttctctgaggtgcccaaggcaaaataattgatattagatagctgagatttgacaaaccatgtctctgactctaaaggtctactatctcatttctcttccaaccgccccccggccttcatctttccttttttttattatggttttaaagatgttaaaatctattacctaccctaaggaaataatgtgacgtttggtgacaagaaagctactaagatttatggaggtagttgggggtaaccaggcattataaatcatctttgaacccactcctggaaatagcggacaacctaacagaattcatctgttttactgtttagtgacacccctattttatggagaaaatgatacagtcagaagacctcatggatatttttggtagtaatctcaaagatgtgggtaacagctggcatttcggtaccatttctttgggtaccagttgacgaaggaagagtggtacatacatttagcacatatctcattcttttaagataaagataaggttgttaatgaatatatttaaaaaaataaagacaggagacaaagctgagtatgacaatgtggagataatgatattttatggataaaaaaggttcactgagattaagaacaaactgattcaggagtggaaaaaggtggaggaaaaattcaagaagacttgttaatcaattaggtcatatacttaagatttggggtagaactaaggataatttaatgatacaatactaatttaaatgacacaataccttatattcagatattttataaaacaatattaatagaatagactagaagaatagtattttcatttgtatgaaaataagatgttaaggcttcaattgattatagagaacattaactgttgttttaaggtaaatacaactctaagtagtgttaattaatctaggtcactataaataatggtcccaatcttctcagtgacaaagtcatcttagaataattcattgtaagtttcttatttcaaaggggaatataaatgagatgtcaagagttctgaaaagaatacattagaaggaagatcgaagaaattcaagatgtttgttctggggaagaagacaagtaagtgatatggtaggaagacagagcacttgtcttctaacacttatttattgaacatctatctaccttgtgataggatttaatgaacaaggcagccaacatcctgaattgattaaggtccaccatgatctcattttaacttaattgcttctttaaactttctatctccaaaagcactcacattctgagaaccgaggtttaggatttcaacgtatgaattttggggtgacacaattcagcccataacagtagccacatgaagaatttgcaataatattccagaaagtaagaacatccccgagaaatgaatatgcttgatatgtcaaagaatagcataaaggctgctctggcccaactatagcaggaaaaatgacagataatgcaattgaattgatggtcagggcccagatcacattgggccttagaggaaagagccagcatttcactttcttctcgatgggaagcaagcataggggtagaagtcgggcataatctgacttatgcattaacgggcactctgacttctctatgaacaataaagtataggcgaaagtattatcagtcagaagttgctgcagtaagtaatccagatagaaaaagatgcaaagatactggctcggactaagcagctgtaaatttggtgagaagtggccagattagagatttttttttaaggtaaaaccaacaagacatatgttagattagatgtcaaatagaaagctaatggaagaattaagagtaattattcactttgcctcagttcttaaattggaaaacagaagaaataccctagattactgtagaaaatttaataaggactggtatggaactcatttacaagtagatctaatcacagtttaggaaaaaatttttaactcaaattgtccagtattggagtgaattacctcatgggaaaataagtatctgtcagtcaagttgagcaagatgggggatgggatgtaatccaattgtattcattgttaataagtatggttgaaagaaatctctccagaggtaatactcacgataacatacaggatgatttcactattataagctattgacatcaatactttagggaccattttcaatggataaatatcaatgcaattgaacagcagaagatcaaaattttaatttgtatataacaggaaaatatttccattaaaacattgttaggtaaatttgtattttctatcagtgtgaggagagaaagtttatttgttggaataatattaatggtaaattatttattgagggttctgagacgctatatttgataatatcttattatactttaatcattgcttaaaaaaaagttgcactatgcaactgcataggttcagttaatttcacaagggaatgtttgttctactcaaaggtgtacctcacttctcctcatttccttcagaacaataaataagccagggcataagttatcttgagaacaaaataatagcatgggctaaagaagaaaaccaccttcatactgaaaaaattgcatgaccttgctaatacacactgaagtgaactaggaaaatatatgtgagagtgtatcagggattttgagcaggaaggagaatataagacaggacaagtgaaaatgtattatttgaaaaagcacttttccatttcttatgccataaggacatctggagctgctcttaatacaccactggaatgtttttttgaagcttatacctgatgatagactatggcaaattagaggagatgcataaactaccttgacaaaatgttaaggatagagtcagaaaatgcagagatataggaatgttagaatgaatttattatgtgaatgaagaaccatcatcactctaccaaatttctcaagggcataaataaaactcctttcaccaaaacattaagaactgcactggtaatgaggctattggcatcattgagaaggagagagtggctgatttctagaaactggggttaagagtaggagaagctgacattttcttactatcattagggccagtggaactccagaatgttcatggtcaagtagtactaattcatccaacagagataaagtagacttaatcaccataatgaacttcatggccaaaatggcagtcaaactgccttgaaatacaggaatctgtggtgatgactaatgggtcatgatgttcctagtggtaagagagacgaatagctgcctaaattgattttgacttgcataactagaaaaaaatcacaaactagaaaaaaggcagacaagtcaccaaaacagaaaactgcaatttttcacccaagttgtagatcaaagtaagtttgactaactaccttcaaataactagaagaaaatgttgcagaattattaccaggatacatgaataacattttctgattatttcccaaggggatcgaatgccatttcctagtgtagctggacactgggcaaaggaaaaaaatgcaactcttttatgagcctttgaaggagaaatagcctgaagaatgggtactcaagacttccaggaagtttgcaatgacttgtcctattgttcagggtccggcaaggaacaagatccaaatgttatagatgacaaaaaattctgggagggaggcattttggtagggatagaacacatggatctttgtattttatgttagtgcccattgaagagcaactgtttcagaagagctgcttagtaatgatgtggacaacatgaaacattctgtgaatgtcagccaatccttatccttgactatgcagtactgttgcaatggggccatgaaaagattagccacgggaacagagacatatgagagagaggatggccaataccaggggtttcttctcgtcaagccaatgctgaatgccaaaactgagccattttttattagtgaaaaatgatatgtttataaaccaagggcttgtgacattaaattagatatgtttctatattagattttttaaaaggatggtttatactgactttaaaaataaatagagatcactatgagctattgtaggtaataaaaatggaattatagcaaataaaatgcattgcttttatactgataaaattaacaaaacagtagatgaccagaaagcaatataattatgttatatgcatctggaaagagtattttcatgcttttcctaatattttatgtagattcaaaatgataatttattagtctaaaatggatgtataatttcaatagatgagtcattttcagtaacaaaattggatgcatcatattctaagagttgactgtgaaaaatgtggtgattatcacattaaaaaatcacattaacagtagaactcaagagagcctaatttatacaatgaaataatgttacatagttttaagtgatatgacaaaacttgagataaaacaagatttaaagtattaaataaaaattaagtaataatttttaataaaatgagcctaaaattatcttcttattttaatttttatatcagtatatatttatataacagttggagatgtggcctaagtatccagaggaaaagacccacttccagagcaaaattcctaagaagataagattataggtatattttatttactaacatctattactaaatttcatagacagcagttactctaaaccccatattctgagaggagtgacaaactcccgttttcattaagtatttttcttccttttttttctttttttcttgaaacagagtcttgctctgttgcagtgcagtggcgcgatctgcaacctccacctcctgggtttaagtgattcttctgcttcagcctccagagtagctgggattacaggcgtccgccacgatgcccggctaattttttgtatttttagtagagacagggtttcaccatgttgtccaggctggtctcaaactcctgacgtcaggtgatccaccagcctcggcctcccaaagtgctggaattacagcggtgagccactatgcccggccccctcccaccattcttttttttttttttttttttaatagaaataggagtcttgctatattgccacggctgaactcaaactcctaagtttaagcaatcctcccacctcagccttccatgtagctaggactacaggcatgccccactgcatctggcttttctttttaataatatattaaagtgaataaaactgggttccaggagtgtgtcaaaaggaaatgccatttgaataatgtcactatagtaatatttcctttatttggtggcatatcatgaattaaattgctcacattattcaaatcttattcaaaaaagatttgaacattgttttgctatgttttacaatgctaacaatttatacaagctcaactttcctgggcctcagtcttatgattaaatatgttacctttacagaaaaaaataggtaagaaacataggcaatatgtttgtaacaagagaaaaaaatatatatataaatataaagcagatcactttttaaattttattatttttattttattttattttttaattatactttaagttcgagggtacatgtgcacaatgggcagatttttcctgcctctgtagactccacctctgggggcagggcatagctgaacaaaaggcagcagaaacttctgcagacttaaacttcccagtctgacagctttgaagagagtagtggttctcccagcacgcagcttgagatctgagaacggacagactgcctcctcaagtgggtccctgacccctgagtagtctaactgggagacacctcccagtaggggctgactgacacctcatacagccaggtgcccctctgagacgaagcttccagaggaagaatcaggcagcaacatttgccgttctgcaatatttgctgttctgcagcctctgctggtgataccctgggaaacagggtctggagtggacctccagcaaactccaacagacttgcagctgaggatcctgactgttagaaggaaaactaacaaacagaaaggacatccacaccaaaatcccatccatacatcaccatcatcaaagaccaaaggtagataaaaccacaaagatggggagaaaccaaagcagaaaagctgaaaattctaaaaatcagagcgcctcttctcctccaaaggaacgcagctccttgccagcaatggaacaaagctggacagagaatgactttgacgagttgagagaaggctttagacgatcagtagtaacaaacttctccgagctaaaggaggatgtttgaacccattgcaaagaagctaaaaaccttgaaaagtagattagatgaatggctaactagaataaccagtgtagagaagaccttaaatgacctgatggacctgaaaaccatggcaagagaactacgtgacgcatgcacaagcttcagtagctgattcaatcaaatggaagaaagagtatcagtgattgaagatcaaatgaatgaaatgaagtgagaagaaaagtttagagaaaaaagagtaaaaagaaatgaacaaagcctccaagaaatatgggactatgtgaaaagaccaaatctacgtctgattggtgtacctgaaagtgatggggagaatggaaccaagttggaaaacactcttcaggatattattcaggagaacttccccaacctagcaaggcaggccaacattcaaattcaggaaatacagagaacaccacaaagatactcctcgagacaagcaactccaagacacataattgtcagattcaccaaagttgaaatgaaggaaaaaatgttaagggcagccagagataaaggtcaggttacccacaaaacgaaacccatcagactaacagtggatctctcggcagaaactccacaagccagaagagagtgggggccaatattcaacattcttaaagaatagaattttcaacccagaatttcatatccagccaaactaagcttcataagtgaaggagaaataaaatcctttacagacaagcaaatgctgagagattttgtcactaccagggcctgccttacaaaagctcctgaaggaagcactaaacatggaaaggaacaactggtactagccactgcaaaaacatgccaaaagcagatcactttttaaccccctgcatacatgtaaccaattgttcccatttaattaatgaaggcttccatagctttggaatagattttcccccaagggttatacaaatgattaattttaacaacatttcacaattgtgatcataacagctcaaaagaaaatgaataatgaacgtgaaacattaacacaagtatattctcttttaattatttgttgtctagttttattgaaattgctcagaaataactaaaaatttgaaaaataactatagtcatcaaactcgagctgctataattataaactgttgacatactatgtcattgttaaccattagaaaattaataccatgtttctgaaaagtcaatatatttgtaataacttagaaacttcattgtatataagttatgacacaaataattaaaagtactcattttaaaaatgtatgcctttttattagtaaaaatacatattccaccattcaggcactataaaaatgtgctctttttcggttattactttctttcaacatcctaacatgtaaaatctaatacatttgtgccactgttattattactgtcttctatattctaaagtatttttatgtggcaacatcacattttccttatacacttttagtataattacagctatgcaaaaagttattataattgtagtgcttaaaatttatatgacacttttcatcttatctaagttataactaaataggtaattaatctataacatctctaaagtggtgtgcaagcatttcatctacgttaattatacaaacgatgaaagtaaacattatactacatatatataaacactgcaagatgatctagtcagatggaaatggttctattaagcttcgaattaatctgctaggagatgctataaagtgcataaaagagggatcaacaaaacaataagcagaaacatatgaaaatacttgaaagttcttttaatgtgtgtgtatgtgtatatgttcgtgtgtgtgtgtatatatataagtatgcacaaaatgatagtattcttaatacatcatcaaaggtgatacaaattgtgtcaacacagataaatttttatttttacctatttctaagtaattaattataaaaagaaagggagaggcataacgcattgatagcggcattaaaatatatattggggaaagatggccagtaggatatcactgcttttggttgtatctagacaagccagtattagtcatgattaagtcattcattctacaaatatttaatgaacttctactctgtgctaggctctgctgtatgtgctgaatgcaaagtgccgaccctcccagaaattactttccagtggccactcaagatttctttgtgaatggtatttctcctttagccagctcataaaaatagcagctgaaaaagaaaagttgtagaatccataaataactgtcaaagtttagtcagagatgattgcagtgtcctgagagatttgacagtgtaagtgctgggagtgatttgaaacaaaaagtatatgattactgttattaagagtgtttttcatgggagattgtatcagatgcatgatggtaggctcaactatggaaaaaaatattatccttagtttttgggcttcagatatattcataatcatctgaatgtagtttgagcacagagaatctatgacttcagccttttttatcttacacatgtaataccaaatcttcaactatatttgctatactggaggattgttagaattaataataatgacaagaatatctaacatttattactgagtgcttggtatgtactagctactgttttaagacatttcatgaattatctaattggatgttcatatttctttgaaattccagtgtgaagtttttctttgtctgtaaatgtctttatagtaaaaacgatttgagtcctggacgtggcatccttggttcagttttcattcaattattccagcaactcattatcttgttatatatttgatgcatttaagaattttttgaaatgcctcaatcaggttattttataaaatacggacgaaggataggctttagtttctattatgaaattactagaaagtcccttgtatgtgcattttacttatttaattcaactatgaaatgagatgtaggaaaaaaatagtcccattgttatccttaaatttcatttttaatcattccccaaatgattctacgactccaccgataggacaaaaccaaagtaaaataagccaaaagaaatagatggtgaacctttttacagttcctggagatatgagagtgatttaagaatttttcaaagataacacggactgtatacacttcaaaattatgagttaatttaaaaatacaacctctgaattacatgcaatcttactacactacctgtgtcattagcatctgcttctctcaaaaacagatttgcattctccaaactcacttgcctatcatgtatacttaaaactaaagttataataagctgtaaaaatattaatgataatttactagtaggatagattacttaaaaacatgtcaagtgttacgctgagtgcagaacagaacaagaaaacacagaataatggaaagatataacaatactgtaagttagtgaaagatacatttcgcattctaagaattttaaggaacctttgataaaagtggaaatattgggaaaagtgtaaagtatgaggttttgtttgttggttggtttggtaagtcccatcctggtaaagctcacaaaacatcctaatttgtagagcaagtgctaatgatcagtggagcagatgtggctcataaaatttcggctgaaaatgactataatcatcagtcttagaaaatagcagcattcagaggtctctgtggtcttataccagataggctattcagagaggtggaagaggttgcttcaggtactaggatgtagttttgggagacttatagtttctacctggcacagagacagggtcatacagtaaatctggtgcattccttttagtgctataattttaccaagcatggagaagacataatgctgaaataaatttccctgtagaggtgagggcatatttctgggtctgtccccagtctcttgtcattgataatatttgtatcagttctaaaaaccaggaaaagatggtatccacattctacatacttgaaggaatataggacgctacaaaagtgagtggaaatgtgaccagaatgaagaaagagctcacacagcctgtaactcacctgtttgtatctgacaactgctcttatcaggaaagttggccagattctgactaaacctcaataactatcttatttggaaggatgaaggcgggatctgacagtgttccagtgtgtgtatagagaagagttgtggaagcaatgtgtttggttataaatctgaatctcaccaacacctgtggaacacacatcagctattggagatcatatcaagcagggattactccatgtacactagacatatatactgtacctatcaaagagaactagcattttacttatagtagttccaggctgctacatcccacacagggaaaaaaggtatagcaaaaagtaaatgctcactgtttatggtgcctttgggtctcattcatttttatattactgcatctctgaactgatgtggttcagccaagtaaaataaccattcccattttttcccttcttgactcatataatgttacagatcatctcaagacatcagatgacccaataacaaagatgaaaataaacaacaaataagaatggcaaacagtaaaactactagacatatgaaaacaaagagactacgttatagaaaaagaatagtttcctttcaatgaaatagaattattacaataaacaggagggcattttagaaaatgtctaatttttttgaaaatataattggagaggacaaaataccaagaaatctagagcaagttgtatgtgataaactaaaatcttgaaatgtgaaaggtttaatggagacagaaaaagtaatatcaaattttaaaatgataataaccccaaaaggaagcaatgagtgacagctgcataaactaaaaaagacattttatatgagtctgaaaatttctattggaaatcagaattttttttcatttattcactaaaagaaaatgtcttccacataaaaataaaagaaaaaaaatgagaaaatcaagttaaaaatcagaaaatattatgtaacacacaagattgaatctactagttattagtatacaggaatcagttaaaattacctatgaaaagacaaggatttccagatttgattgcaaaacaaaattaactatatgtcatttattaaagacaaagcagaataaaaattgtttaaaaattaacttcaaacaaagcctacttaaaatgctatatgtaactgtagtattaatatttaatattgaataaagatgactttaaaaataaagtgtctcatattactaataaagaatatatatgtatataaaatgaattataagccattagagcacagcagataatattaaaaataaaaagagaatttaacaaaagtataagtatagtggaagactccagtgcataacttattagtccttaagacatcaacaaagaatacagactatcttaattacacaattaaaaaagccagtttaaccgttgtactaaatttggcatggaacacaccaagaataaacatattttccaaaaactattgcaccaagtcaaatatagaaataagatatctcagtttctgacattgtgataaaactggataatacaagttttaacaaacaaaaacttcaaatactgataaatgtatatcaaaaatcactatcttaaataattcatttaaagataaactcaaaactatgatatgcagaccagttaaaaataatagcagatatatacagtcatgtgcagcttaacaacaggaatatgttctgagaaaatgcattgttaggcaattttgtcgttgtgtgaatgccatggagtgtactaacatgaatctagatgtatagcccaggggtccccaaactttttggcacctgggaccggttttggggaagacaatttttcaatggacggataggggtgggcagtggtgcagtataaagcggggatggtttcaggatgaaactgttccacctcagattatcaggcattaagtagattcttacatggaacacacaacctagatccctcacatgtgcagttcacaatagggttcacactcctgtgagaatctaatgctgcagctggtctgacaggaggtggagcagtaatgcttactagctggcggctcaccacctgctgtgtgacccagttccaaacaggccactgatgggtacagatcagcggcacaggggttagggacccctggtatagcccactacatacctaggctatatggtgtagcctattgctcctaggctacaaacctgtacagtatgttactgtactaaatagtgtagacagttttaacacagtggtaagtatttgtgtattcaaacatacctaaacacagaaaaggtacaataaaagtatgatataaaaattaaaaatggctcagctgtttgggcacttatcataaattaacttagtaggactggaagttgctctgagtgactagtgagtaaatgtgaaggcctaggatattactgtccactactgcagacttcataagtgctatacacttaggctatgctatatttataaaaaataatattctttcttcaataatagataattacttcaacttatcttataaacattttaattgtttttaattttttggctcttttataatgacacttagctgaaaacacaaccacattatgcagctttacaaaaatattttctttatattcttattctataagcttttttatatttttaattttttaacatttttgctctgtaaacattttgttaaaatctaagacaaagacacacagattagcctagtatgaaacagggtcaggatcatctacgcagtgttttccagctccacatcttgtcccctggaaggtctttggggcagtaacacaagtggagcggtcatctcctatgggaacaattccttcttttcttttctaatacctcctgaaggatattccagagactgtttcacagttagctttttaaaaaaataagtagtacactctaaaataatgcttaaaagtatagtatagtaaatacataaaccagtaacacaatcgttctttagcattatcaagtattctgcactgtacataattctgtgctatattttcaaatgacaggcagtgcaatatatttgtttccaccattatcatagccaacacatgaggaatgcttgtcgttctgacagctaagacttcattaggcgacaggaatttctgagttccattataatcttatgggatcactttcatacatgccgtcctttgttgactgaaatattatgcaacacatgataatatggcttggctctgtgtccccacccaaacctcaccttgaattgtactcccataattcctatgtgttgtgggagggacctggtgggaaataatttgaatcatgggggcagttttccccataccgttctcatggtagtgaataaatcacacgagatctgatgggttcatcaggggtttctgcttttgcatcttcctcattttctctggctgccaccaagcaagaagtgcctttcacctcctgccatgattctgaggactccccagccatgtggaactgtaagtcccattaaacctctttttcttcccagtcacgggtatgtctttatcaccagtgagaaaacagactaataggcatgactatatatatcaaaatacgtggatctgtgttcaaagaataagtgataaagaaggaaaatgcagctcaataagctacagaagaccaaaataacacaatattttcttcaaaatatgagccagagtttagtacttctgctgcatttaataaagtattatgggtttttttcaatgttatatttttagaatttttatagattcaggtcttaggtttaagcccttaatccatcttgagttgatttttgtataggtgagagatgaggaaccagtttcattctcctacatgtggctagccaattactcaacaccatttttgaaaagggtgtcctttccccactttggctttttgtttgctttgtcgaagatcagtcggctgtaagtatttgggtttacttctaggttctctattatgttccattggtctatgtgcctacattcacctctgagcaagaggtgaatgggatatgctgactgactttggtgcagaataattaaggaatcagagagactgaggggttgaggaggaattatttaattatttaggtgcactgacccagtcggattaacatccaaaggactgagccccgaacaaagagtcaagctaccttttaagcatttcgtggggtggggggagatctgtgcagggggaagcatattacagaagtgagaaacaaagacagttattcaattaagacatgcattacattatttattacttttcaaggaacaacatgttttacaacttgagattatctgtctagtgaccttgcagctgcacagctagagaaacagtcttcacaatgcctgggaaagggagaaataaggctcactagccacagagagaaaaacagagagttaattttaaaggactccagcctttttctcttcctcacggggaactgggtttgcttacatacaactgagtttttgcttacacaatctttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacacgcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccacaatctttaacttcttttaattcctgttccaactttagcaaatcagtctacccctacaacataaagcacatgcactgtgtgaaaaatgcctgagacactctggaattgggatacttttactaagagatagagagcattaactctgaggagtgatgaaagttggttatgtaggatttaagttgaagtttttaaacaagtatctatgattgcctatactgatggaattatgttccctgaaaagcagataaatgattttgttttatttttacagcccaaaggatagctgacacatgagcctgtgggtttttaaacaaataattttcatcaaaaatataaacatttaaatttagtcttataaaagatgcatttctttgacaatgttggttagtactgactaataaacattaaagattgttatcacaaaaatgaaaataccccacataaatccatattgaatatgaaatataagaaatgtgagaatgattatttccatgccaaatgtaataaaatggctcacaatacaattttagaaggataagcaacatacgttttggaattctgattttttagggtaactatatctaggaaaaataatatctgtattttataaaaagtagataatataaggcaatgctttcctaactcaatacaaatggctgacttgaacatgatatctgaataagaaaattctctagtgttgcttttcttctttattgagaaagctgatacaaattcatatgtacaaagagtaaatataagattaaaatattaatttagactccagtagaagtaatgttttcaatgattttttttctgaaataggtatgagcttataataatacatccattacataatcttaaaaatttatgttggtatctggattcaatatttattttaaatttataaattttcagtaaacctggtcaaaatattcctcacctgaattaaacttaccactgagctaaaaccatattgtatttagtttgaatatatgctgatgcacaatactacctaaccattataattatttttactctcaccaccatcaccatcatatctctattatcattattattactagtactatttctactataatgttgactacctttgctgaaactattaaaactgttattatataataactaattcatactttgttagttcatcagtgatagaactatagtgaaaacatctctcaagttttccagaccttaacgttgaaaagcacagcatttgaaatagacagatcatgccaattactagccatacggctttggacaagtaatttattctctctgaacctcagttaattcctccataaaatgtgataataatatctatctcttagtctattgaaaaatagtacaataatgtatatagaatacatggatctagaagctgatagtacatataatattctggggatcaataaatactaattcatttctgatccaggcaaatgacccttatctttctgtccttgttttaagatgttcttcatagggtgagttttctattgctctcaaaatttcatatactcatatttggacattctctaggtccattacatatttcttgaagtacaaggttctgaataatagctgatacacatgatctacaaaggggtattttgcaataattaaaagttatgctgaatttggcatttattcttttattttgtataaattttttatttcaatagacattatttttcattgtcttgagaaaaatgtgctaaaatattttaatgaatttttactggctttatgtcattagtcagactttgatgtttatcttacgagacccttaattcttttatgataatttactgataatcaagatagtagtatcaaagtaaggaggtgatttataaaaactggtttttttttcagcctgcacaatacaaccgttaagaaaatcttctatttaatttgtaaaaataagctgcttaggctgtatattatataactaaagtcttggctacattattatagcagccataattaatagtcttcctcaaatataaactattgtgtggcccatttaattcaattgtaagaatcaaactgactagtacatttttaaaacgagaatagataacactaaaggcagtaaaattataaatgacacaagtgattaaaatgaaaaattccataaatttttttgatggtaagaatttagtctctctctggacagctttcaacaccaagcttttttaggatctaccagtctggggaagtttgtacatatttattctcatgctgaaattaaaaacaaaaatctctttgtcttgaaattaacatgaatgtattcaatgagtactcaataaatactttctgattatctgtctgaaacatttgaaatattttctttatttgtaagcaaatataatatgtgacttataacagaatggaatgagcagttacataccaaggagaatatgaactttcctttttcaatataaattgattctaaaattcaacagtgtttagacgattctctttttttttgcctgaatttttctattgagcttatgacttagaataattcttcctttcatcacttcttccacaatcttatgaaattataaaacaattacactacctgtagaaactttcttgtaattaaaacacaagtgaaaaactgacggctgggcgcggtggctcacgcctgtaatcccagcactttgggatgccaaggagggcagatcatgaggtcaggagatcgagactatcctggctaacacgatgaaaccccgtctctactaaacatacaaaaattagctgggcatggtggcggatgcctgtagtcccagctactcgggaggctgaggcaggagaatggcgtgaaccctggaggcggagcttgctgtgagcagagatcgcgccactgcactccagcctgggctacagagcgagactccgtctcaaaaaaaaaaaaaaaaaaaaaagaaaaaagaaaaactgacagtagggttaaatgttattatttctcaaaaggatcccaaattgatatgtcaaattaaatcaaagtacaaatttacttctaaacatggcatcattcattttttcatcatattgatggattcagtttctttaccgagtctatatattttctcagttcagaaacaaagtgacttgttctttatattactctccttgggagaaacatctgctaagtatttgagacttaagtattttcctgtgtctagaagaagtacctttgttattgctttgtttcatacctatatttgcataattttgttcaagagaagtatactttcttttccaattactacctattagaaaaataagcagataaaatgtacttagaaagcacatgttaagtaatttgctcatttatatttgattagattgctctttaattgtatctgggaaggtttagagcgtagagagtgggaaacaaatacttaagcattgcagtagcctgccacccatcaaaagcacttcacttcttaaatgtcagtatccttatttgtaaatgacgactttgttacttgtcttgccttataagcttttggaagcattttagagtaaatgagttttttgataaagcactgcaaatttaagatcagtttgataattttctctaatttaaaatgtacaataaaagatggacagcttatcttttatgaagattccttaaaagctctaaatacaatcagggttacttcactggattaataacagaattaagtcagtatttattgcactaacttcctacacttattataatgcaggttattacctgtggtaacttcttttctaataaatggattcaaaatccttatatgtaaagatccaaggagctgcaatttacaatgaaaaacagtttgatgcttaataaatctcctttaataagcattcagttaagtaaaagtgttaaaattttggtaaaaatatctgtaagaatttattcatgactttgcaatagaccttttggatgacacatattcaattagggaaaaacaagatgaaacaaaaacaaagtaatcatctcattccatggagaacttagaaatatgcaatttagttgctaaatttaggttttatttcaaacttaggagattttattcctaattttacgtcactataacaataactaaaaatactaaaaagttcaaatgctacgtttgcattttttatttttcttgaattcaagaagaaaaaacagcatataattaatcacattatttctagttatgtgttttacaattctatgttactcataaatcgtgaccatttttgttttcagttatgatagccacttagttagactcaaataatgttttctaatagtcttgtctaaataattcacaaacaggatccacaagttccaaaatgtaatattttatttgattaaccagtaatttttagtcctcatttttgcttggacataactttgtcaagaatattataggactatatacatttcttactatctatattcacttcaaaattttagctaatatagatttcaagttcttgtttcttgcagaatctcccaccccaaacccattataaaaaggtttgtttggaaaaagaaatatttttttgatatggtgtggtttttgttgtaagtagggtttataaatttaaggaccacccttcatccaccagtttttaatttaatcatgggtttcttgtgcctgatagcagcataacccatttttctattttttttcctttgtcaccctcactaatgaaaccagtaatagtcctgaaccccatgccgttttgtcatgtagttacagcttgtccttttataaaagaaaattagaaaactgctgagtgttatagatattaatggttgttagaaaagcataataaaagcctctctttctggagcactgctaagcttttatgtcattattcatgagtgactaatgcattcaaagaagagtgccgatctctaaggctgggatgatgaacagtggagagggacagaatggctaagagaaagtcgtttgtcaaatgtgaagatttaataacaggcttgcctacaataagatatttcagctgaacttagaaaaagaaacttttcttacatatgaggtattattcatggtatttcaaatcaccaggaacaaatctataggatacctttgtttaaatgaatatttttcaggaacacacacaacccccaaatccagaaagtaagcgtcttatgaaatgccattgaactatacctgttttatttcttttatcataccatatcacatatatattgctcaatttgtgggtagttaaaagaatcataaatagagcatctggatttgttggtgttctttgactgtaagcaatgaaaaccaactcagggtttatataaaacatgagtttattagaaggatatagagtagcttttgaaatcctaggaaagtctgaagatcaaggaggacaggatcaaagacgtttctagaagtatggtaggaggaactaatggacagtctcatgagggtaatgccattagtaaaaatcacctcccaacatttttgttttaaacgtttttcagttcaaatttcaaattccaaagacagacagccatatgactatcaggggagagtatgtgcgtgatcttatttgtaaggtttcaggcaaaggctggatggtgtaattacgcaagcaaatattgaggttgtattacttaaaaaagtaagggggggcagacaagataaacgctgggaagataaaaggatagttatgaactatacctgccttctggatatctctcaggcctatttattttctttttccgcaacaaacacaaaattatagtgaccatttacatagtgtcctaaactacatgctttcctgtgacactgattagaatctgtcccttagagaatgtcagcatcatctttgatttagcagcatcttaatgttgtatagaagtgtaacaacttataactgcaggataaaatatgtttttcagattaaggtgatcaataacctctaattccaaacacattattgctaaattacgatgcatgtgaaatctggatacaagttaactactgattaattcattgtgactcgcttggcttagggatacagtttaaacatggaaagataagagaagaaaataattttgttcatttggactaaaactgtagttttggtttcttcagaacaactcaagaatttatattattactggagaattagttttgcttcattttctcatagattagtaatacataaagggaatttgattttgcaaacattattgtttaaaacatcaataaatatatccataaaataatcactctattagtctgttagatagatcagtcatccattaattcaattaagaattattgagtcttttatgttctaagaagtgttctaaaaacaggggctctatttggtgggaaaaacaaaatgaaacaaaataaaactctgtctttatgtagctcacattctactggaaatatacaagataaatatacccatgaatatataataaaatgccagctagttgcatgtgctatgaagaaaaaagaaagcatggagatggagaataatggaggtgggggtggtgacgtggaggacaaatattttagatagagtggttaggaagggcatctataagtgtgtcctttgaataggaatgacaataagattagacaagcagttacatcacgaagacgttatgcaatgtgaaagagttggtcaattaacatctgatagggtttcgttattctttaagtgttatattactcaagatcccatcagttatttcttttcctaccctgcaaacatttcctacattctcttatccactcatatctttgtttttttgtttttgttttttctttttttgagatggagttttgctcttgtcatccggtccggcatgcaatagcgtgatctcagctcactgcaacctccgcctcccaggttcaagtgatttcctgcctcagcctcccaagtagctggaattacaggcacacactaccacgcctggctaatttttgtatttttagtagagacgaggtttcaccatgttggccaggctggtctcgaactcctaaccttgtgatccgcccacatcggcctcccaaagtgctgggattacaggcatgagccgcgcgcctggctcactcatatttttgactataaaaatatgataagattattatatgcgaaatcctatctggtgtcctgagctccattacagacttcagacttcaactgtttagtgtctgtcaggataccagaatgtcccagagtcaccttatatacattctttccaagtcgaaatgaattattttcagcatcccattcatattcctttcttaactctgtaaccacatatagaaacctacagccattcttgactactttttcctcatggaaacataagactcaatttattttgcatcttaaatatttcataaataaaaaagctgcttctgttcattctgactaccctcatcctttatcattgattacttgcacttttgcaacagcttcccatatattttcctaggcttcaattaaatatcctcatctgtccttctactgaccttactgagataattgtatatatgactttgtcaggctccttcttaaaaccattcagtgactgttattgcctaaagtccaagctccttataaaacattacttcttatataatcagtcctaagtttaaacaagccctttgattaaatctaataaattcttatcagttctttactcaccttatacgctcaagaaaagtatttaacaaaatcgaccatgtctaggaactctctttggattctgtgatgccatattttgcagacatttgtaggtgctatggccagattccttccgattacttttatcatatctgcatacctatactcccctcctatgaaacttgcttctaacttcctgcatttgcagttaaattttaaggactgcatacagacaactgtgacccttttgcagagaacagacagtacgtgggagccaataaccacatggagctgacttcggcaaataccctatgagagtataaaagttcagctcatttgcatggagttgggaaaaattctgaggagcattttacccttcaggtcttgcctaaggaagcaggctacagttgggattttcccaataatcacacacttacatggtttcttcctcttccctactcccttaccagtttctccagaaatacttttctaataaatcaccagaatgtgaatcacgttctgaaaggcctgcttctgaagacatgattaaatactccactctatcctgtttcctttatcctgcttggctcctcttccttgctttccgctaccagcttttccttcttcatccaacatacaaattcctgagttcctcagcactcaaactcagactcatttctcattgcactctataccccctccttaggcaattttgcccatacctatgactaatgttacaatcattttttttttttcactaccctagacttttcttctcagggttagacaatatacctaactgcctcctcaggattcccacttggatatcaggcaactcaaactcaatgtatctcaatgatctagctcaacaaacattgtatataacatatatatatatttccatatatatccatatatatatttccatatatatatcatgtatatatttccatagatatatcatgtatatatttccatagatatatcatgtatatatttccatagatatatcatatatatatttccatatatatatttccatagatatatcatatatatatttccatagatatatcatatatatatttccatatatatcatatatatttccatatatatatttccatatatatccatatatatataaaatacaaatcatctctatattaggtactcacactatggaggaaaattaacaagagaactgctggcttaagcgggcattcagacttggaggaggaaggtagaaagttcttttggactagtgtcaggaagagaggaactttccttataaattagcagccacagacagcctgccttgtatcaagaggggtggagaggaacagttagacaataatatcctgtgcaagaggatgtggggaggaacagctggaagatcacgtgtgaaaggccacaatggaaaatgctgtgtccttcagagtctctcccaacatcatcttcctgggtcctcatgacttccctccatcttgtttgcctcaccctagagtaattaactatatttctactgaatttttctgataattttcaaaatattttctttgcatctaatcttatccttctatgatgtgttttacagtgttttattaagtatttagaaattataaaaatcattaaaggctataaaagataagactaacatgccaaatgactaatttatccagcagtttaagaaaccccctgggtgcttctctctttcctcaggcatgaccatttttgtgacttttagtttcatcagtcattcccttgatttccttaaaattttatcatttatgtctgtatccctaaaatatattgtttatttttcctatatgtttaaaagacttaactataaaataatactgtatatattcttctatgacaacttttttcactcaaaattatgttccttatcttcatatatgttatatgaatctttttttaaaattttcacggatgtataatatttcattatataagtaaaatataacttatttacccattccaatgttgatgggtatttgggagtttttcaatttctaaagattaacttaataactaacatgaatcattaattaatttacaattataaaaaggcatttcaatgaaaatgtatatatatgctttctgatatacaaatataagagtttctttaaataagaatagaaaaaaaacggttctttgaggatatgacttaagctttactagacaatgccaaataattttccacagcatttgtatcaactttatattcataatcctacctgcagtgcatgagaattttagctgctctgcatttgcattaagagtcatccattcctcatccagcagttactatgaccttttacaaatacaaatctgattaagtcacccaaaccttgcctaaaagcctttaatggtttctcaatgatcctaaaataaattctaaaagtttaacattgttgaaggattctttttgccctgacctctccctcatttagtattttatatcattcttcttgccttctatgtctatactggccttaaatttcttttttctgccccaaggccttcatatgataaacttcttcctggaactctttaattctacctgttcctctgattaacttttctcctttagtcatatattaaatgtcattacagcaaggaagcttttctggactcttcagaattgattaactcccctcatattgctgtaattacacattttctaaatataacatttatctcaaaaataatgaagaaacaattgtggtttaaaatgtgcccctatgtcctttgcagggacatgaatgaagctggaaaccatcattctcagcaaaccaacaaaggaacagaaaaccaaacaccgcatgttctcaccacattatctcctataagtgagaattgaacaatgggaacatgtggacacagggaggagaacatcacacaccggggcctgtcggggggtgggaggttagaggagggatagcattaggagaaatacctaatgtagatgacgggttgatgggtgcagcaaaccaccatggtacatgtatacctatgtaacctgcattttctgcacatgtcccagagaacttaaagtataataaaaataaaataaaataaaataatatgtgccccctaccaaccttcacgttcaataggttcaatcatagtttcttgttctgtgttgttcacaaatttatttagagcaactagaatgtacttgacaaatagtcaatgttcattatacatgctgaatgagaatgactaatctcctcaacacatacacagtatagtttatattaattttcattctagaagagatacatttttattcaacccatagttatgttattgttttactttgaatacccccaacttccaagtgagtggtatgcttttccctgccattgatgccatgatcttctttgaccaatgaaatgtgcagagtgtcatgaaatcagaaaggtgaaatgtgctcattcttttaggtgtgccttatttccttccactggcaccatgagagaggaacatggttgagctagcttgctggtctctgaaaaataagtgtcacatagacaagtgtagataagccaaataccatctgatcaacaaattcagagataaatacttctttttgaatgcctctgagatttggtggttatttgtagacagaaaaagttaacacacagagtagataaatttttacaaaggatacaattcttagaaggacacaagtttaacagagacaagtttctcaaggaattatcaataaaataaagtgaattcaatttaagttgaaatataaataaatagctgctcaaattcattttttcaaaataacttagatgaaaatgaaatacaaagttaaacactggaaaatttgagtgaagaactgcttgattttaaactgattataagccttttatcacataaatcttttcatgtgtctaggcataaaacagtaaggatcatggctgtcatcagctatgaatgacaatataccttactattgtatgggccagctttaaactgaacactttctattagctgtacagaaagggttttgtaatcttttcttggaatggcccctatttttcagagctgaaatataaaatgctattaaccaattaccagctatacctaatgttcaagtttagctttttagtcataaagaaaaaaaagctttttaagtttcagaggaagtgagtatatcataactaaaagcttataatttaactcatgtagattatacaattcaagtgcaattcatacccgctaagactatttctggtggcttcagcgactggaaatatctctaaccttataggccaagaagagacccgacaaaaggaagcctttcacttcatgccagtgtaagcttgatgtcagcattttctacctttattaggagagttactgtccttttcttacaggggagtggtcttatgttaggatccaaacaacactaatatgaggaaacagtaattctaaggaagcctcatcaactttattactgactcccctggctttagtcagtcctactaaggacaaacctctgacttcagttaagcaagtctgattctctcttgaaaactgagcattgaaattcaggtttagctaatttgatctatggtttatgcccagaatttaggtgatgtaaacaggaaggtggtcatgtggatgtgaagagagaaagtgaggccacacacagagagatgaaaatcaagccaatatagcacacatgtgcaggttaaagatggagcttcctgcctaggttctcagctgtcaattccattttctcccttgtgaagaggtcagtgtacccatgtttattttcatgtaattaaagtgaggtaagaactctgatctctgggttgctcattttcctgtcaaacttagctatgatcaaatgaggtattttacatcagaatctattatctgtaatctcagcaatcagctactaggaaatgtctcagtatataccaatcctgctttctctcattttcatagctgtagttctgtgcaaaatctaatcctttacagctgaatagctgaatatatagtaggggattgtttatatatttatattacatatttagatattggtggttacaataactacataggtagggatggagagaggcattgtggtccattcttttttttttttgttttttttgtggagggttgggggttgtcgaggcttcagttgggcttttcttgtttataaccaaaatatattactgtggattcagttgtgtccctctcaaaattcatatgttgaagctctaaccaccaatgcaactgtatttggcgatagatcttataaggaggtaattaagttaaatgaggtcagaaatgtggggacctcattcaaaaggattaatgtccccttataagaagaggctccagagaacccacttattgtcttcaaaatcccacaaatgaaagctgtgtaagaacactgccaaacagcgattgtctatgagccagaaacagaacccttaccagaaactaaatttgttggcaccttaatcatggcctttcagcctccagaactgtaagaaagaaatttgtgttggttaagccacccagtttatggtatttttatatagcagtgaatcccatgcctgagggggcccaatatttacctgggatcctccaaatttctacatagtgaagccagatgacacagcaactcataagttgtcttagtttcagaatcatctccaatgagatacagatctatcataaaaagcacacacctgctttcacagcatggcttaagggtgaaattttccctggacaaaaccaatttacatttaatttattgctacccagaagtatgtctggctttctgctttagaggagattgtcatgcagaaaaagagggaaactcataaacaacagtctatgacaatgtaatagaggtgtagatagcttgttatgggagaaagaaagactaactcattggaaataaaggaaaaatttacgcttagggtatttttgggaaaagtttaccctttctcacctgaaaaacaagacttcaggtacttaaggttctttgctgttatgagatttttattttggcttacttaatcagccttagtatgttaaagagaagaaccgaaaaaccaatgcaggatattccgataaaacacagatacttgaaaacttgagtggcagaaattagaagtaagaagaaaagaaagaaataaaaagtgtttttaatcagaaaccctgaatactaaacatactattttagcaggttgtagatattgttgaacccagcacatgaaggcaatagaaactaacatgttgagggtagagaaataaaaagaacataggctagtaagtgatttaggtgcctcacttttatggcattcttttccaagatgggaataatgttgatttatcctttgtgatgtcagcccctagcacagtgcctagcacataatatgtgttaaataaattccagtcatagggatgatgcgcacaagtacgtggtttgctgaagagggagccactaggtggctgggcatccaggagagaccactcggacaaatttaaacagagaggacagaaaagacctttcatgtactttacgttttttacataagcctacatatagttcgtttatatatcctggtcccatatcaagccttaaaattaatattttttatttcagctttaatatgcagtcactgtaggccatgttaataaatattctttattttagtaagtaaaatatttctttttaccaggaaagctatatgcagtgaaaacgctgatagattctcctaattgaaactacattgctagttataccctcgagtacaggtcttatctctacttaatataggatgctaagaatcatgacactattattaaaatagagacacattattcttcaggtcagaaaagaattggtatgtgtgaccaaggggtttatacattacatttcatcacaacattgtcattcttttaatatagtgcagaacactaaaagctattgtttccatgaattacaaccccaaatactttcactctgcagattcattttatcaggatctcagtattatacatcacaactgtaatgtgtaacatattttcagtacatatctttattgtacgttataggctaaagtagcataattatcattatagtaaggttttacaagagactttatgttttaatttttatgttcaaagttatttaagtagtcactgcaagaagaatcttaaaaaatactcataagttatactataaaaccagtccttggagattttaaattattttcaatttttagggggtcttttatgagaagaaatattttatcaataagggagtaaacattttcaatgcatgctcttcatttcacattttgcttcagcttgcaccaagtggttattttgcaggaaaacaaaacaaaacaaaaaaaatattaaagactcaactctgctgcactaaagtaaatcaaaagcaactgcagaaacaaaaagctgtttaaatgcaaaaccttgccaacttttctgtcagggtatacaacttttaaatggtgtctaaatattttaagcataataagaaatagatctctaaaacttatatcgctatccacctctagcttctgagataaattctggcctgactaaccattagtagataattagaaatgaaatgggagatccaacattaacacagactttctttttttttggcttaggagcctcctttatgcaaattggtaggagaccattttcatgcagttctggcaatcagtacttaatttgttgatagccttaacagttgtggccagagtataattggtatgggcccttgtgcaagaaaaataaattgggttgtgcacaaaactaagcaacataattaccaacaattagacgttaattaccaagtagcagattctcaaacctttctcctgaatttggccaaagctagacctaattatatttttatgttgtgaaaacatccatgtgcctgagataatcaggtgttccgaaggtgccttctgtagatactgtgttttgttatggattctcatgtcaggaaattaaatatgtttatatttgggcttatctaataatcacagaaaagttagtgaggtgggatttgtgctaatttggtagtcatttatttaccttacctatttaatttgatcacttctgaaaatactgatgtaaaaaagaatgaaaattattttaggattataaaaagaaagaacagaaagattttgctcaggcaaaaatagagtttctccaagtatccttcactataacaaagaaatcttttccaatattagaccctaggggaacacagctacagccacagtctgcataacaggtttttactactagatgcgacatgaaaagtatttatacaaaaaaattagcagatcaaacattatattataactatgaatgaaaacagtctaagacatttttggggaacactaaaaatatgttgcagacattccttttgatcagaaacataataatattatcaaattttaacagcaaagcaacatttacaacagcatagcaatatttacatagcaaaataaacattttcttactttgttttctatgatccgaagacctgaaaccaaggtctaagagttatcctaccagggagtagtggtaaaatccacttattttcttacatgtatattctaattatggctggcgggttattctgtgctaagatcacaggtaaaattaacatttttgcattcttgagggaatccacatgtcccatcgtgttttcacttcaacacatatttgtttattcaattagttaagagatacacataccattctctgaggaagatgagatacagttttcttcttttcttttttacattagtcctcctgctttttcatcttccattcactcccctggactgagaattggaagttaattttaaaagtatttttaatagaatgttatctactggtttcttttccgtgttctcttattctatttaaatctctctaagaactgggaagttatccgatctaatggcctcttcaaggtcttcattctagacactgcagcactggatatttttgagattttcctatttcttgaaagcttctcttcccatgaattttataatattattttatttattaattaaaaatttagtgtcttctcaatagtaatcagcaaaatgtaaagtttaccatcattgagattcaaaccctttacaattggacaacaatcgaccttatttggtacttgctttatacattctaattctctccttttttttttttccagattataacatgtactttcatgtccatttacctgtatccttgcattttccacacctggcaatgtcctacatatattaaacttcaccaactctgtaaagtttggaagtatttctactgcacaacactcaacaaacagactaaattatcagaccatctaaacaacattggatggattctttcttgtctttagaatgtctagaaaaagatgtggaacacctacattatgaaatgtgtgtgtgtgtctggtgtgtgtgtttatgatttttatttatttgttttcaactagaagggcatgcatgtgttggacccatatatgtcttagaaaggtgggttgagttttctaagactagatgaggtgagggtatagagaagaaataagatagcagaaatttattaaatttttttttttttgagacgtagtctcgctctgtcgcccaggctggagtgcagtgccgcgatctcagctcactgcaagctccacctcccgggttcacgtcattctcctgcttcagcctcccaagtacctgggactacaggcacccgccaccacgcccagctaattttttgtatttttagtagagacggggtttcaccgtgttagccaggatggtctggatctcctgacctcgtgatccacccgcctcggcctcccaaagtgctgggattacaggcgtgagccaccgtgcctggcctattaaatgttttaacagtacatttttaaatattacttaggatagtttttcctcctaaataacatgtctgggtgaagtataatcctaatttgagtggagcattggagatatttacagaagaaaagttggctctcctttaaagttggacaaattgctatagtgtgatggattactagagaggaggaaaaaatggaaatcatattgagtgaaagtttttctatttaagggaataaatcagtagtataattacttatgtttacactaatattagtaacttatagaggagacactgtaaattatgatatataggtaagggatccattatttggacagcatagaagcacatacagaaatataaagtggtctctctaagacaatatttgagagacaaatctaaggctaaatttaaagcctcttgatttcagaacaaaatatttactggcttccattgagagtaaaacgaagaagagagaaaaatttgaaaaaccaaaacaaaataatgttaacaaaaactacaacatctatattgaagcatttcataaagaactactaattttgaaaagaataataaagtgaatgtctaattaaatggcgcatttttaaaagacttcttgcaaacactctttttgctgtcacttaaaatttgtgctccttagagagtgaaaggagagaaccaggaatcattaagcctagtaccataatgaaatacctgcgtgatgaaacaatctgtacgacaagcctccatgatgcaggtttacctgtgtaacaagcctgcacttgtacccctgaacttaaaataacagttaaaaaacattgtgtgcttatcataatttcttgaaacaaattgtatatgcaaaactgtgcctctgcatctgttaaaattaccctgattggccacttgcattctcagagagaagggtatagagctaattgaccttgccagagaccaaatgtacctactgtgttttaatttggtgtgcaattctatgtctgtgcaaattttctcatgccaattattgcacttcaaaaaatctgcatcctaccaatatctttgcaactgaacagaaagaggagagaacattctctaaacaatgcaattagagcagtataggcaattaactttgctatttagtctaaagtagacagcactaaagacaaagtaataaatattcataaacactttaccattatatggaattgcagaatagacacacatttttaatacacaatacaggcagtcatattattaaacttaatggcatctgaggaatgatgaaactctaagagccttgagcttgtaatgagataagcttgtagcctgatcagcttgcatacaaatcatctcatctgaataaaattaatgtttgatttttatatctctcctcaagcactgctgtgcccccctattcattttatgaacaattattgaaaagaaaataaaagtttagccctgacatgatatatcagtgggagggtctacaaaacatgacattttaagttcttatttctggtgttgaatgtaaaatttcttataggttaataattgaagaatgaattattgatgctaaatacaatgtgagaaatattttaaagcttttacattaatatagaaactgtttattttttaaattttttcataaaaatgtttacttttaaatttttttcatactcctcaataacaacatgcctgtatttaatgttaaaatgagtggtattcatatatttagttgggtttccatctgcaaaaaaagctattccctctaaatcctcattttaaaattataatattaaaggagataaatgtgacatggctatgtcatttcaagatcagtcaaaatagaaaaaatatgtacttcattttaacttatgtaaccaaagtttacatttaaaagtttaattccaaagtaagttttcttgtgtcacttctttttgaggtgagttcatttttacagtgttcacttaagacaaattccaagcatctcagggcaggatattgccctcttctctcacattttatacagcgcctagtaacatttagcatgccatagctatgaaagagtaaaaagcacaaaatctaaattttcactaaaaatcttaactgacaaagaaagctgtaaagaaattatctaaagtagatactccttgtgggttgatatcttagaacataattcttcaacaggggtctcatattatagtcatccaaaacatgacttacagttatttgaaatatcagtatgaaaatttatcttcaaatacaacattatgaagaactaccatggttctcaataaagagaaaatttaaggcattcataaattaaagagagtattttaggaaaagtagataaaatggtaaattaaaaactcaaatttctttcttgaattatcctagtttactattagatattcatttcactgtatttgtgcagacatctaagtcagtggtccccaactttttggcaccagggaccggtttcatgggagacaatgttttcatgaactgggtggtggatgggtggaagatggtttcaggatgaaactgttccacctcagatcatcaggcattagttagattctcataagaagtacacaacctaaatccctctcatgagcagttcacaatagtgttcttgctcctgtgagaatctaacgcccccgctgatcttacaagacatgaacagacagtaaagctcattcaccctccactcacctctgtctgtgtggcctcattcctaacaggccagggtaccagtccgtggaccaggggttagggactcctgatctaaatgacataactgagtattaaatgggttgaaacatataagggcatacaatactgcctggcaaataatacacgttcaataagttttagttattactcaataactgtccctgcacttccactccctttagtactcttatgcccaccaaaaatcacttgtgttagtttgcatacatgctttttgcaagctgaacttttcctttaattcaaaaattataaaatttggaaagaatctgcagtcagattccaagttctattaagagttccttcttcaaagaaacaaaacctggaaatagtggatggtgcagtatgtggtggtttatacaggaaattgtgttggaggtcttcaagataacttcaagctcaataatttgcttgaaaaactcacaggattcagaaatctcctaggtttatggtttatcacagagaaaatagagattaaaagcaacaaagggaaaaggtgcaaggtgcaaggaaggaagtccaagagaaaccaacagaagtcaccccaggggtcctctcccagtggagtctcatggtgatgtatgtaatcctttcagcaatgatgtgtaacaatgcatgataagtgctgctaaccagagaagctcactcaagctttggcatccagggtttttattgggggtcagtaatgcaagcatgcaatgccagtgcaattgaactcagctactcagactctcccctccctcagagcaaaaacaggcattcaccataaatcacattcttagcataacctttactgctcagactggtaaagcatgtcccaaggccccaggtatacaaaaatattcttatcagtagtatatttcaagttctcagagattatttcctaagattcagtcaaaagccaataccaaagacagacccttctttggaatgtgcagtttgtgagcaaccaagactgctgagttaacctttttctgcctgaaattacaaaatggaagtgaaatcagtgccccagaacacacagcggaaaaaaaaaatgttgacactggccgggcgcggtggctcacaactgtaatcccagcactttggtaggccgaggcgggtggatcacgacgtcaggagatcaagaccatcctggctaacacggtgaaaccccgtctctactaaaaatacaaaaaaattagccgggcatgttggcaggcacctgtagtcccagctacttgggaggctgaggcaggagaacggcgtgaacccggaggcggagcttgcaccattgcactccagcctgggcaacagagcgagactctgtctcaaaaagaaaaaaaaaaatggacactatgtgtaaagattagagaataagtgaatgaacacatccatatgttttatttaaataaaatcttgttacctaattgtaatctttaaaaatatcatgttttaattacttttctgactaactgaacaatttcagtaatccaggtggctctttcaaaattgagcatggctcatagtcatggcttatgccctggtttatgctttaatgccctggctcctaaggcagagccttaacgttgttcctatcactaaggctattctataaccttgttttcttcaaattcctgtatgacaatttaaggctgtgggccagatgtcccagcttggtatactaacttatgtgatccagtctgtcttcctggtcccacacctgacaccatgcttacatctatcaagttcagcaatcctgttggtacaacgacttgttgctggaactccctgagagtgccttcctgagctgccactctcactctaacacctccatccccgctgtgtcacttgacagatggggctccttccaaatccctgtaatttttcctcaggctttaccctatcatggtaagtaagcttattgtcttagtctgtttgtgctgctataacaaaacatctgagactgaatagtttataaaaccagaaatttacttctcacaattctggaggctagaagtccaagatcaaggcgctggcaggttcagtgtctggtgagaacctgacctctgcttccaagatggtgcctcgttgtgtgtccactagaggggcaaatgctgtgtctcacatagcagaacagtggaggaaagcaaaggcactccctctagcctttctataagggccataattccatccctgaggattctgccctcatgacttaatcaccttctaaagatctcacatcttaatactattgtactggtgattcagtttcaacatttcaattttggggagcacattcaagccacagcacccacactgcttccatgtcctcacatggatttctcttttcccatcgtatatcacacagggctactctattcatagagaaatctatcttttattcacatgacatgcattcaacaagtatttagtgatttagcaagtggccattacataccaggtactgttctattaggaaatatgagagtatgtagttctagccaagtaatgtccttgttaacacatatgcatttttgtgaaacacacaaacccaaagataaagtccaagtctttcccttaataaacaaaaaagggtcagaatatagaaatgacttccaaagtatcctctcttgcgttttttttcctttcagtcatccgtgggtctatctgtgctttaataatgcttccaatccagttcagatcacttttcagtcctaccaataatattacaccctgatcctgatagtacaaactgttacattttccacttcacagatcccaatctgcaccactgattatgaaacaaatattctttgttcctgaatgactgtagatgtggtggagagtaccaaagggtcacagcctctctcacactaaaaacaagaataaagcagtgagttgccctctctcaattcaaacagctgtaaacccaacaagtacatggcctctaattctcctactcctggaggaaatctcttgactgcacttacatttaggccactaaggagaaaaaacctaccctcaaatgaatatatcagcacacaatagaaatacacaacaaagtaaaatatttaataaattgtttgaggtaaatcatgaaagtataaccctaaaaaccccaaaatagacatagcattgaatcctttgaagactcaatttacagtccatctcatgtgttcagttataagttacgaaaacagttacctctaaaatattgttaaataatcaaatgggtccatgatatggtttggctgtgtgttcccacccaaatcttatctctcattgtaatcaccatgcatccaggtagggacctgtaacctgcatgtgtcaagggagggaagtgactggattgtagggaggtttaccccatgctgttcttgtgataatgagtgaattctcatgagatctgatggttttataaataacactttttcctgtgctctcacttctctttcctgctgccttgtgaagaaagtgcttgcttctccctttgccttctgccatgattgtaagtttcctgaggcctcctcagccatgtggaactgtgagtcaattaaacctcattcctttgtaaatttcccagtttggatatttctttacagcagtgtgaaaatagactaatacactccccatgctccattcttattgtgagcatttttttctttctctgaaaattaactttataccaaaaaatagattatgatgttatagataaaaacatttcagggatgtagaacattatcaatcaaaagacgctgaaaagagaaaaggaaagttatagggattcatattgggacaaaacacatttaccatcacaaagtagaacttgcttggtattgagtactttttgagtacattccaaagttcattaccatgaattgtatttgagaaagtggaaggcagttctctgggtggccttggactgacccagttctccccccaccatttcttgcttatagttctcaagaataagtatgaaataggctgggaattcaacatcctgaggtaagggggaattggccagaacagcccgggctttgtttcagtctaccctggaaatgagatgttcgttaatgctgtagcctctgacggtgaggcattgtcccttaggtatataattgggagtgggctgcctttcagggtccctcagctccggtgtaagtcaggcaagtgcaggcaaaataccattcactgtggtcagcttttttgagccttggtgaatcctatgcttctgttgtccctcactgcctatctgtaaaaaataaacttgcttcttgtaacttcttttgtgtgtggatgttctctctcaccaggctgagatcagttggtaacctgtgcacagtgaatctgcccaacggaaatggacctattggttctcacattatactttaattgcaattttagccacatctagatcaaaaaaaagataaataagtgaatttcgtttttggcacaccaaccattttctgcatcaagaaccttacttttatgcagagcttagcaatatctagtacttcatctgtatcaatttttcattttatctacaattacgtgttgagagcttcccacgtgcctgatcctgttccagatactgaggagactgtgccgaatcagacagataagacagctatgtccatggagctcatattacggtggaaataagaccaacaaattaaaaagtaagctataaatgtgtgtgttctgaagaaaataaagtgggatggcatgatagagagtaatgagagagtgataatttaaattaagtggtcagggatggcctctattaagagttgatatttaaacaaaggtacaaatagaagatgatcctggatgtgagaattacgggaagagggaattaactatttttcaggtagggaagagctaggagaatttagaaaccaaaaatatcaatgtggctgtagtacagtgaatatgtagcagaaatcataaaagatgaacttcgcaagttagttcagagccagttcatagaactttgtaggcaacggaaataattttgtatcaaagtataatgaatagccattagatggtttagacatgtgtgtggaaaatggatgggaagaaatgaagtttggaagctatggtgcagcagtaatatgagtaagagatgatggcaccatggaatagaaggcatagtaatagaaaaaatacaaaatagatacattcgtaatgtggtttaggtgctctaaacaggacatgattatggtagtctgtgggtttaaaggaaaataaataattaaaggatcaaagatgatcttagatttggggcttcagtacatggagagatggtggcattatttactgatatgcaaaggtatgaaggagcaggtggagtgcatttgtgtgtttcagaaatgttacaacagatgacactgctagattgccaactggaaatatcaaataggtgaaaacaattatttatatattctatataattttgtatttgtgtatgtctctaaacttatgtgtgtatgtacatatacacacaaattatggtgaaaaaaaggtaagaaaaaatattctaaagttggaaatggggaaaagagacacttggtgttcttttaatccagtgctggccttgactttctattaactaggccattttccaactctgtagggatggaggctaacttacacatttgctgttgctattgtgtaaatatgaatatcattttagtctagtgaaataaaaaaagttacagcatattgccctgtaaaatattaaccagttttgtctccaacctggaaatcttaaaatttctttattaaattgcatattatattaatacatgcatacatgtacacatatataaacacacatatatatacagttattttctcatatgctctttgggtcagtttcaatatcttgctattaattaatgagttaaacagaatctttggcatgtgttcatttcatatttgccagagattattgtgtttatctttttgaaaattataattaaatagatatgaaggttaacatattaatctgagagtcactgacatgtggatgatagctatgaaactgatgagattacattttatttttctttgaggcggagttctgctcttgttgtccaggctggagtgcaatgacacaatctcggctcaccgcaacctccgtgtcccaggttcaagcgattctcctgcctcagcctcccgagtagctggtattaaggcatgcaccaccacgcctggctaattttgtatttttagtagagatggggtttctctgtgttggtcaggctggtctcaaactcccgatctcaggtgagctgcccaccttggcctcccaaagtgctgggaatacaggtgtgagccaccgcgtccagctaagattacattttttaaaagtacagaaaaacatgtgagaatagttttggttccagagtataaggaacataaatatcatttcactatttgtttagaaaaactctataaggttttgttatgttcatttttcatttttctactgagtaaattatggctcagaaaacttggctcagggctttgcatctaaaaaatgttagaaagcaaatgcagccctggtcagtttaactcaaaaatttattttttccacaagagcaagataattctccagaagaaaatagcttaattttttttaaataaagctaatgggcaattttggcaatttcccttctctttattcccatccccctcctggtgtgtgtgattgctataatttaggccctggatactgcagaaatatttcttaacctgtataatctcaccctaaagagccacttcaaaattggtaagtatagatcatgtcagaaatgcaagtactatcatgatataaggcattttgctttaggcaaaatatgaaaaaaaacagtttacacatattgcaatatttttaatatatacatttataattttttttaacggaaagtgcattcatgaactaagtagatgattacattttcctctttttaacttaggactttccattttgtaattataagtaaatgcataacgaccatcggtcgatcctgaatctaaaagtataatcaattacatccatatggaatttaaaacataataactttaaagtattacttctttaagtgaaataattcaaaatgagattaaaggcaatgcttaaagaacatattatgtaatgcaaattaaatgtgtcattattaccctattattcaccacatttttaatatgcatgttcttgttatgcaggtagataaaaatcattttaaagagcatagaaaaataataaatcccctgttattagtcagtttttacactgttatcaacaactacctgagattgggttatttataaagaaaagaaaaaaaaagaaaagagatttaattgatgtacaattccacatggttttggaggcctcaggaaacttacaatcatggaggaaggtgaaggaaaagaaagacacatcttacatggtggcaggagagagagagtgggcgaagaaggacgtgccacacttttaaacaaccagatatcctgagaacttactatcatgagaacagcgtgggggaaacggcccccataatcctataacttcccatcaggctcctcctccgacatgtggggattataattccagatgagatttgggtgaggacacagagccaaccatatcacccctctatgacttatacaattcagtaataaagaatattaaacaactgaaaaatatactttattcaagaagcagcaatgattgaaagtgattgaaaataataaatcatattgcccaaatgaaagttttaaaatataataccaattatattgaaaacgatacatttagctagatgttggatcattactttacatatatatatctccttctaataaatcacaaccctttgagggcaggcaaggatcataatgatactcatctgtgagtttccagagcacatagggagactctcatacaaatacattaatgtagtctatgtcctacatatcataaatccatagcctaaatcttactagaactctaaaaatataacattacagaataaaattcaaattttgaccattttttaccttttagagatgtttactaattattttttaaccattatgcattattaaaataaagcaaatcaaggttggaatttggctgctctaaactaggcataaaatattgaaatataattgttaaaggtatggaatatgtaaatgttcaatacaataaataagcaaaaatttaaaaactgtaactttatttcttcttcttatttcatgtctttattttaaaagaatcaacaacacagaaccagatgctgaaggtctataatgctttattcccatttaggtgaactgtaaactattgcatataatgtgaaaaattcaaactagggaattttataaaaacaatgaaggtcatatgtaagttacaccattagagaaaattaaatatctaaagtttactgtaattattcacaagttataattagattatacctccttggttagctatattcctagatatctgatctgctttgtggctattgtaagtgggattcttttcttgatttcactctcagcctagacggtgttagtgtgtggaaatgttactgaattttgtacccctattttgtatcctaaagcttaactaaaattgtttatcaattctaggagtctttaggcagaatacaggattttctaggtataggatcatatcctcagcaaagagagatagtttgacttattttcctattttggtggattttatttatttttcttgcctgactgctctggctaggacttccagtactatgtagaatagaagtggtgagagtaggcatccttgtctttttccagttctcaagggaaatggtttgagcttttactcatccagtatgatgtagtccgtgggtgtgtcatgcatagctgttatcattttgaggtatgttcctttgatgcctagtttctagagagtttttatcatgatgggatgctggattttatcacatcattttccgagtattgagacgattatattgtttgatttttttatgcagtgaatcacatttattgatttgcctatgttgaacccgcctcacatctcaggaataaagtccagttgatcatgctgtattaacattttgatgtgctgctggattcaatttgctacttttttttttttgaggatttttgtgtctatgttcatgagggattttagtcggtagctttcttttttcattgtgtctctgccagattttagtatcaggctgatgctgccttcatagaaaggattagagaggagcccctcctcctcaactttttggaatgattttagtagaattggtatattttttttctttttatacatctggtagaatttggctgtaaattcacctgaaccagggctttcgttatggttagcaggttctttattactgattcagtttcagaagttgatactggtctattcagggtttcaatctcttcctcattcaatcttgggagattgtgtgcttccaggaatttacccatttcctctagatattctaatttatgtgcatagttgtccacagtcatctctgagtatatttgggttctgaggatgtatttgtggggtcagttataatatcacctttgtcatttctgatcgggctttacttgggtcttctctttctttctctttgttcatatagctaggaggcatatcaatcttatttatttatttgaaaaaccaattcttggttacgttgatctttttatagatttttacgtctcaatttcattaagttcttttctaattttagttatttattttcttctgctagctttggagtttatttgctctttttttctagttcctttaggtacaaagttacattgctaatttgagatctttctgtcttgacaaaggcagttaggactacaaactttcctcttaacactgcttttgctgcatccaagagattttggtgagatttttcccctgttttcatatatttcaaagacttttttatttctgccttaatttcaatgtttgctcagcagttatttaggagcaagctgtttaatttccatgtatttgtgtagtattgggagatttgtgtagtattgggaatattgtgtagtattaagaaatcaataggtattgatttctattttcattgcaccgtggtctaagagtgtacttggtatgatttcaatttgctttgaatgtattgatgcttgctttatgagcgagcatgtgatcaatcttagaatatgttctgtgtgcagatgagaagaatgagtattctgtggtcattgggtggtgtgttttgtagatgtttcttaggtctaattggtcaagtgtcaagttgaagtctagagtttccttgttagttttctgtctcaatgatctatttaacactgtcagtggagtgctaaagtctcctacaattattgtgtggttttctaagtctttataggccaagaagaagttgttttataaatctgggtgctccaatgttggatgcatatatatttaggatacttaaggcttcttactgaattgtaccctttatcatcaagcaatgttcttcattgtccttcttaatttttactggtttgaagtctgattcatctaatataacattaccaactcctgcttttttgtgtgttttctatatgcatgtatatcttaatctactctaacttttagcctgtgggtgtcattacatgtgagatgagtttcttgaatacaacagatggcagagtcaagacaaataaatgggaaaacattccatgctcatggattggaagaatcattattgtaaaaatggccatgctgcccaaagcaattgacagatacaatgctctttctttcaaactaccaacataattattcacggaattagaaaaaatgattccaaaattcacatgtcaccaaaaaagagcccaaatagccaaagcaatcctaagaaaaagaacaaaacttcagctatcacagtacttgacttcaaactgtactataaagccacagcaatcctaacagattggtactgctaccaaacacagacacatagaccaacagatcagaattttaaaaactcagaaagaaagccacacacctacaaccattctttgacaaggctgacaaaaaaaggcaataagaaaaggaatctctatgcaataaatggtgctgggataactggctagccatatgcagaagattgaagctggaccctacctttcaccatatacaaaaattaactcaaaatggattaacgatttaaatgttaaaacctgaaactataaaaatcctggaagacaacaaaagacatactcttcttgacactggccttggtaaataatttttggctaagttcacaaaatcaattgcaataaaaacaaatagacaagtgggacctaattaaactaaagagcttctgcatagcaaaataaactatcaacagagcaaacagacaacttactgaatgggagaagatatttgcaaactaggcattcgacaaaggcctaatactcagaatctataggggacttaaatcaacaagcaaagaataacctcattaaaaaatgggcaaaggacatgaacagacattttgcaaaagaagacatacaagctgccaacaaacgcatgaaaaaatgctcagcatcactatcatcagaaaaacgtaaatcaaaactacaatgagataccatctcacaccagtcagaacagctattattaagaagtaaaaaacaagagatgctggtgaggctgcagagtaaagggaatacttacacactgtttatagtaatgcaaattggtcctgccactggaaagcagtctggagatttcacaaataacttaaaacagagctaccttttaactgagcaatcctattactgggtgtatactcaatgggaaataaatcattctaccaaaaagacacatgcactcacatgcttattgctgtactattcaaaatagcaaagacatgaaatcaacccaggtacccatcaataatagactggataaagaaaatgtggtatgtgtacaccatggaacactatgcagccataatacagaatgaaatcatgtctttgcagcatcatggatggagctggaggccacaatcttaagcaaattaatgaaggaagagaaatccaaataccacatatccttacttacgagtgggagctaaacattggatacacatggacataaatattggaataatagagagtagtgacaactagagggtggagggggagtgagttaaaaaaactacctattgggtactatgctcattatttggatgatgggattcataatccaaacctcagcatcatacaacattcccatgtaacaaatctatacatgtactccctgtatctaaaatgaaggttgaagtaaaaattataataataataatagattataaagcctttaatatgtcaggtcaacaaacagctattgacagcaaatatatcattagcaaatgttgttaactaggaaagcaaatattcattaaaataaattaaatttgcatagaagctaaataacttgttagttttaatggttttatctacatccaaaaataattggaagtttctcctatcaccaatactttgtgggacattctactcagattttccacaaatgtagaaaccaaaccttatttccaaatactatatgcttagttcttaggataaaagttgtatagctatattaaattaatgcatgtctgttatacccacatagagcctctgatatcagtaagtctgggatgggccctagaaatctgcatttcaaatctcatgaaaatctgattccagtactctgcagagccttctgtgagtaaaatcgctacagtcagtacctaaattctgcctttaccagaaagcttctgcacacacttttctcatgatattgacattatagaacaacaattagaaatcatcctcccccccttttttttctttttgagacagggtctcactctgccaccaagactggagtgcagtgatcaaacctactgcaggctccaattcctgggttcaagcaatccttctgcctctcgagtagctaggaccacaggcgcacaccaccatgttaggccaattttaaaaactttttgtagagacaggtcttgctatgttacacaggcaggtcttgaacgactgtcctgaagcaatgttcccacctcagcctccaaaactgctgggatgataggagcgagccactgtgcctggacaataatcaaaatttcttagaaaaccagaccttctccatttcacaaacttttatatcattaacaatgatcctttgactagaacataacagatttttttttgttgaagtattgaataaatccatgttatcactagatcagtcttttaaataaaattactgctttaaacagatcattctctacataagaatgcttaataaaaaatacaactttatgaaattctaactggataacgtgaaacatttttgaactacatggaataagacatcacatgaaccactgaacccttatttgtaccaaggttgtgtttcacaattccataattttcatctatcaatcaatttatattttgcaaatccttattaggaaacttaattcatcataaccctttctcatatgatactttaaaatcttattgtaaaagacatatatgcacataaagatatgaaagtatgcaagatagtagatagcaaatttgtagttttatatatttacatatgtgcagtagagggcagttagcatacctgagttggttttaaatgatagttagaattaaataagcaaagagggaagaagggttttatagacatggtgagtgaaatataagaatgtcagatgcctttgagagtaaatcaaattgacaaaaacagaaggtttatagagagttaaagtgtgaaataagttttaaaggacagcttttaaaaggtagctgtgttttaagagacttatgtctaccaggctgaaagatctgaagtttaatctatgggctctgtgtttccttgatgattttggtaaaggtaagttgccagcaaattgatgtgaattaggtgatgtccaatatctttaaaattgaaaatgaaatactttgcaaaactgaaacgcatgtattttactatttaatcatacatatttaatcaataactgtttactgcatactgagtctatgctgtgcactctgccaagcaatgggggtgcaaagttgagcaataacacgtacataagatttaaagtctaatgggacagatagacattaatcaactagtcactaaatagtcaaactattctaactggtaatttttctatggaagagtgtatgatgttttatgagcacatgttagggatggtttctctgaataagtgactttgagttcagttctgaataaaaagattagggcagagataattatgggcagaagaaggagcatgtgcatttgtttgatgggccacagagcacggtacccttggggatttgaaaaaaatgctactgttgcagagtgtgagggtgagacaagttatgttgctagagaggaaggcaggagcccacttagcagggcaatttaggccattttaatgagattggacgtgaaaagaccactggtggtgaggatttattaaaatccctcaatttctgctagtaattgaaggattttaataaaatgttgacattgaactaaaaaattcatttaggctaaaatgtaggaagggaatattgaatatctgggacatatggttgttaaaatgagtagtccattcaggtttaaaatgatattaaattttgaatatgataatttggtagataggaacaatgaggcagatttaaaggatgtttagaataaaccttagtcacatattggctattggaagttagaaaaaaaggggatttcaatgataacaactaggttttaagctaggataattagattgattatgggctgattcattaagacaactaaatacatatataaaataattaatgtagatataaataatgcatttgttgacaacatcacaaatatatgtagttaatatactctttaaaaattaaacattccacacacacataaattatgggttctcttttttaatatcacatgtaatctaagcataattttagaacagtttattgttttacatgtattttgttaacacattatcctacagtatattcttatgaatatcaaagtctgtctatgagctaaacattttgtttcttccaaagtatttccatttgttcatatgttcacaaaggaaactgtttaggtgaagcttcacaatatattcaagtatgtggtaggacaattctttcttcattattctcaaattaccttttgctttcataggctggtctattatttaaatcactttgagaattttattgtcaagtgctactaaaattgccaatggaattttaactgaaatcaatttaaaacgatgatataaatgagagatatttgatatttttatacaatattctatttctcaaacttattttgacatgaaaaacactataattagaaaatgtaatggtagacaactcatatttattatttaattaataaaacgggtagcttcatttgtttttctaagtgcataaaattgtgatacagaaagaattttagtggacatagtagagctgatcctggcttcatcaatgtcaacatttgaaacagctaaatgcttgtagattattgcatatgtaaaaatcaccaaatttaaaatttaagcagtgtctaaatcacgctcttaattttgaaagtgtactatgtatgcaagaaaataaatgtgctttaagaatctgcatgctactttgctgtctgcaacttgttacttttattatctttgagtcatatctaaaattatctacatgtattgaaaattgaggaacaagtagaccacatatatagaagtatagtcaactgtaataaatttaaaatattttgacaggttgaaaaccatttacaaaattattaagataataaaatgcatcttaaattctaaactattactgattccatacatgatgtagaatttccaaggttgaattttacttctgaaagggaaaaacaaacaaacaaacaacaacaacaactatgtactagaataaaatttgactactaagccgggtgggtgcggtggctcacgcctttaatctcagcagcttgggaggccaaggcgggcagattgcttgatgccaggaatttgagaccagcctggccagtatggcgaaaccccatctctactaaaattacaaaaattagttggctgtggtggcgcaggcttgtaatctcagctactcgggaggctgaggcatgagaatcatttgaaaccaggagtcagaggttgcagtgagatgggatcgtgtcaccacactctagcctgggagacagtgagaaggtctcaaaaaaaaagtctattaaataactatggttagacatttcttaacatatatggtgtaacaatacgtgaaaatctaaataatccttaccttcctatccttctataagtatcactgcagcacattatataacgtacataaaaaattaaataaagcaaaataactcaaacatgtaaaaagaataactcatgaaaatgatgaccaatattcatattaacacgataaagtaaaagacagccaacttgaaatattaaacttatatttggcaagtatgcataattatgaaataatatatttaacttcatttgctgactttgaattaaaattatataccttatattttggtaaattatctcatatactttagttctctcaacaaccctgcttatgaagaaatgaagactattgagtttatgtgaagtgcttaaagtgacacttctagaaagacacaaatacaagacctaaaactaggtttcttattctatcaacaaagctcatttactcaataattactctatggcaagtttggtgttgaaaaacacatttccactaagaaatgtttacaaatgagacaataactcaataatcatgatagttatagtcatacaaaattgtacatttgttgaggtcagaaattatttcttctttttcagttcacagtatttattacaaatgttttgagaagcactgatgtagatggtggttaataattgtttattgaattaggcaacacaatgaaacctcattagtttaaactaaatagagaaagcttaatctgaatcagtgaatatcttagtctgttttgtgctgctataacagaataccacaaactggacaatttataatgaacagaaatttatttggctcacagttcttgaggctgagaagtccatgattgattaagaggctgcatctggtgaggaccatcccatagcagaaggtttaaagtaaagagagcaagcacagttacatacaagaaagagaggggcaaactcacttttataaaagtccactctctggagcccattcctgagataacaatattaatcgattcataaaggcagagtcctcatgacccaatcacctcttaaaggtccctcctatcaacactgatgcattgaaggttaaatttcaacacatgaactttggaggacccattcaaaccacagcagtgaacattttcaatttaagactatcttcttaaaagcgtaactaagttctaccaaaacatttatttcaaaaaatctatgagctacctcttgagtcaaatagtgaataaggtatgctgtcttctgccagtgagcacacaacctagctcaagtatgttaagtgttatgataaaagttttcataagaaggtagaccaactaatgccttttaatggtaaaactaattggatttaaatattcaaaagtcagtgttctctttatcaaatatcatttgtgataaatttagaatttattcaagaaatattcaaaatagcactgttttatagttataaatcccttttgttcaagtacaaatctgtataaattgtctcttttcatgtgcgcatatagcacaagtcaaattaactctagtttagtctcaactgggacacttaaactcccaactacaaagttatcatgttaaattactgaattacttcttgagaaattatcaccagtaatgaaacaaatcaagacatgtgccttccaatatgatgtacagcatcacttattcagcatttttttcagttaccataattagaaaattattatgacataaaattacccaaattcatattgagagatattgtataaagctgctatgaactcttcaaaaatgtcagtgccaaagatagaaaacaaaaaacaaacaaacaaaaaaccagaaagattcaggaagtatgtgagactgaaagaaattaaaataggataactgactgcaatgcataattctgaattttcctgttcagtaaaggacgttattgagacaaatggagaaattaataaaatctgtagattagattatcatgttgtaaaggtgttaattttgttgtactgtgattatgtgttttccactgttcctgatgcctagacaaaaagagtggatgaaaccatgtgagaatttagtaaatacagatgacctgacatgcagtgtctgaggtaatatttttatatttgcttcagaaaacaaaagagtcttttcttttgctgtagtccaggtcccgtaccattacagcttcttttccttcttggctgagtacaatcttatgaaatctaagtagcatcaataactatgttcttgattgtttgtatcgctttgtgtactttttaaaatgagtttcatgttggagataagattgtaaaaaaatgtgggggaaaactgcccccaaaacatgtcaaagtctcttgataaattcaggcgccagaagttttctcaatctcttattatctgagtatcttactcattaataaatagtgatgttagcagagagaatgcatcactttcttctgcggtttccactcttgaactattaagtcttgacaccatgaaagaatgaggagacaagcacagtaaagatgaaggcaaaaaaccatgcaagggtttcttcatgtcttgggtcttcataagtttgcccttgccagacttctagctcaatttcttgttgagtcttacctttcttcttctcctatgctatatctgtcctaagtcacttgcatttgtctgaaccatcagaatgtcctatagccaccatctagttatctctcactagaaataatcatttatactcttcaaatctattttaattgaaggacagttattcattttgcaactcaagttcaaacttcatctccatttaatcattttgttttatttttcttgcacaagcagatacatatccaacaatttattctatattttgtttacctttgggtactccattggtgtagtttcattattaattcatctctctactccctacaacctaacagagagccaagcatatagcagatgcttcacaggtgactgaaaaaatcaggcggagaggcacagaacacatagagataaaatacacatcaataattcagatcaacctcttctgatagagtttccttttacctttgaggggaaaactggagtatatttcactctcaaaaactaccaaagcccagaaagagaaaagatatggagaaatcagaatgtttaaaaaagtttatggaatgaaaagtatattaaaaaggtgttgcatatttaatggtatcctcattttacaaatatttcccatatcaaaggttagcaaaggaaatgtagacagcaaaacaaacaaacaaaaaagcatgtgcgatttattaccaggccagaggcattcccatgtaaatttagttcttccaacaaccagtatatgatttagaatggaagaattgattgggaactttttactcccagatgtgtggcagaaagcagaagagacagtatgattagttgttgggctaaaggtttcttatatgaacagagtttttgaacattcgtgacccacttttagtgctgagactgggacagtcttgagcaagaaaagggtaatttgtcatgctatgagaatcctcatgaaaacagctggacttaggaaattctaagtgtttttcataaaagctcaaaaatgttcctctcacctcctaggatcatgtcatttgaaacttgatactttcagatagtcttgtcagacttcctgttctatgttaaagggcagatttccttggaaatcctatgttttgatgtcattaacacattgttaatgttaattcttttagcgactatttactgtttaaattatctatgtataatgttatgcattagtactgtgtgctaactggtttgcaaacattgtttcatgtcatgtaaaaggctaatgaagtagtcactaatattatttttgacatgagcaatgcaaagttaaataaattaattttccaaagataacagacctgatgaataattattcctatgtttaataatggttatataggttgggcacagtggctcacacctgtaatcccagcactttgggaggccgaggcaggtggattgcttgtgctcaggaggttgaaaccagcctgggcaacaaggcaaaaacccatctctacaaaaaatggaaaaaatagctgggcatgttagtgtgcgcctggagtccgagctactagagaggctgaggtcggaggattgcttgagcccaggctgggcgacagagtgagaaagaaagaaagaaaagaaagagaagaaagaaaaaggataatggttatatattttaatcataagatatctgaacttgaatacccggacattctgttctctgaggtacattctaagtatgaagcatcttgctggatactctgagacttttcaatatccatgatgcactgtgcttaagatgtttactatcttatggctgggcgcggtggctcatccctgtaatcccagcactttgggaggccgaagtgggtggatcacgaggtcaggagttcgagactagcctgaccaacatagagaaaccgtgtctatactaaaaatacaaaataagctgggtgtggtggcactggccagtaatcccagctacttgggaggctgaggcaggagaatcgcttgaacccaggaggcagaggttgcggtgagctgagattgtaccattgcactccagcctgggcaacaagagtgaaattccatctcaaaaaaataaataaataaatagaaagatgtttactatcttacatggggatacaacatgcagataaatagctaagatatcactgaaaatttgcatagcactttggtgtacacaaccccttcacaaatagtaagtgaattgaccattctaatggctcattaaaacaagcataacaggagtttataatttccatttaatagatcaagaaactgaggttcagataaactaatgatgttcaatagctattgatattgcagcggggtttaaaatccagacattttccttataggctgatgttcattttactttacggtgtggcttcaaatacacattaccaagtcataattacattatagaaatttccctttggctcatgaattccagcaacctttgtgatttgcaaccccagtcacatcatacttctgaaacttcataaatgttttttggatgaatgaatccacatttccagatagtctcacccttagaatttattttatccacaatcagtaacaatttagagacccacaaagcaatcaccttattcataaacagaaatgaacatcttgaaaagctgtaaagttgagtggctaaaaacccttgagcgagactggctttataatccagctcttcagctctctgcctgtggtgagtatgaggaggttacttaccataacatttcttttgaacctttcctcaatatctcctctggtacaattagagtaatattctatgtatctcaggaggttgttatatgaattgaatgaagtaatatgagtacacatctgagaacaggatctggcacttagtaatatatatctcagctactattatcatggacataataattattattttactcagaaaccaaaaaaattaacataggttcagccacttgttttatctgggaaatattattttcaccaagctaaatttcttcatctacataattggataatagtcaaactaatatactgaaaacacttgttcagtgttaacccgatataattgtccaataaaatttctatatttttatttcattttaacaaatattgtgtaaatactgtataccaggtcttctggtagtcactggggatagaacagcttttaaaacaggtaaaactcatttttttcttttattttaatgggggatacagacataatacagaaataaattattttcacaaataaattacatatactgaatctatactcagccagaacacttagagctaaaatatgccacatataatttatcattcatttaacttttgaattatggtgtttattcagttgtctgtacatcctataagtttgctaagggtataaattagagtttcaactcagagcaaagagaccactttacagatattatgttttttaatgattagcacttaatttttttagattagtgatggtaaaacaaaaatgagatcacttctaatgttgctgacagagtcccaaacccaagtattctgagtcagtgtattctataaatccttttaataatgaatattaatgattaactttattaaagttattagagccattgatgacttttccaggtataaaattatagagtcattacattttaaaatacaatcataaaattatatgcatagagggccatgcagatacaattttgaatatgaaactgtcacagggataaatgttagctagcaaaatctacattaatgcaagcattaacgttctgcaagagacttccagttcaggctgggctaaattgtgatcacagtgctaaatcacttggcaagagaccgaataacctaactgggattcatatatttcttagaagagcttcctgttatccctcacctaaaagtgattttcattactaagaacacttaatttaactctgtatcagcaattttcatattgggcaactatatttattataattgaacatttatatattctgcagattgctaaaacaatgactctcttgccagttactacatgaagagatatatatttttagaaatgctgatttgaatgttgtaattatcatcatacctcaagcaggaatgcccataatagaacaactatttaaggatatttcaattaactactttatttttattcaaaatattgtttattttaaaaatgatatgcaacagatcagcaggaattggtcgcaatgagccacaatattttccacaattataaatatatcacatttatttgcatttccaaaaatatacttttgatcaaaaatagtaatccaatattttatttgactttccccagtgttgttttcaaacagtggaacactttgttattcatttgatagggaaatatatagtttaacaaaattttacataaatgtatgtgtgggatgtgttacgctgggataaattttttgtaaatatagttttggactgaaaaaaagggatggggatttcacttatatttctaatatgtgtctttttcgcattcatgactttacatttcatttttgagagctacatagttttatgatctctagaattgtattgggtttttccttctttctctcttttttatgtccaagcttgcttgtcctgtgatatcactgtgttgtctttaacatttaatactgtcattctgtgtccagctaatgcaatgttgtcacattcacatagagaaaggaaaatagccagtagcacagtatttagtaaatgccccaaatgccatgatctgtgctttttacagtgaaattaaaagtaggttattcttaccaaaaaagacacacacacacatacacacacacacacacacacacacacacacacacagaataaaaaactgaattaaatgcatcttcatttttgatatttctattttccttgattttattattgcacggaatttaccttagtctgtatgtacttccctagtcacttctttttcctatttttttgcaagacaataacaaatggttgttaaggactcagaagcagaaacatttgtatacaaactccagttgttttaatcttaacagttgtgtgaattgcgcaagtgatggaagccttaattttgttgtgttatgtgcaaaatttagataataaatattgccccctaattaatggcttactgaaaggttaaatgtgataatgcatatggcatttttagcacttggtgaacatcactaatacatgtgttatcattgacttgtgcccctcttcctattgttgaaatccaagcattatttaaggttctaccatttattgctctcttctatttttatggctttagtatgtagctccactcattgtcaaaacatcagtaattccaatatcaaaacattcttaatgaagtgatattaaaacaagctttataaaacttcatcttaggattaaagtggtatcactgattttaaaagtttgagaggtaaaaataaatttgttattttagaaacaaaagataaagaagaaaatgcattatttggtactcactcgtatttatattttcttcggtaagcttagaactcacattagttcagtgactttgaaagaatgttaatttagcatttagcctgcttggtatttggaattaatgaatataaaaattaataatcactttcatttgtcaccaaaaatgatttcaagatatatctgctgataaatagaattgccatgtatagcataaatttctatatgagaatgtccacagaaatgatttcaatatatctgctgataaatagaattgccatgtatagcataaatttctataaatgagaaactcagttgtcacctaaattattgtagatacatttgccttaaatcaaagaatgtatagaaatgtacgatataatcaagtttttgaagtctttgtaaaaaagaatatgtaaattgatgatatatgcaaatagtacttgagagtatatatattaaataattgccttaataatatgactggtctacttagtttgcaaggttagaacactagaaatcaattaaaattccttcctttaccttatccttctgtctgcctgttcaaacattgcttttacatcctaaatttctcttaaatccactcaatcctctatctaaatgtatttagtacattatttcagaacctcatcagttctcacatggaccaatgaaatattattaaatccattcttttgtttttatttatgtcttcttctggtgaatctgccaaaggattattctagagtttacatattcaggattctctctcagatttgtaagtacgtggctttgtaatgtcaaacgtataccaaacattttagtgtggtagttctcaaactttaataggtatcaggatcacctaaataattttggctgggtgcggtggttcatgcctgtaatcccagcactttgggaggccgaggcgggcggatcacgaggttaggagattgagaccatcctggctaacatggtgaaaccccgtctctactaaaaatacaaaaaaaaaaaaaaaaaaaaaaaaaattagcctggcgtggtggcggacgccagtagttccagctactcgggaggctgagaaaggagaatggcgtgaaccctggaggcagagcttgcagtgagccgatatcgcgccactgcactccagcctggtgacagagggagactccgtctcaaaacaaacaaagaaaaacaaataattttctgggattattttccagagtctcttatgcagtagttttgggtgaaccccggcaaggtgcaattctagcaagtttcctagtgatgccaatatagctgatcctggaaccaaactttgagaatcattgctttaatctaacctaacacattctccatgacttctctagcttgtttctcaaacctaatctctcatcactttctcaaacttattcacatttcacataggcctaaatagtgtgagctcttgtacatttccatacaggatcgtatgttctttctggaacatcctttatttcactactccattgctttgcaactttgtttacctgggttactgataatccaattcaggattcagcacaaacatagtcttgtacaccttcccaaactcttattttgtgtaactttcgcatatgtaagggagtccctgtgcatacatatgtcccaatacttaccaaaatgtaattagctattttttctgttttgcatacaatttttgtgagctcctcatcttatatatccctatatattcagaaacgtatctggcaatttgactctatagatatttatcataaagtaaaatatgtacatgtcaatcactggaaggaatattaaaaataataaataaaaatatatccattacattaatggcatgcttgtgtgtttcctcctttaatagtttaaggatattctgattttttataaataagaataatttcttatatgttgtgaattttagcaatgacattaaaatattgatgatattatatagtgtgttctatataatccttttttagggtgaggccaaattatatttgctgttttatttttcttatctagtatgtactgaagtggtaagaagagatcatatttcttatgtattaagtgacagttcattaatttactaaattaaggaatatgtatcaaaagcttactatgtagcaagcaccatttaaagttatgtaatttccccaaactcaaagagataaaagtaaacagtgaagaagcaggtcagtatatctgacccattgccatttcactatctgttcttctccctatgtgctttggttggtaaaatttgtgtcagaataccagcttactaataaatgaaattgacctgcaactctctcaagaaacatttatgctaagtgtagctcttagcagaagattacagctactgggaaattctcagcaacagagaagaggatgcaagtgaaatgaaaagcaattgggcagtctaattgagaaagtaatgatgatactcagtatgaaaatagatattctgatggcattaccttccctaggatattctcatactaatctatgatatttctaaagatgtatgatgtgttttcactatctttaaccataagtgatgtagaaaacatttaatagaataacaagaacaattttcaatgtgtacataaacaaaaaattttgaaaatgaactcaaaacattcacagaaattttttcaagtaagcttgcaaagtagaacagaaatatcttaataattattagatttcacccaatatctaagaaatagaggtggggcataaactttttatacatatagaaatcataaaatgagtgatttattctctatgtcaccaacaccctatatttaatataatacatatgctaaaaggatttatggagaaaaagtaaagtattactcataaaataattactatgctgaaaagggatttgtgaaaacaaatcctgtgattacagtgtctaatataatatattttcgattatatccctttctactaatcatttccatatgaaccttagctttacatttcatgattataaggacagatacttatattgtgattagcccacaagatgggatttataatttaaaattaaataaaaattctagcctattagggataggcattcaaatatatattcacttactactaataatgtagaagttgattttacttttttttgagacagagtctcactctgtcacccaggctggagtgcagtggcgcgatattggctcactgcaagctccgcctcctgggttcacaccattctcgtgcctcagcctcccgagtagctgggactacaggtgcccaccaccatgcccggctaattttttgtatttttggtagagacagggtttcaccgtgttagccaggatggtcttgatctcctgaccttgtgatccgcccgccttggcctcccaaagtgctgggattacaggcatgagctactgcgcctggctgattttacttattattgaaaaataatttcacattttttatgatgatgtgagaatatgaaaataaaatgaaattatagtaaatacattgatagaagattaagttgataatttgcatagagcatattggctgggtgcagcatttgtaatctctatgttccttgaccgagggcatggatgttcacatttatgctgagaatttaattgtaagcagaatgttgacttttttctcctccctgcttttgctattctcagattaaaatggcatttcttgccctaacacattttgtttattcatcacatttttattgttactagttttatttgtagttaagtaagtctgcagaaatcttcctcccaaactgttctcccttaatcagagattcctgctgatcccattgtggtgattagttaagctaatgactgcttgcctttagatttgggtgcagggagaaacacatttaaaactcttgttatgaaaccattaaattaatcttaagatactcatattaatataaaaattagcttgtcatttcattatcagtcatgtcctcagctttttaattttttggccagtatgtttctcaataatgcctagcttatttgactcatagatccctaacttcttgaccaatgcccctcaactctgctgtgatctttatgatttcacctttataagattctgttttctgattttctcctgaatctttagattcaacctatttgcctgctatttgcttttttcaatacgatactattcacattttcagattacacctgaatatggtttggctgtgtctccagccaaatgtcaacttgaattgtatcttccaaaattcccacatgttgtgggagggacctaggaggaggtaattaaatcatggtggctggtctttcttgtgctattctagtgatactgaatacatctcatgagatctgatgggtttatcaggggtttctgcttttgcttcttcctcatttttctcatgccattgccatgtaagaagtgcctttcgcctcccactgtgattctgaggcctccccagccatgtggaactgtaagtccaattaaacttcttttggttcccagttttgggtatgtctttatcagcagtgtgaaaacaaactaatacagtaagttggtaccagtagtgggatgttgctgaaaagataactgaaaatgtggaagcaactttggaactgggtaataggcagaggttggaacagtttggaggggtcagaagaagacaggacaatgtgggaaagtttggaacttcctagagacttgttgaatggctttgacaaaaatagtgatatgaacaattctaggctgagatggtctcagatgtagatgaggaacttgttgggaactggagcagaggtgactcttgttaagtgactcttgttatgttttagcaaagagactggcagcatttagcccctgccctagagatttgtggaactttgaacttgacagggatgatttagggtatctggcagatgaaatttctaaggagcaaagccttcaaaagtgacttgggtgctgttaaaagcattccattttaaaagggaaacagagcataaaatttcagaaaatttgcagcctggcaatgcagtagaaaagaaaaatccattttttgaggagaatttcaagctggctgcagaaatttgcataagtagcaaagatactaatgttaatccccaacagcatggggaaaatgtctccaggccatgtcagcaaccttcatggcagccgctcccatcacaggcccagaggcccaggaggaaaaaacagttttgtgggccaggccaggctccctgtgctgtgtgcacccttgggacttggtgccctgtgttcctgccactccagccatggctgaaaggggccaatgtagagcttgggctctgggtttagagggtggaagccccaagccttggcagctttcacatgatgttgagcctgtgggtacacagaagtcaagaattgaggtttgagaacctctgcctagatttcagaagatgtatggaaatgcttggatgcccaggcaaaagttttctgcagtggtggggccctcatggagaacctctgctagggcagtgcagaagggaaatacggggtcggatccccacatagagtcctttctggggcactgcctaatggagctgtaagaagaagatgccactatccttcagaccctagagtggtagatacacagacagcttgcaccgtgcacgtggaaaagcctcagacactcaatgccagcccatgaaagcagccaggagggaggctgtaccttgtaaagacacaggggcagagctgcccaagactatgggaacccacctcttgcatcagcatgacctggatgtgagacctggagtcaaaggagatcattttggagctctaagatttgactgccctgctggatttcagactagcatgggccctcttacccctttgctttggccaatttctcctatttggaatggctatatgtactcaatacctgtacccccattgtatctaggaaataactagcttgcttttgatattcaggctcataggcagaagggacttgccttgtctcagatgaaactttggactgtggacttttgggttaatgttgaaatgagttaaacctttgggggactgttgagaaggcatgattgattttcaaatgtaaggacatgagatttggaggggttgggatggaatgatatggtttggctgtgtccccacccaagtctcaacttgaattttttctctcagaattcccacgtgttgcaagagggacccagggggaggtaattgaatcatgggggccagtttttcccatgctattctcatgacagtaaataagtctcaggagatcgtatcagttaatcaggtgtttccacgttttcttcttcctcacttttctcttgccgcggccatgtaagaattgccttttgcctcctgccatgattctgaggcctccccagccatgtggaactataagtccaattaaacctctttttgttctcagttttggttatgtcttttttagcagcatgaaaaaaaactaatacaacctgtttctagattaaagtatattttgatggtaacttaacatttagcccagagttgatactgatgtcaatataaaatctgaagtagacatagaattatggtatactttggggtaagaagtggaagtacttggaaaaaattcaacagataagcagtcaattagcatattaaactatatagtatataaaactattcattatagtaatcaatattacaaacaacttttctagggaatctttgaaatgatgaatgctcaaggatcctaagtatatcaatctatacaatgcaaattttaacaacttatgtaagcaattctacatctatctatcatgaacttccattatgaaaaacatcacttttagtatgaatatcagagtcatctaaattttacagacaaagaaatcgattgtggaataaaatttttcaaccaaaccaaatgtttaaaattttgctcatgtttttcgtttcagcaaataaaagcaataggtctcttttcttttcagcattcaatttttcaattgatttttattgatgtgttatggattatttttctgttaaaatacatatttttaaacccttctgaactttccaataatactttaatattattttatatcagttatattctcataattgagttagatcatttcctctatagtttaataaaccactgttagaatattttttaaatgctaataacactctatctactgcattgtactacattttgcataacaattatatattaaaatacttttctaatattgattttctaagttgattttctaatatctaattttctaagttgaaatttgtcttccccatcctcttggacattgaataaaatgattactgtgaatatcaacattttatattccttaaatgtttgaagatagctttcatttttctcttctatctttatttcactgggctaatcattctcattttttctcttctcgcttttgactctcatcatcatagtctaccttgtgtcggggctgttttcaaataaagcaggttatgcacaaaattaaatatattgtgattaacaactttcttaatttgaactctgtatttcaacaaatgcaactgaattcttattagattcatggtaataagtttacatttgtttttaactaaaattccctgaagcttgttcacatgtgctaatggtaaatcccacctttcccattctgtcttgcctgttatatccctatccatttgtcttcttccctctcccttcctacttgctttcctctctcttcctcccttcctttcttctttcttctctctctttattcattttcttcctattctctcttcctatttagttttctcctttatttcctccattttgttcttcctttctttctgcatgaccactctgttgacaaaagtcaatgatagcttagattgacataaagcagccataaacagcaatagagtatatcaaacagtgcatttttataaaatatgaagaaggaagttagtatggtcatgatatataccagtgagagctacaggattatctaaatcctcaccatcatgtagacagttactgattttatctgagttagggatacatagatctcctagaaaattatctctgcaacttccagacccagcactatatatctatacattagaatggaacagcttttcaaatggggtagtttagatttgtgctagggttatctctggggtgtattctgattagacagtactataaaaaactgtactcttaagcactgttaccatttttcttcatcatgttcagttttgccaggctacactacttggtaaaagtagattcctgattttcattctgtggaactcatgctttatgttttcacatatattttctttatacactttgcatttctctcctatatttttcatattattgtgtttgtttttgatattttgtttgttctggaaaggatctgtatctttcaatggactcagcatctgtttccatcttcagaagaaactatttagaaaaaaatacagatctcaaaatgcaagaactgaggactggctctgctacatattagccctgtaacttgagctagttatttaatctctcctatgcttcagtttcttaatccgagaaaaggataaaaataataccaatctcatatatttttatgataattaaaatacatagtttatttccagtatccagcaaactatctgatacagatacagaacttaatagaaatagcaattagtttgatcaatttgccattgttttaatcagctcaggctaccataacaagaacatcataaattgagtggtgtaaacaacagaaatttacttcccccagttctagaggctgggaattccaaaatcaagggactggccaatttggttcctggtgaagtctcttttcctggcttgtagagggtggccttctgacttacatactggcttgaccttaccatgctgtatgcatgcaaaaagagagataaatctctctctctcgttcttcttataaagccctaaattctatcaacttaagatcccctctatgacctcattcaaacctaattatctgctaagagctttgtcttctaataaaatcacattgagagtttgggcttcaacatattatttggggggacaaaattccacatatatcagttatcaaatcactccatcaagccatttaaaaatattgaagagaacaacgatttggtcgtctgtgtgtattccatgtgtatattcatatacagatcacactttcagacacacaaatgtgaattctcctcttttcaccattcactaatcactaatcaatttttattaggtattttgttgtagcattgatttttttgacatttagaaaatgatattccatttctttttcttactataattactaatcaattaaaacaagtttttggtctctactaaaaatacaaaaattagctgggcatggtggcggctgcctataattccaggtactagggaggctgaggcaggagaatcacttgaacctgggaggcagaagttgcagtgagctgagattgcgcactgcactccagcctgggtgactaagtgagactccgtttaaaaaaaaaaaaaagcttttacttttatttactatgtgccaggacattattctaagaatttttacatgtaacaattaacttttacagtttttatactcctttgtcttcttttctcgaaattttaataatttctgtgtatcattcttgggtcacctcttgctgtgaggctacagagaggggtggaaagggttattagttttgaagtcaactggatatacattacttagtttgttgaataaattatcacattttctttttttttctcttccttccattctcctttcctttctctctttgttggtttcttttacttttgttttcttctttcctacactgttcctgccttatttctttttctcctgttaaaaaaaaaaaaaaaaaaaaaaaaaactatgggaggacattgttttggaccagcctcctgcactaggctcctgaagaccagaccaaacagaatgcagtaatttgtgctaagtatatataatcaagctgaactttaaaatgggccagttttcagaaaaaaatctggatattcccgtcagcctacgtcaacataacagaaatagttcccactctgtcttaacgctgtaaggaaagtcactttgaaattaccaatctacttttcgtttcctgtttctgtctcttcagcccttttctgcccataaagccagcttcccctgctcagctcattggaacactcattctaatttatagaatgtggtgttgcccgactctggaataacaaataaaagccaattagatttttaaacaaaatttgttataattttgtcttttgacactcctttcctccttttgtgtgactatattcattgttatttccttacttgcttgtctttactctgtgtaggtagtacagctttacttcttatatttactatcttcattttggtaagtaatttaaccttttcataatttttaaaaatagggataatatatatggtatacacaaaatatgtctgatacattgtaggcaattcccaaagtttattgagaacagtttagtacttgtattttaaaattctctcattattctgaatgagacttttgtgagtaatcagcatttagcaagtcttgggagcacagtctttcaggttctctgtagatatacacataagcatatgttctttaaaaacaaacaatgataacaaacaaaaaagagcatagtttcaaacatgatctaattctgccccattctaattgtggatagtcactgatgaccaaatatcacttaaacatatatgtgacatctttactttgacttgaaatcagcaattaactgcagattgaaaaatttgaatccatatgccaacttaatttacataattaaattatcttaaagattctctctaatatttctctattttattttatctttctccatcaaacaacttttattgtaagaacacgagtattttacaaaatgcagaaccaaatcagcaaacacatttcttaggcaaagagaagagagtcgctcaggaaaatttaacaggtggtattttaaatacaatatacaatttcccctccccaccccagaaaaaaaaatggcattaaggagacttagcagataatcactcagtcttgatatctattttcaacatataaaattagtaagacaaagcctgattggctcaacctagatgatttgaaaagaatgaaatcatttagctatggccaaaggactcaggcttataggagagagaaggatacagaaaggtctcaaagaagaggtacctgttggatagactaatcagcctcacactagtgccttccaaccatagggtaccaataccatacctactgtgacatatttgacatgtcaccatatgtgaaatttctagatccttttttaaagcacaaatgcaggtattataaacaatgaacccaagttcaagctagcaccaatcccaaagtcacatccccaaaaggcaaatgtgttcatatcaattaataactgacatgctgaggtcactcactgagtttaaatcattcacatggtgtccgtggctttcagagaattgttgtgaccctttcagattcagaaacctatgggctaaacattaaatgtaaatgctgcaaatacaaaactttacatactaattgaagaaccaagcatgccaatttaccaagctgcaaaacaaattgctcattacccctaacagacaaattattccccttgagctctaaaatctaaaaacatttgagtgaggagcactcatctttaatcatgggagattcaatgctcaaccacgacccctagttgcacaggagaagcatacatgcctaggtcttgcctaaaaccatattccacattctttgggtcaacaacttgactgcacaatctgtagtttcaagcttatcatgagtagagtctgcaataggcctttcctgtgttcgtaagaccagttacatctaactgaagggaagaataagaaacagcctgctgttgttcttccctcaaattaatgaacaggagtgcagtgggtcttcatgtgaataagaagacaaaagggaagctcagcaaacctgcttaaatctatagtgttagcaggccagcttggcagccatgaataatctatatattgtattactggagtgagcacaatgggctaagaaggcaaaccaaaatccagacacatctaaggagataattcaaagtgtataggcatgcacacattctgcacattttttttcatgctctatacgaggcttttacactaaatttttaaaacacaggatgtgattcctgacattctatcaaccattttattaggtgatatgtatcacaaatcataaagatcaaatctctactatagccctaccaccctgaatgcacccaatctagtctaatatttctctattttaattccacacagctggagccctccattattataagtttgaagttttgcaaatcttccctttttgtttatttagtaatatataacgtaaaattcagtccttttaaagtgtacaatttactgaatcttaatgaacttatacaataatgtaaccaccaccaaaataaaaatgagaaatatttccattgtccgaaacagggtcttcattaccctttgcattacttttttcctacattactccaagaatgtggcaactattggtataatagtttttagatttgccttttctagaatgtcacataataataaatctttccttttagatttgccttttctagaatgtcacataataataaatctttcctttctatagtgactagttcattgttactaaaaaagggcctataacgggcaaataagcagaaaaaaaatgttctaatcagacacaatgctactacttggctgttaggcattgtgtcttcctgccttccaactgcaaaaaaaaaaaaatgtcatttttcagggctctaggcttgaacgtattaaagattggttgtttatctaaggtgcgcttcactaaaaatatttcatacaaatcaataattagttatctcaagattttcaaagatattcttgaattaggaggaaattctctcgacaaatcaaatgttcaccaaaaggccattttatctgatggttcctagatgaggtgaccaaagcattcacatccaaagtgtactgagactgaggatgagatatgtgtcctgctgagataagaacctgatgggcctttgcctgtcttaaagtaaattccttttagtagagattgactttctcttttctgctatgatttttctgctcaagttatactagaaaagtatttttcaaataggagtataaaacaactagccagaatgatgatgagaaatgattaagaattctagtgattttaagggaatagagtttatattatccactccagcatagtgatggttttctagtgggaaaaatagaactggaactgcatatgttgtgatagtttggtggcaggatacaaaagaaattctttgaaacagcatttaaaattccctcaggagtataaacattatttcttccttgcctgtgggcagcagagtgtaacatatgggacatacatgcaatatgagagaaaactgacaaacaggagggacatgttctttccctctctgtggtcccagtttggtctttagattcttaggcactattcccactctagacaagctggaaatagatttagaatacagaaacatatgcgttagaggaatatccctagaactttaaagttcaaaagaaataagaaattatgtagcctccatataactctatacaagttgtattagatgtgatattttggaagtttgaacaattgatttgtgcattttactttatatttatgaccttaaggaaaattcattaactagtgtgattttgttaactccctaactgctgataaagagcaagggacactgtgaactttcgattcatctgagtttattggaagggaaaaaagtcactaaaaatccatgataataaaattacttaatgaatattgaataacctatgataagttattgatataaatttagtaaatgctacattttaaataaataatataaataagtttataaataatgcctttaagtcaatcataaagcatatgctttaaaataagagtggttagggtaactagacaggttttgctatgttttatgtggagatagaggagtgtattttagaaattgatgactttctctgtaaagttaagtcaagcgattattttaattttttccctttatggttaagactcataaaatattgctttatttctagaaatagcgttgatttttactgtcttttccttttgaaaactaacactccaaagagaacactagacttcctgcatcgcttttcaacgtctcaacccattttagaggagaattctgcccaaaacaccttaaatttctcataaaattatttttacattttgttgctggtgaaatgtcacctaaaacattttaatgtaaattatttgttaaggtaactggattctcaagatgtaatatatttatgtctaacctatagcccttcatagtacagtagcagcctcaacttgtaaaaaaaatcacaataagctgaaaaaaatacaaaacgaaattagcattgtgacagcaaaaacaaggagcactaggaaaatcaggaaattgaatgacactgaagaacattgtatttttaaaaaatttttctattgtagtgcttcttagtaaaagttgaaattaaagctactgatttcctattagcaaataagggaaacagtctaagagcacctgaaaactggaaaatcttttatttcttaaaagctctttacctttgaaaacatcttcatatgcaaacttataaaccccacattttaaatgacaaatccaattattttctttgaaagcaaaacaaaaactaaaaaccaaagagagtactgaagttgtggaaaaacatgggtagtcttgtagttcactctctaagtccttttgtattccctccaaagtcattatttgtggtttcagatagaaaatacattcaggcagcaaatcatgttccttttgatggtataatgtgataattctcaaaaggatctcagcacccccttgttcatatttatgcaattaactagtactttaaatgcctaatatatctcaaaatgaaggctaaatatttcattttaataagatttcatttgattggaattttggttgtgaaggacatttgatgacaccttttcttttcatgtctaaattgcagcttatcagtgggaatttccacttagctctcaataaatttggggaataaatgccaaaataagaaaacattaaggaaatggaaaagtcctaacaatattatagggttgatagcaccttttttattacaccagggattactgaaaggcaatgcacttttcacatttttctaagtctttatttgctattacagtttaaaaaatcaattagaaagattatgtcattcaataattatgatcaaaagtaaagaggataattcaacttttccaggttttctttgataatcaaattggcataattaaagtgtgtttctcctgttaattgcaatattcaagtaacaataataaccattaatgaacaaattttcacatttatgaatggtataatttcatcagatcatacatcattcctttaaccatctctggagttgttatcagtctttgctgaccattgctgccctcaaaattgctttcctcatggcaaatatagtgtttctatgagaattttggcttgaatttgcaatagcacatgtgacacctatttgaatatatggtcattttttgagctcacaattttacttctaagtaaatactctgtgatgatgaatattacacatcaatttggctagattaagacaaataacgtgtctttttttggtcacacactagatgtgaagatattttgtagataggactaatatctactttaaacaactctaccttaacatttattttaagttgatttaaagcaaagagataatccttaatttgcctcatctagtcagtcaaatgttttaaaagcaaaaaccgaggttttccagagaagaaggaattctgcctcaagactgtaacttagaaatcatttcccagtttccagactgccagtctgtgctaaatgtcaactcttagctgagtttccagcctgctggcccgcctcacaaatgttgaactttccaggcactacaatcaggaaccaatttcttaaaatcactctctctctctgcacacacacacacacacacacacacacacacacacacacacacacacacacccctatagggtctgtttctctaaagaatgctgagtgatacaaattttggtgctgggaatggttctagaaggacagactcttcaaaataaattttctgaattgattctgggattttctagaattggtgctctaatctggttagatataaaggtaccaatggctctatttctagtagtaaagagagcactgatgttttgtggtgtgacgtggcaagaaaactacgtgaaatgtctccattgaatgcaatggaaatattcaaaatacattgaaaatatctcctaatcaaatacaagaggaaaggttctggatgatcatgtatttgatattttaggacattctgtcaaactaacaagtaaaatgagattagctgattgctcctaattgttctggacaaagtgggtacagaaaaggatgagctcatggtttcaaattcccagctcaagtacaacatacatgatctgaaagtttctatatctatcctgaaaaacaaaaaacaaaacacacacacacacacacacacacacacacacacacacacacccttatctcctgtagcaaaattcagctacttacaggataagactacttatgggttaagtttgctacaggagataaaggtgtgtgtgtgtgtgtgtgtgtgtgtgtgtgtgtgtggtgttttcaggatagatatagaaactttcacaatagcaatgacttggaaccaacccaaatgtccatcaatgatagattggattaagaaaatatggcacatatacaccatccaatactatgcagccataaaaaagggtgagttcatgtcttttgtagggacatggatgaagctggaaaccatcattctcagcaaactatcccagggacaaaaaaccaaacaccgcatgttctcactcataggtgggaagtgaacaagacaacacttggacacaggaaggggaacatcacataccagggcctgttgtggggtggggggaggggggagggatagcattaggagatatacctaatgtaaatgacaagttaatgggtgcagcacaccaacatggcacatgtatacatatgtaacaaacctgcatgttgtgcacatgtaccctagaacctaaagtataatagaaaaaagtatataatgtccaaaatcaaagagtgtctgctttaacattagggcactgattaggaagaaatggaatcctcaaaattagagtgggacatattttgatcagcaattttgatgaagctgaggacactgaattccaaaattctgcagtcatctttagcaacagcccttccacacctgtttgaggacattacagctgccttccctgaggaaattaaatgaactttgagacgccttgcaagactttactaattctactcagaatccacccccatcacccaccttgcttgtagacctctaattagactcaaatcctagatgagccaaaaaggtgaagtgcaaagtgtggcccatgaagagttgcactatactccaaaagaaccacatgattttttctaactcatacagagaaatttgaggaatgtgtttattgcttaatattttgggtgatttttgttgttgttgatattgaggtatcttctacatccttatggttttttgtcgtttttctatcaacaagtaaatgatatgtgttaaaatctcccattatgatggtaagtttgtctattttcatttttagttatatcaaattttctttaggtattttatagatatgttggtatgttcaaacttagcattctaagcttttccttggataagttattgtagcattatgaaatgtgtcatcatctgatattattgctctatcaaatctttcttggggttgtgcagcttatcttctattactgtttcacttcttacttttgtatatatttattttcagttgtatctcctgtaagcagcataaatcaggtttttttctattattttaaacttcaacttttatatggagtgcttaatatattcagatttaataaaatcagatatatttgactttaaatttaacactttattttttcattgtttctatttcttttgttcctttgattatctttcttagaatgaaatccttttttattttccactttattagcttatttttacaatattttgcctttacttttagcctaaaaattacagcatgcttccttgttttaatatatttatataaattagtacatttttcactttaaacaacataaggaccatagaacttctctcctcacttgccccactattaatttatttttattttttcctaagttcctagcttcagtgttatattgtcatgcattttaattttatatttatctaccagtatcattggtttttattcctccctgtatttctgtgttttcagttgcaattattttcctttgcaggaaaaaaactcactttacttgaagctgctgacaacaaattctctcaatttttttgatataaatttttattttctttttatttggaggatgttttcttttaggtacagcattctagtttggcagttttattttttagctctctagtaacagcatcatattatcttctagtttccattgcttatgttataaagtcagctatagatgacattgttgctgtttcaaagataatgtgccttttgtttaaatcaaaatattccctatgtatttgactttcagtaaattgaggtttcatttgtatatattctgctttaggtacatagttccttttaactttgagctttcttgtctcattattttgggaaaatttctagccactgttttcacttaacgcttttgtttccttcttctcttacctcacatcatatcatcttacctaacctcactttctcttatttctctctttccttttatttgggggtatttagaagagatgctaaaccttttgatcatgtctaataaatcttgtatgctttgtaatgtatttttttctgttatctactctattttctgatgactcatcttcctgttcactaactcttactctatgttcttaatgttatttctagaattaccatgtgattcatactatcaatgcaagaagtctgctgacagtatcgtataccttgttgtatacattaatcatagttatttaaaaacatctaaaaagtccaataacccttgtttttttttatcactgggtttcagtgacatagccctgcatccttttaaatctgctagtttttgagaaaatgttgaatacagtgtatgaaaagttagaaaggtaatctgagattttttaatgtaggtattttcagccataagggattctcttttgtttttaggaggcaggagagtaggagcaaatcaatttttttttttttttgagacagagtttcactcttgtcgcccaggctggagtgcaatggtgcgatcttggctcagtgctacctccacctcccaggtttaagcgattctcctgtctcagcctccctagtagctgggattacaggtgcctggcaccatgcccaactaattttttttttttttgtatttttagtagacatggggtttcaccatgttggccgtgatggtcttgaactcctgacctcagatgatccatccgcctcagcttcccaaagtgctgggattacaggcatgaaccactgcgcccagctggagcaaatcaatttttatcagcctgtgataagattgattcaaagttggatttctgcctttgcaaatgggcttatttgggtttgctctaatgccagttgaaagcctgaagtgtttaccgaagcccatcttctttggcaggtcttgaactaaatgtttgtctctgctacccatgaaactggcaaacctccattcagcttcttagcattttggctaaaattaaaatatcagcaaatgtgtagaaaagtgccaagtgttaggctcccctctcagcactcctcttgctttctgggatcttggtgcctcaagttctggctgcattggtaaacatcaatccttattttcacttttcttatcccaagatactgcccaaagctctgattgacttctcagtatctggaccctttacataaataagcaagggaaaggtggcacagaaatttggcactgcttggtataattcttctctgcaagttcttggtttctcaagggctggttgctgaagtagttctttaatattttataataattaaaaccatttttaaagtttttataattgttcttcgtgatctgttttgtcttctataggccagtctttcttattggattatagtgattttattaggctatcagtaagtaaacaaggtattttttaaaggagacattgaatcactctataaaatatgaaataaactctttcttgattaaagtctttggatacaagctttcaattctttgcataataattattgtaaaatatgataacacatgcttgaaaatgaaaagactaaaatataaagatttatttgttctatcccctgaaaagacagcactgattctatcacacacagatataggtatttatcttcctatagatcatacctaatattctcagagttgataatatattagagaattataatgcatatcatatatgtatctctcaggttacagaaatttcaaatggtgtagtaaaattaattttttgaggtccaggagattatcagattaactgaatcataaggtgactcacaaaatatatgagagtaaacaattatatatagtagaaaaatatatctgaatctgcattcatttttgaactatgtatttactctacctagatgcaaatcttttccccagtctgcctgtttcccatattattcccatattatatgtaaatatttctatatagacatgtatatagaaatatataaacatacatatgtatcagtctgcatatttatgtatgtgtgttagtctgcctgaagctgctataacaaaacatcacagactgtgtagcttaaacaacagaaatttagtttctcacagctctggagtttggaagtccaagattaaggtgccagcaaggttggtttctggtgaggcctctctctctctccttggtttgtagaaagcaccttattgctgtatcctcacatgatcattctctgtaagagagagctcttgtctctttaccaactaaaaaggacaccagccctgtttgcctaacaaggcaaatttccttagatattaaggctcacgcataatcctctttggtctgatgcgctgccttttgggtccactggggtaatagcgtcacctcccctactctgcacagaagccccatccctgtggcctgggcagccctgcccctgaggtactgggcagtggcattctgccctgctgaaacccaggaggtggccctcttcctctgagaccaaagagaaaacacctttgccttgttgggtatgtgatgggagtagcaactgtgctgctctctgaatcactttcagggctgttcttcctatttcttgaaggataatgcatgtttgaagccagttaattctattgtcttgttctgcagagtcccagaagtctgacagccttcctttattacatccaattctctctgttttgtttattccagctgtcagtgcttctgctgatgtaattccatctccgttcctgtcctcagcagagatggctgattaaatccataggtaatctctttaaggagcaaatttccagccacacactttgtctctctagaacatgctttccactttttgcaacatagttagtctgataattttccaaaacttcaaatttccagccacacactttgtctctctagaacatgctttccactttttgcaacatagttagtctgataattttccaaaacttcaaatcctggttccatcttgcttaaaaatttcttcaatttgtatatcttctctcacattttactctaagcaataaggaaaaatccagcctcaccttcaacactgtgcttctacatctcttctgccaaatatccaaggacatcactcatattttaccttccacaagagactagaacacaattcagtgaaattctttgccactttatggcaagactgcctttcctccaatttccaataacatatttctcaccttgagacctcaccagaagcacctttgttcatgtatctaccaatattctgtttaggataatataagtattctctaagatgagacattttctctaaagatcttcttatttatctgtatatatgtatgtgtgtatacatatatacatatacacatatacatatatgtatacatttatacacataaacacacacaaaaattctaaccttcagtctgacatattagatgggatctttgggaggcaattaggtcacagggtggagccctcatgattgaacttagcacccttataaaaggaactcatagttctcttgccctctttctgccatgtgaaggtacaagaaaatggcagtccgcagagagcactcatcaaaacctgaccatgttggcacagttatcccagacttccaggctccagaactgtgagaaaataaatttctgttttttataagccaccttactctatgaaacgttgttatagcagctcaaactaagatagacagacagatagatacgtagatatatagagagatgatagcacatttttaactggaaacatcatcatctttttaactcaaaaaagtaaaagatgcattcttagtagaattattcttacacaggcaagacatctgcctctatcaattcaaatgtatagtctaacttcagcaagaatatctctgtaggggtaattgtaatatctggtaaatagtaagcataatttatagcttaagagagatttacactaatttatacttgaccagaaattaaaaaaatatgtcaatgaaaatattgttacaataaacaactcaggaaatgggaattgtaaagctcagagcatggctccctaagtttcatttaagtaagatcagaatttttggaatacttcattttaaatcatgcatattcagaacactggctaatggaataaagtttagtaatatatttaaatatgcagtctcaaaaatgttgtcactatgaaacatacaaaaacaaccaggagtatttaacttgaatacacagtctaagtagatgtacatatacataacccattacaaagtcctaaaaccgaaatcacttcattttatcagtagagtctgaaggccattcagtcatttgtttttcccctgggatattagcactattgcaaaacccaaaaagaatattttttccacaatctaatttttttgactaatctgtttgactttctgacattacatttgcattttttagtaacctctacagttataaaacattgctttttagatgaattcataataaaaattattttaataaaccttatgatatgtttttctcgcattttcattgttcgcatgcatagaaattgcttcctattccatcagatcttctcattttactggggtatttttaagtcagtttgagtagttgttcataaacttttatttttataaattgtgacactcttgtgggtaaaatttacactttaactaggaatgatggttcactatagaatgatgcttttctgacagttgttgatttgagagcatgtctctgttaactttaattccatctctttttttccctgtaatgctcaaaatgccaatacatcttcatttaccggttgaaaattcctcttcccaaggcaccaagggtctactaaagagtatgtcactaaaactgttgcatttttgcaagcttgggcatcacatatggctcacgctagactcagatagctgtgtggagcaaatgctcaaatctgtgccagaatttgttcattttaacatcactgggactttcaaagaacaaatgccatctatgtgaaaataacacactattaaaggatttaatagcgttactcataatggttaccttaatgataatgctgaattgatctattctgaaatttattccagattaaaacatcttgatagactgttgctgctactgctactgctgctgctgctgctgcatccctagatttttcttcatatggctataacttttgatatgccaataggaaccatatcagtgacagaagaataaggatgctcgtggaatcctcagggatagaagcagcagtgtgtagcagctggagtatgaaggcttatggcagaggcagcagtgagtggaggcagagacaaaaaggaaggatccagggtaatgcaggattagcaggagagatgacaatgttaagggacagtttaggggaaaaagtagaattttgttctaaataagctgcatattctgatttcagtgctcagtccattgtatttttttaagttttaaaaaaattccaagttatattttatttcctcattcataatacaataataagcatatattaatatttaatgtgtgtgttttttatgtgtatttcatgccctgggtctgttgtagatattggagatatagtgtaaattaacaaaatattttaagaatttcttcctaattgaaggtggcattctggtctatgaaatcatatactatagaacaagcatatatattgtcataattattaatacaatgaatgtaaaatgcttagtgaagtacataatgtaaatattaatctctaaataaatgtaacattgttatttttggaaaatgtgtatcactaatgccatatcaaagagctaaaaactcaaatacataaatcatcttctaaaacttgccaatgaatattttatacaatgtttataaattaatgttaatatttatgtataatgaaatgcaaagctcttaagtgtatattaagatgaattttgacacatgaatgcacagtacaagtaataaccaaatcagaatatagaacatttccatccccagagaatttcctcatgaccccttcctgtcaagctcttctctactcaagccctctatatttatatttctattcccataaataaatctagcttgttctgtaacttcatcacaatggcacaaatagtatgtatttgttttttttttttttttttttgatctggcttttgtttttttttggtctggcttttgtttttttttgagatagagtcttgatcattgttgattttattactgaatgtattattgcattgcattttatgaatatactataatttttaaatcaattattctattaatgaacacttggtagtttctagtctttgactcttacctataaagctttctaaatatccttgtacaagtagttttgtaaacatgtattttcactctttagtaaatacctagctgcattatggtgctttgtaggaaactaccagatacttttccaaaatggttgaaaatcttatacactaccagtatattaagagtttatgttgctgcacttcctccacaactttagttgtcatcagttgtttcaattttaggccttctagtagataaaaggccatagtcatagctcattgtagtttcaatatttgtttccttgatgactgatcaaataagcacctttttatgttcttacgggacatttgtgtagattttgctcatttttcaccaggtttgacttttttatgtattttgcatacaatttgtcagagagatggtgttacgggctgaactgtgtcccccaatatccatatgttgagacctaaaatccccaatgtgactgtatttagaaaggtgtataaggacgtaataaacgttaaatcaggtcatgaaagtcttaatctaataaaacttgtttcctcataaaaagaagacacaccagagatttctttctctttctgaacaggcacagaggagaggccatgtgaggacatggtgagaaggcagccgtctacaagccaggaagagaggcttaaccagaaaccaattgtggtggcactttgaagtttgacttctaacctccagaactacaagaaaataaatttctgttgtttgaaatacccaccctgtgatattttattatgaaagccctagtagactaatacagatttttagcaaatacttttcttttaggctgtggcttatgctttcaagggtgtgaagttatttcccctattttttcttctagaaactattattttaagcactctgcatgtatgcatgacccatgcgaaaatattttttatatgatgtgagattttgccattaaacgatcacagcaactttgttgaaagccacttagactgtgcatctactatagactactaagtgtagacttcctactctgatccattgttctacttgtttattattatgtcaataacaccatcttgattaatgaagctatattataagccttataatattttatttttatattttaaaattatatttacatatataaaacatttcatatttacataatataaaatatttacgttttatcatacttttatattaaatttaaaatttatattttatgtagttatatattaaatacataaatatataattcttattataagaaatcaggcaatgtatgtcctccaaatttatggttgcttttagtgttgttttgactattctaggtcctttgaatttccagaataattggttagtccatttgtaacaaattggttgttgggattttttattggggtttctttgaatctatagaataattggataacaaacattctaacaatatataatcttccaatccatgaaaactatttgtcttgccatagaccttctttaccatttctcccagaaatggttttaatgtttagtgcagatatattgcatgttgtccactaaattcattgctatgattttattgtttttatgccacagcaaatggtattgtgcttcaattaaaattttcacttgtttgttgctgttacatacaattgttcttttatatattgaccatgtatccagtgaatttgaaaaaaaagttattacatttataaaatatatttctcaggatttttcacgaatccaatcatttcatgtatgagtaaagagaggcttagtttcttttcagtcacgattttgctggatagcactggcaagacctctaatataatgttaaataaagcaatgagaactcacattcttgccttagttcaaatcttagtaagaaagcatcaatattctgccattacatatgatgttagttctaggtttttcagaaaaatacttcatcagatagaggaaattttcatttattctcattttactctgagctattaacatgactagatattaaagattgtttaatgatgtacccataatatttctcttttattagagtctcattttggattaattgctcttcaaaagttaaaccaatcctgcattcaatagataacgttccacatagtaatggattataatttatacttattattggacgcaatttgcaaatattttctttaaaatatttttatctttgtgtgtttcactgaatttctagatgtataggttgatatttttcaccagtttgacaagttttaagccattgttacttttaatatttttctctcttctcctagaaccacactcattgctatattacttgatattttcctatatattactagatcttcatttaattattttattattttggaagcttcactttagatcatgtctattgacctgtcattgatttcacttattcttttttctttactgtctaataagctgtttaacccattcagtgaattttctttcatttattgtacttttctagtatttccattttctttttatagatttcattcttttgcaatttcaaaattattctttcatatgtccaaatttttatttactttccttaaatatattttaacaactgtattaaatcctttttgttaactcaaaatcgatctcatctggtaatccatttttactgactgcttttgctgctaagtatatgtcacattttcctgtgtgtgtgtgtgtgtgtgtgtgtgtgtgtgtgtgtgtgtttttacatagctagtacattttttgaaattctgcacatggtcaatgttatcttaaaaggagagataatttctttctttatatggtactggtttgttctgataataaaaccctaacagatcttctgtattttgtttagctttagttatgatgtctttatttttgttaacttcttaattcaacggttatattctgattcaaaggtggtgtccttatccctataaaactttctgggttcttacgtaaatttccaagggtaggctagaactctaatggctccagtactgtatgacctcttatagtttccagtcggatctgagctgaacaggagctattgtctacaaggtaacaagcaaagtgctcagcatgaacatatgaagctcagttattaggtaagtactctcaaacatttccaggaagaattttggaatccttcttttgcagaattatgtatcttctctctctctgatcaaattctaggtgttttggtagctccaaactaatttttttctccatatcaatgtgcaccagacaatatgttaccagacaaaatgccagattgaatgtggagctcgtctgtatgtattttccttctttcaaggatatttcaagaaatatacatagccgggcgtggtggctcacgcttgtaatcccagcactttgggaggttgaggcgggcggatcacctgaggtcaggagtttgagaccagactgaccaacgtggtgaaaccccgtctctactaccaatacaaaattagctgggcgtggtggtgcaggcctgtaatcccagctactcaggaggctgaggcacgagaatcacttgaacccgggaggcagaggttgcagtgagcggagatcgcgccattgcactccagcctgggcaacgagagcgaaacttcgtctcaaaaaaaaaaaaaaagaaatatatatatatatatatgccttatagctaacttctagagtaaacaatgataaagaaattagaagcagaaagataaagataaatttacttcaaagagccaacagatggtagcaaacttcttcacaaaaatatattacaagaaacagagtcagataaagtgttcaggtaaccaaaaattgagaaattcttccacaaggagacctctcattctaaaaaactttgaagatgggatatttgatcacaagaaaaatttttcttgatgaaattgttgagatataagaaaaaaatggaaaagaacaacaaaaggttatagtatgtgagtgaatttaaataaatattgatgatataaaataattctcgttgtatattttggagttcaagagttcaagagaaagaataaaagcaaagtagaattaagataaaaataactgctgcaaagaagcttatagagataaatgatgttaaaatgttcaaagatcttagatcatgtaagaggaggaaaaacattgatagacatattataaaattaagcaaatatatttcaatgactagagtagcatcaaaaccattggaaacagcatacaactttcaaatagataggagtttcctgtggactattttggctgtaatttctgctattttctgttcaaagtatcttattttctatattctgagttactttaaccttaggctgatcattttccttatgattttatttgtataaacatttaagacccaggatgatggtgggtccctacaggaaagatgtgtaaatgtttctaccatttgctttggaattgcaagatatgtcaacatatgtaaagtgtcaacaaaataaataaatgccatatgtgaaaacttttaagtaaaaacattattgaaaacccaaaaacatacagatacacagtttttcaaagaaaacaatgataattcagagcacagactttttaaaaatagttgttacatttgtaaagtaagttatatgttaagaatcacatacaatataaaataattgaaaaaaattgcataatggcacagagaaaaatgttgatccttgtacatattatcagtacagtaactctattctacatgtatataaaaataaaaatgtaaaaatttggattctagatatttactggagcaaaaatattaatgctcagagcagaaagttagaaaactcagcagttttataactcatgaaacatttttaatgaaacagaaatgtaacattatgaaatcttgagatagtagaaatgaagtatgattaaactattttaaatttaaccaatattcatattcatatatgcattgaaaaattatacctttttctaagtttgattcttgaaaattatagttagttttaaattatttattttttcagtgattttgtcacatttaaaattcccccttgaaaaattgctttattaaagtgaaatatttgaatatggagtttgaagagtaacaaataatttttcttataatcagttgtaaaacatatataattttcaacattagtttagtatctacatgtattttaatcctataaaagcaatatttttattgtaaccagaaattagatattcataatgctaacagatttttaaatattatagctattagtatatataacttaaatatttctaatgtttgaaatttcctataaaactggttcttaaacccttcaactactagaagcctttaatgcagattgataaatgtgtactttacctaatttataataaatatggcatattaagtacattttctttcttgactctatatttccagaattttaattcagacttccataagaatcaggaaattatttactttgacctaaattaatttgaaactccctacaatggtactttgtgaacttcgtgtttttagttatttcagtttctgacatttgtgtatcaatatttttaaagttagtccattttcttacatgtgttctattcagcatgcttccaccaaaaaaaaaaaaaaattaagcaattatggctttcttccatttagattatgtgggcaggtctgtgggggtagtacagaaggtatatttcatctcaaacataaacaggaagccaatgtgctatggaatgaatgtttgacccctgtgaaactcatgttgaaacttaatccccaatgtggcagtattgagagatgggatctgaattaattaatgtaaattccagtagactcaacacactggcatcaaccattataattacaacaatttttatgaaacacttatattttcaatacctgttatcctttttgaaataataaggacagagaatgtaaaaggaagtggaaaagcacagtgtggttaagagattcataaaattgtgcttggattataaaacactttaaaataccttgagacatttttgaaccaaagtttgtcagaaatatctatacacatgtaattaatgacaactataagtaagctaagacaggctgggctgagaaggtggtattaggttttgggggcagaagtctttgcagaatgtaaagtataataggatagacggtatttcagtggaaacctactgattttttttgttttcctgtattcctttcacttttctgtctgtcactcttatttctttcaatcctctttgagcttttttgctcttttccttttatttctccactcttgctctctcaccctctctctcacacactcttcttcccacaattccttcgtccctctttctcctttaccacatccctttcagaaacctttattgaagatatattatgtgaaaggtatgaggtattcacagttgaagaccatattttcagtttcatatcggcatatcccatattcatactcagcctctggcagcacactcctaaaatatatggtcaaagcacaaactgaagaataaacaagacgatcacttcacctcagtttctttttcttcctttttaataaacatttgccaaataactgccatatgccaggtacttttccatggtgctgaatgtaaagagaattacaaattgaattttgggtatttagtaggagggttaaatagtaatgtaaaatctaaaaaatctttacagttatagaaaaaaagagggaaagaagaaaccattaaacagaacctatgttggacccttttttttctttttttttttttagctcgcttaatctttgcaacttaatgaaatagttactattatcttcattttagaagtgaagaaagagaggctcatatagattaattatctttacagtgacatttcgcatgcatcaaatgccaaagactatttccttacactctgctttttcttttttttaaattttacttcaagtcctgggttacatgtgctgaacgtgcaggcttgttacataggtatacatgtgccatggtggttcattgcacctatcaacctgtcatttaggttttaagccctgcatgcattaggtatttgtcctaatgctctccctcccctttccctcgaccccccgacaggccttgtgtgtgatgttctcctccctgtgtccatgtgttctacactatgcattttgaagaatgaatacaagtttgtcaggtacaaaaatacaataacactctaatgaagaaggagaaaggaaaaaaaacagcatgaacaagaataaaaaaaagatttgctgacacttatatagcatatactatattcgattatgagtactataaatacagcaaataatttaattctcccagtcctgcaataacttatgtaggtaatatgtaggattcaaggtggcaaaaatagattatgtctaattttttaaaaaagcaatgctaagaactttgatccttgttttcctgaaaatgaagaattaatgaacatttgcaattcatccaaatcactagaaaatattttaaaataatatctatatgggatataaaaatagtaagaatcatattattcaagttaataaagtattatggtcttaattgatactttcaaaaatagtaaactacctaagatcagatcaatgatgaagtccattttggattttttacaaatctcataattgatcaagacagccttaatgttttcctaagcttgactaaactttagataagcttcttcctgcctctaggtctctgacctccctgtcatcccaacccttatagaatccagatggcctaatcacagaggtctctttcctctcttagagcctttactttagaaaacctgtaaattcaagctgggcgcagtggcttatgcctgtgatcccagcactttgggaggccgaggcgggcagatcacttgagatcaggagttcaagaccagcctgggcaacatggcaaaaccccatctttactataatacaaaacagttatcagggtatggtggcatgcgcctgtaatcccagctactcaggcggctgagtcaggagaatcgcttgaacccacatgatgaaggttgcagtgagctgagatggcaccactgcaccctagcctgggtgacagaatgagactgtctcaacaacaacaacaacaaaacgtgtaaatcctttctttgtccctttaagatgtaatttttttaaaaagcttcttgccaggtgtacaaagcaggaatgtctttaccaagaacctgggagatctcctttggaaaaactcagcagggctgggttgatactgctttctgatctcttttctctattgcagtagagttttttatttttttttaatttttgccctgtttaactttgcacagtccaatttttgctttgatataattacaatcctccaaactctgaggacagtagcattttgaagagtaaatatctggattcaacataatccccaaattccaaattctaacagtgtatataatgttcttaaataatagattgattactctcaatttagatttacttaagtaactaataagaagccatgtaagtacaaaataaactcaaaaaggacctatacattcgctacttacttctctaataactttatgtcttagtttcaaaaatgattctcaatttttcatttgtatggacttttttgatctaaatatcgcattcaaatatgacacatttctccaacaataacattagtatcagtatgcataagaaccctgcattaatagattttccttagatcctgtctacaattgaaaaaatatggcttaacaaaaatggatgatattctttgcatataatttttagaagaactcacatttcatatccaccaatattatacaatattaagagcttttccattatttttctctgaaggtagatagcacttaatggtatttgcaagaattatataattaaagaattacattgtgttaaagttggatactacccttctgaaaaaaaatctctaaaataaaacaaagataattctattttttgagttctcataagtaataccttcaaagccataatcttatcagtatttgttagtctaaggaattattttctattaaggaaaatatgaatataaaaagtcacaacttttgacacagttatctttcaatatgattcttatattgtcaatcatgttgtccaagctacaatatgtttagcaatttccaaaattcttaatattcttagcatcagcttttgggacacatgaaattcttttcatcttcatatttaatcaaactaaacaagcagatcaatctacatttctcaacatgattttaataaaagattctgtattttctattcatcaggggacagaagattcaaaggcaggcctagtcattaaagaggaagtggatgaagcaagagcatcaaagatctagcttggcacaaatgaaaagaaggtaatttttttcttcttcactgtaccatatgcttcctagagttctcagttctctattctacaattatccaaaaagaagatagaaagagttttaattattattctgtaaacaaaaacaaccccttaggtaaaagctttggaataccatttctatgctttaaaaatagaaattataattccctcactcaattgcctttcatttttgcctcttaataattatacagattatgtttccattattctctcaaagataagggctgcaaatttaggctgaactgtttcatttacctgtttcttgaaaccacttttgctctccaatttatctacctggccaattgatcaccatgacctatcaatttcagaacatgctttttgaatcgtggtctttttacacacagataaatacgcttaagatacatatagtagtttttttcaacggatattccataatcaagttgtggtgttaatcactactttaattataaataaagccatttaaaataagtggattcaccttggggcagtcactggcttgcaggtgcaatgttcagcaaatttttgtttcagacaataatgtctagaaatgaagtaaacaaaagtgtgcataacacattatttcactataaaaaaactgtgatatgagatgtaagcccttgccttgtttttcattgttgacagtttttatatcctgtgattggtatcatctgatattcactcataagctcagctttagtccagagtcagaaacactccagaccttggtcctcaatgatttcttgagttctaggtcaatggcttccaattagaaatcagtaaagttatctagaagcacttatgaaagagtttcaatatttaaaaatacctcatacacaatcatcacttacatttacctttaaggcttcattgatctgtagctaattaaagtgccaaacttttttgcatttaattggaattaatatcaactccatgaacttccatattacctcaggttttactcaagagtgacacatattattttggtttaggatgtttagttgattactttgtctctctcaggataatagtgttaaacctggctcatttatttgacagatagttgataacagatttcagatctttgctaggcactggggataaagaaataatagacttcaccttgctatcagtttgtttctaatctgattggagagggaggtaaaccaacaactatgatagacagtgataagtatattagcacagtgctaatcaaacatagaggatagacatctaactcagaacatgcagaaactgaaagtaacacatggtagtatatacctgtttgcttccatttgcctttcaaggaaaaatagcttcaaactgcttctgtgggtctttcccttttaactttgattttgacgagcaaaagcccttgttagcatataccatgcagtccaatatgcacatattggaatatatgcatattggactgcatggcatatcctaacaagggcttttgcctgttaaaaccaaagcttacagccaggcgaggtggctcacacctgtaatcctagcactctgggaggccgagatgggcggatcatgaggtcaagagatcaagaccatcctggctaacacagtgaaaccctgtctctactacaaatacaaaaaaaaaaaaaaaaaaaaaaaaaaaaaaattagccgggcgtggtggcggtcgcctgtagtcccagctactcgggaggctgaggcgggagaatggctggaaaccgagaggcggagcttgcagtgagctgagattgctccactgtgctgcgggctgggtgacagagggagactccctctcaaaacaaacaaacaaacaaacacaaccaataaacaaaataaaagcttacatagattacagctatttccaatctcaacactgtcttaagttggttgtctctgccaatgcttttcaagttctaaccatttcccttgctattagtacccttcctccagagaagctgatccatactggagttgtttttttgttgctggtttttgttgttttgttttttttttcctacatgactttgttctctctttgcagctgttggaaagtaagccctgctaatgtgatctctgccattttctttgtctaccaagatagaatcatttcagatattatcttttgcaccatgtttagtcctttaattttggagctgctggacagcttaggagttgatattccaggtgcctttttagagatttgatcttctcagaaaagaaaaatatcttatgctacctcctaacgtttctatcaaagacagacactaactgactttctaaattcaaagagtatagccctagaatcatcattactttatggctggtgtggagataagaaagacaaaggaaagaatacccatctcgtttgcatatccactaatccattcttttcaaatcagtataggtttttctctaaccaaatagcatcccgccaaattacctatgaagcaaccctactaacattctaatctactccacccaaaggcagagggtattacattgaacttcttataaaatatttttatcacaggttttggacgtagagaatatatatctttaaaatacattatcatttaaaataagtatagtaattttccatgaagaggaggaaaatataggaatgtcacaaaagtatgccagaacccaaatgtttttaaaaatggaggcagcagaaattttaataattgtttttgtttattgggttatattatcatcacgtaattgatacttcaatatccattcttattggagtcagttatatgaaagctttaaatagttacccaaaaagaaaaacaaaggtataaagaacactcatggccgggcgcggtggctcacgcctgtaatcccagcactttgggaggccgaggcgggcggatcacgaggtcaggagatcgagaccatcccggctaaaacggtgaaaccccgtctctactaaaaaaaaaaaaaaaaaattagccgggcgtagtggcggtcgcctgtagtcccagctacttgggaggctgaggcaggagaatggcgtgaacccgggaggcggagcttgcagtgagccgagatcccgcagctgcactccagcctgggcgacagagcgagactccgtctcaaaaaaaaaaaaaaaaaaaaaaaaaaaaaagaacactcattaactgttagtgagattattgtttttataaatggcagccaaagttacttccatgaacagtgtctttaaaagtaagctctaaattgtgtgttttgtagattcagcttgccatatttcccaatggaattcaggaagtgacgtttcctttaccaactcaatagctacactcctggaacattagctttgtctgctgagggataagagaatttatggctggaggatatggttctaatttacttgagatttcctgataactttgcttttctggcttttggcatcagtgatctaaattgacagatcaatttgggatagaaacatgcacttgtcaagttgtttccaaaagtgaatctgagacctaatgctgtttcccaagaactgctgctgctctttctattccaggccacccctactgagaatcactgtaatagattgatcggttcacagatacagagcaaaatgattgcacagggacaaagtcatggtggtaccatatggtaagtcaaggaaataaatacctctttaggcattgaataaaatagttttaaacctcatggtgaataaaaataatgtataatatcatatttattcactaatatatgtaatagctatttttttattctccacatttaaaaatagcaaccacaatcataattgtttatgtttaatggttccttaacaccaattatttaaaaaaaacagtatatcaatctgaaaatgcatcagcatgctagccatttttatataaaacttatattcaagaatatttacatattctatacacatattggactgcatagcatatgctaacaaagatgtttgcctgtcaaaaccgaagttaaaaggggatagacccatagtagaagtttgaaatcagtgtatggttatgtggacacagagaaagaaaatttctagagcaagttccaattttctgtatctttatgtgactgcctgaaatcaaatcccatcacacctttactttaaactgcttcctgcatctattgtatgcccataagacttattccccacaagggggtctgagtgatctttgtaaacatacaacaggtcttgttgcatcactctttaagttatcattgcattctttaaagtataccactcttctatggactcccaggctctatatcatcttttcttgagtccaattctgtgatattagctgggactacacttccaattacactctgcaatccaaatgctgtaaattgaatttctctgtgtttctgtacttctccaggcttgccctcatttctgtgtctttgtacgtcttgtatcctctgcatagaccccttttcttctggactatgtgggtcattctctgctcagatcaaagcatcagagatactttcccctagtgacaattaggtcacctatgctaatcagtctctatcccattacccaatttcattttcttcagaatatttgtcattatctgatttttacctatagactataaatacctcttgaaggttttatgagaatagagattttgtctgtctttgtctgattccatgtaggctactataacaaaatgccatagacagggtggcataacaataaatgttaatttctcacagttctggatgctgaaaagatcaaggtgctagcttatttgcttggtgagatccctcctcttggtttgcaggtggccagcctcttgctgtgtcctcacatggtagaaagagagatcctttctattctgcctcttcctatgagcacactaatttcattcttactaatttcaccatcattgcctgataacttcctaaagagcacacctccaaataccatcacattgaggattaagacttccacatataaattttagaagacaaaaatatttagtccatgtaagtcttattcacctctttattctcattgtccacagcaatacttgaaacataacaaacatacgcaatggacattcgttgaatgataaatgtaagtaactttcatttggtaccaatgatctgatactaaagttacattgcatcatatcagtttcttgtagattcaattttccaacttattctattttgagattctatttttctatgaccttcacagggtcttcttgacttatctctatttctcaatcctggaaaaaccccacactagattttgagttatggagtagtgattatttccataaggatgctgtaattaacaagaccctcttacaatgcttctggagcaagctagagtataaatatattttaaattaaaaccaatccatagacatatggagccacctcatcatctctttttccataggttgtacattttgtatatgtaagtttgtgtgacttaatttctagggtttaaaaaaaattaatttcttgcacatttccatggctgcgtccataatccaaagcaagaccctctaataacaaatggggtatctttgcaattttcatgttgttttaaagtgttaaattttatttggcttaaagctgcccccacacatagcaaactgcaacttaatttagtatgtaaaggaactgcaatctaaattaagagtatactcttttaataagtagcagaatttcagccaatgataatagccaagttttagccaatggcaggctgccaactgaccataccatgttcaaataaagccaatgatgagctgtaaccaatcaagctgtttctgcatatttcttcctttttttctgtctgcaaacactgcctgttcacgttgctgtggggagctctctgaactccttctagttctgacgtttttagcaactcatgacttgttctttcctcggataaactctgctaaatttaatttgtctagtgttttcttttaacagttttgtgtcaaaagtggggtccaaagtagtccactagtgactcccaggagcaccgagagatcaagcaaaggtacctgtcaggcccattatgctccttgttatcttgcagtaactggggtcaagggtgagttctccctcagatttgagctccacagatttgctttttgttcttcaaatttatttgagcaatttttactgaactgggatctcggattgaattggatcccataaataactggatcgaatccagaaagaggtctcagataccttaataaacatgagatttttaaatccaaggagtctgagactccaggagactaggactccattttctgggatactggctaactttatgtacaaaaattatgagcccagaattagtatatttttggagaaatgggttaaccttactaatgaaaacacagaattatggtaactagtgcggggaagttttaacttaaatgtgttggcttgtgaggtgaggtgccttagaaaagatagaatcagaaacaccaagaaagtaataggatgcattatttaattgttacacagagccatctaaaagattaaagaataaaagattaccacatcaaaagcttccctacagaaggcaaatgaagaaaatcttaagtttcttgacaaatattattcaaacgatgtagccatctgggcagaaactcttgttccattggccagtaaaacaatttggatctagaagttttttaagaaattagtgggttatgtagtattgtccttggcacataactaacattttttaattaaaatgataagagctatttaggtttatatatttatgtatgtcactatgtatgatgaatgtgtgtaatatttttctatctttttataatattgccaaattaaaatgtaaaagagctctatctaatcatcttcaaaataagtgcttatataaatcaggtattctgttagaaaaactaacctgaatacttttcaagtttacatgacttggctaatccttggtaaaaaaatattttgtgttgattaaatctggcatatcttcgaagttgtcagcattaaatatattgcagacatacaactatcttggtttactggtgaaataagctcatgttatctttgtattacaaattttttttcaggaagaaaaataacttaagatgatgactagctgctttgtctcgtctttataagcaatccaagctcaatagctaaatataagtaagttaaataactataagataaaattcctatgtgaaagatttcctccctatagcacaaggttttaacattcttatcaccaaaaattgaaaattatggctgagaaaaatctttacaagtaatttaattctcaagcctagcaaagaaaccaaaggacagtgatcaaaatgtttcccctctccagtttcttatttatttatttatttatttatttttgagacagggtctcactctgtcacctagactggagtgcagtggcacaatctcagctcactgcaacttcagcctcccaggctcaagcgagtctcctgcctcagcctcctgagtagttgggattacaggcacatgccactactgcccgggtaatttttgtattgttagtacagacgtggtttcaccatgttggccaggctggtcttgaactcctgacctcaaatgatccacccgcctcgacctcccaaagtgtcccctctacagtttcttatcacaaagagaggctaaagatgtctgtgactgtttgtaaacatgttttgtgccacattgataaattgtactatgagaaagcacatgcttctagacatcatgattcataaatttgccaatctacatattgctctgtgacagtttacaactgcttgcttcccactgttcactggaaatgaaggttactagagttaagaattttaatttatagatgttgcttaatttttaaaaaataatgagaaaacaactctatatgcaaatatgtaaggaaggtaaaatgtgcttttggtaagaaaaagctatcaagtatgaagagattttgttttagttaacgaaaaagaaagtatttttagtcccaaagaagaatgactattgtttcaaaataaaaaataatacagataaaataattgaagtgatataagaaggttgtagaagtttggtgggagaagaatcttgtgaaaggaatttaaaatgtaatcaagctggctaagattataagcagattatctataaattttttctaaaatttagtattaatatcaaaattatacagtcaaaactagaatgtgacctctctgctaaaacgagaactttttttttggagcattagtcggctttttacaggaaattgtaaaaggttttctttaccttttaggtcattggaaaaaaaaagattttgcattttaccgagataactttctatgctttgtattattagtttctgcatcactcaagaaagttaaatcctaatagaagagctaaggtttttccactaccatgtaactttctgtatttcctttgaagtctttatcactctggttaaatgatttactattttttcacagtgacctgtaatactattttgatgaacccttgatatttttgacaaacttcccaaaatcaaattctaaaatattttttattgttgtcaaattaactttgagattttccaaatgggtccttgagacacctcaaaaggctctctctccttagataaagatgagtattaaactaattgagcttatttgatatattaaattataagaaaaacactgtgaaataataagtaatgctaaaccttttttgagttctatttgtatggagtgttattattatgtgtttgagaaattgtatgatattcgtagaaatcttatcataccatttaactgagtaagaattcccagaactctaataaaacaactgaatgttttcatgctaacccaatttcaagcagaacaagaattatttgattactatggaactgctgtggcaggttttcattctaaggcagactaggctgaaattgttaagatgtacaattgaaatgaactctataagactgatccaagtcaaaatgatctatgttaaactatttaataaacagtgctatacacttgaattagagaaacaaaactggtatttaaaagtatgtaaattcaggccaggcgtggtggcttatgcttgtaatctcagcattttgggaggccaagacaaatggatcacgaagtcaagagatcgagaccatcctggttaagatggtaaaaccccgtctctactaaaaaataaaaaaattagctgggcgtggtggcaggcacctgtagtcccagctactccggaggctgaggcaggagaatcacttgaacccaggaggtggaggttgcagtgagccgagattgcaccactgcactccagcctgatgacagagtgagactccatctcaaaaaaagaaaaaaagaaaaaagaaaaagtatgcaaattcagtgttgagtgtggactcatggagaaccttaatggctgcctaatccttcctgagtatttaaagattctattcttcaaagctctgcattatatgatgcatcataaaagagataaaataatatgttatgaaaaaatgatgaggtgactgttctaaatctaaaattgttcataacctatgtctgatttgttaaacccataatcctgagaagacaataaaaacgtcagatggtacatttcttgcacctgttggatcatttgaacacttacagaaacatttcattcagttgccaccttcaatgcatgttttctgtttgtatggaagatttctcttgcaggaaggccaatattataaatagtagctaaaaccttattagtatccccttatagggcattcctggaaaaatatccagtgatagaggtcatcatttcactggacaagttgtaaaacagtcagttaaagtattacaaacacaatggcatttggtgaagcaaactgaatcaattagatttctttggtcaaaggtattaccaattaatggaagtcagattcactcctgccggaaaacataaattgaccacttatgaaatagttactggaaggcctatccccctaatcataagaacttcatgtgacttatgctcttatgaactctgacatggctcaatattttgagactttaatccaatatgctaatgtatgtttttgcaagataaaataagcccttcatgtcctgccaactgatgacaatcagacctttcatgattgagaacccagagattgggtttttggaattagcaccagagaaagactgccctataatttaattaaaagggactgtagcaagttcttaccacctatacatcagagcctcaaggattggcttcacattgtcttaactgaagagaaccttaactccagaaccttgggactgtacactcattggggacctcaaggtataattaaccaaggatgtttctcctcagaagaagatgacatcctagatgtgggcagctttcccaagatcatggaacaggaattatctcctccaccatgaaatcattgtcccctttcctttttctcctgtgtgttttcacgtatacatggcaagataatatgacaattaagatttcatgatcaatagcttttggagagaacttaactgaatgttacatatggcatgttactaacagcaggtaaaacttataatgagagttttacagttaaattattccagaaatttaataagaagaaagataattcagtggtttgtaaatgaatttaccaccctaatcccttaattgtaagtagccttcaaccatgcaatgattcaacaatagagccttagacaaatatcactagtgcttccctactgtgattcctaatgcataaagcatcctaccatctgttttgcctctctagtatatgtttttatctatgtaggatttaacaaccaaccctatgtgtgggcaactccatgtctcaataagtggaaaataaggggctactgtggactaaatattctgacagtagcattatcactccataaccaattggaaactgaacattggtctacacctcttaacatgcagtatagaataaagaggaatttgccagcaggtaataaataactctgcttgtaggatgcttcttccctggcttagcataatgtaaatgaagttatgattagaaatccgtctcaaatattagctactatagctgactctactacaaaggctacagatgcccaacaaacctatttaaattctcttgctaaaattgttttaggtaacaggattgctttggactacctgttgactgaaccgggggaatgtgtgtgctagttaacacctcgtgctagacttggataaataaatctggtataggagaaactcagttgaacggaatcaacagagaagctacttggttaaaacaagtagcttcctcttctggctctttgttgttaaatttaattctgtttactcgtgggggcttctgttaaggagtatatttcagtctcttggtattttatccccctgataactatcgtaatagttttcctggtgtgccatatcctcttaagagtcttaaatacttgtatgtggctacctcttgtacatcaagtggcctcactctggttaaatgacacaaaaaaaggagataatataaagaatcattctttatgtcatcaattgtgaattccatactgaggactaaacaagctcattatagtgatggagagtagcatcatgcccaaggatttggtcaatctctcaaaactgagaggctgaccaaaagaagggaattgttaaattagttatgtcctaaagctgcctctgtacatagtgacctgcaatctaagttagtatatataaacaagcagcaacctgacttaagggtatattcttgtaacaagtagctgagtctcagccaatcatagcagccaagcttcagccaattacaggctgtcactgatcagaccatgtccatataaaacaaatacctagctgtaaccactcaagctgtttctgtatgtcacttcctttttctatctacaaatactacctgcccacattgccatgtgaagctgtctgaatctcttctggttctaagggctgcaggattcatgtcttgttctttgttcaaataaactctgctaaatttaatttgtctaaggctttgttttctttaacaacactatatacatgcacatatacaaacatacacacatataagaacagtatttatgatgaactatgttcattagagaattattcaggatcttaaataattgttgactgtagtggtgttgtgataatgtaaaatcagaaatagacattttcaaagaaactctgttctagtacatatcatacagacataatccacagtataaaaactgaaaatataagctcttgctctctctctgagaaagaaaagtatgaggtcaaaatgcacatttttctttcaaatcagaatcagctctaaataaaggaaagctacaatacagatcacaaagaattgaaagtgcatttaaaaatctggtatggtgctttaatgtgtctctttgtgcagataggaaaccaaatttacaggctttcgaactaaacaatgagctttagttaactgaaaatcaaattcaaacaaaggtctcaagaaagactaaatttaattatactctgcactccatcaaaagtgacagattttttctattatattttcctgacattgaacgaaataagaaaaaagtctcttattggcatattgttttactgaaaactctttctatccacctaaattatacctttatatttgcaaggaagtcaaagtttgaataacatgtttgagttaattatggaacaccataaaaaacgaatctcagctagctcaaagatgaactattcttaattttaatctctttagaaatgatcaaattcaaaatgaacgtttaagattttgaaactctattataatattattcctttttaacctcctagttgtttcttttctaaaatctatacatatcacagagagattttacttttgatctggctattttaacttgtactcttctttgtagagaaggttaatgtcaagattaaataagcaagagagagaagagaagcaagtcgattggcaggaattgtctgggagctggaagaagcttccggatgtgaggtaatggcaaaagaaagacacccacaactccacactcctgctataccattttacaaccctaactatgggagaactcctcgacttctgtgggcttcaaggctaacagagggagctgcctagagagtgcacagaggcattgttcgagagagggaaaacatatggagtcccacaggcatccgaaccctgagcaggtgcaccttgctactattctgagatccaagtccccaaaggaagccagtgctgctgtggctgggccaaaaagatagaggagaaactgggaacttccatgaacaaatcccagcattgctgccgagggttgttgaggaaccaagacatgaccaaactgcattcccacagctacctgccggtgctgctccagctgaaaggattgccatcctccctagtggcaagtccacaggcagctccattctgagcccagtttccaaaagtctatgtcctgccctggggctagtgcagatgctgccactgctacccaaggacaaaaaagggtaggggaggccaggcactttcacacttcaagagcaaattctaccacagctactgcaggctactgtgataccaaggcaccaagaaaccacatgacccacagctacctcgctagcctgcttccattgtgagtgccttaccctccctagaggcaggcccgcggtgtacccacacctgattactcacccagcagcctgagaaccaccctgcccctgcctaagatagccagtccctgaattcactactgggggcctgaggacaagactgtggcctagtcctgttcactttgtaatgatgttttcaccatccaggggcctagaagttgtccagcccattctagccctgttggtgcctgaacactccttctaacactccttctaaggtctgaggtccggcaaacccaacttgcccagactaccatagcttgcactgatctgcacacaacaccagtgaaatggggccttggcctacccaccctgttgcagtcactactatcactagcactaccacttgtgttccagtgagttgctccaccactaccacagccattgaccacatcacaccagatgcccagggtgctgagaatctgcccaaaacctggccaacaactgccactactaccagcatttaagcaagacaactggaggtccaagaattggcccgtgtgtacctactaacactatggccaacaaagccacccactaacactacggatcccaagacaggtacgctcatcccacctctgccaccaggggggtctgaagactgcccatctggcatcccaacagattataagtcgaaaactgaaaaaaagacaaagaaggtcactatatataatgataaagagatcaatcagtcaaagggatatatcaattctaaatacactggagtacccagatttataaagcaaatattactagatctaaataaaaagatagactccataaaataacagtaggggacttcaacaccccactgcctgctttagatagatcatctaggcaggaaaatcaatgaaaaaaaagggatttaaactaggctctagaccaaatggatgtaattgacatttagaaaacattctatcccaaaactgcagaatatacagtcattaatcagcacgtgtagcattattcagagtaaaccatatgttacaccataaaacaagtctaaataaacttaaagaaatcaaaattaagtcaaataccttctcagaccacagtggagtaaaactgaaatcaacaacaggaaatactttggaaagtatacaaatatgtggaaactaagcatcatgctcttgaacaatcactgggttaataaagaaattaagcagaaaatttaaaaatgcttgaaaccgatgatacataccaaaacctgtgggatacaacaaaggcagtgttaagaggaaagtgtatagcaatatattcctacatcaaaaatgtagaaatatatcaaataacaatctaactttgtacattaaggaactcacaaagcaggaacaaagtaagctcaaaactagcagaaggaaggaaatagtaaagatcagagcataaagaaaccaaaatagagaattaaaaaataatacaaaagatcataaaaatgaaaagttgtttcttcaaaaagataaaattgataaattactagctagactaaccaagaaaggaagatccaaaagaaaataaaatcagaaatgaaaaaaagagattttataactgacaaaaagagattttataactgataaaagatcatcagagagtattaggaacaactgttatatgctaacaaactggaaaacctagagaaaatgggtaaattattaaaaacatacaactttcaagattgaatcaggaagtgatggaaaacctgaacagattcacagcaagcatggaaatttaatcagtaataaaaaagtctccaaacaaagaaaagcccaggactggatgaattcacagtgaaattagacgagtcaaacaaagagaaactaatatcaatcttcctgaaactatttcaaaaaattgaaagagaaggaattcttccctactcgttctatgaggccaacatcaccccaatactaaccattagacaaggacataacacaaaaagaaaactgcaggatgatatccctgatgaacatagatgcaaaactcctccacaaaacattaccacaccaaatccatcagcacatgaaaaagacaatgcaccatgataaagtgtgatatatttcacagatacaagggtggttcaacatgaaaaccaatcgatgtgatacagcacatcgatagattgaaggacaaaaattatataattatctcagtagatgcagaaaaatcatttgataaaatttaatatctttttatgataaaactcctcaacaaactaggcattgaaggaacatacctctaaataataaaggccaaatatgacacacccacagctaacatcgtattgaatggggaaaagttgaaagcatttcctctgaaaattagaacaagacaaggatgctattttcagcacttgtattaaacatagtagtggaagtcctagccaaagcaatcaggcaagacaaagaaataaaaagcatccaaattggaaaagaagaagtcaattgtatctcttcactgggaggaagcaaaaaacaaggcgcttgcatgtaataacagatctatataattttataatatgcaatattttacccatagctactggacatgtcatatcaacatgaaaaaaaaaaacatgtgcagttgctgatataaagaaaagaagtatatgcgctataatataataagtgataggacagtggtgattttggggtttgcacagggaagccttcttggaatttaaattgaggtaggaagaatgattaaaagttacatagctcccctatcagaaccatagaatttgcaaagtcttaaaatgtgaggtatatttaaaaagtatgaaaaaatcaatatggctggaatacagtgtatgaaattgagtacctgggaatctgtatttactggtaagaaaatctgtgtcaactcatttctcatttcccttccttcttaacacctagaaataaccccccactggtaaaacttatatcttcatcttcttaaacttccaacatttcccctctctactctctgtcttatctgatacttttgttctttgttttactgagaaaataggataaattagataaggactttcagattactgccctcaccgcaacccaaatgatgaaatctactaacctacattcatagtcagctatatattttgtcatgaagtagaggaatcatgttcctaaaaccagttctcctactttatgatctgatttcatctgcttatacacactcccagacacctcttttacagttggactcctcctttcttttcagcgttgtcaaaagtttttaaattctctcctctctactataatgtccatatcagaatatagtattatataatgtttctcgaaaaagaacttctttggaccctgcaacccactcctactagtgctctctttctgtgctcctctttatagtaacaaatgcacactcctctaacttgtagtttatatttatcacttcactttgtctttatccactctttaaactcctttcagtgaactttaaacttcattgcaaattttcctgtcaaagccattacttgcatccaggctgacatatccaggggtctttaaaaattttttccagactttatctaaatcatctcctcagcttttgacacatttcatcactacatgctttctgttttctttacttggcatcaaagatgtcatttttttttcttctttctcaataaatgctagttttagtctactttttttacttttcctcatttttaaaacttccaaataatgcagtggcccagcatcgaatcctaaattagaatcactgtctacatactacatgtagaattcaagcactttccattagctctgttgctaaggtcccagttaagccaccatcatctctcatctgacttactatttctctctgtattggtttcactacatatccaatggcctccttcagttcagcacttcaaagcatttgttctctgtgcctaaaatattcttacctgggtgtttggatgtcacttctttcaaaagccaccctgttagagatatcttcatttaacatacttcagcacacgtataaaacacattttcatatttaggttcttgctaaatatagttattctcataatatattgccctaattgcctttacttaacattacatcattagtatctgtcatgagtccacatttgaatgtaatttcaaaattttaatatttccataaatgtatttgagaggatacagtgcaaaaatagaagtatctgataccaaggattctctatcctgatgtagaaacatcattttgtgtctatgatggcagaagagaagaatataataaatattttgacaccagtatttcctaatggaattaaatgatgtagtagtacagctagaaatataaaccagattctttccccattttaatatcaggctagagtttcctgttccaagtttctgaatcatggctttttaatattcctcatgtacctcttttttcaagtataatagcatattgtttcattatatcttgcttatgacctccttgtatagcttattcacttcaatatttattgaactacattatgcatcaagtaccatatcagatgtcaggggtacaaaggatacataagacattgttgctgctctgagccacatggctacagttttacttggaaactacatgtccacattcatcacttctatctattggcttttctgtagaccaaaaaaagaaaataaaagagagagagagtaaaaattaatatctaatagaaagagaggataaaaccaaagggaatcagtattcctcagggaagattagcagtctaaaattttacctgagtgcacctctattttatctatagataattttaattcaatatgccttatatctatatatttgataaataaatctaaaatgcacacaataaatatttttgtagcaatatttatctaagccagtggaataaatatatttggtttgaaataagaaaacacccttcaaacacaaagagagtttgtgcagctttcaatgaatcaggggaacctcttttggggagaagcaggaatcaagagaattctcacatttacagaatttttctgcactctaatagaatgaacactgtattagtcccccagtattttctatggaagagaaataaggatttgcatttgtgaaaaaaaaaatttcttatgctgataaatcctgttttctctttatgtatgtaagactctaatttaaaactaaaagaaaaaacatttagtcagcaaggaacagttagatgtatgtcattacagtacttagatattaactacagctaggagaattaattcttgttaagatcagcaaagtgaaactaaacaaatacagcctgtcaactgactaactcttcagggaacaaatatctactagctggtaaatgttatctgggattatcaaagccattgtcaagaaaatgtgaacttgtggcttcttatgtctggagggatcatgaaatgtgtgcagatttggaaagagaaaataattagtttgatgctttttctaagatttggcttcagatactataactattataaggtataaattaatgatcaatctgaatattaatgatcataaggaagttcaaataaattagaagacaaataaataacaaagttaaaataattaataattaattttactatagctgttctctctcaatgatataggtaattgcattcacaaaaatacagcaatctaagtaaatttagaaatgcttaatgtcttaaaacattgaattgcaagaataatgcttaaatatattattaatacaataaatagcatatttcaatccaatgtcttttctttgttctcatgaaaaaatgttcagttacagaaatcagaaactgtagttgtgtgtctactatattgggagaatatagaaagtataagatatttatgtggacaaaggcatgtgatccaaaattatgctaaaattcaaattggaaattggagacaaagaatgaagaatattgtgtgtgcatgtgtatattgttgttctaattcttagtttacattggttatatttcaacttaatattcattcagtataagccatgccctgtgttaagttctatacataatagagtaatgattacaacatagtttcttggccataagtagcttacaatctagtaatggtataaggaagtacataattatatacatgtgaaaaacaagatgagcatcttaaaatggaataaacttctgtcagggacagttaggaaaagcttcatggtgaatgtgatgacgaagaacttggattatatggtaggaaacattatattacttatataagcttatatataactttcagcaaagcacagtgttaaaaaacacaatatggatatgtagatgtcctttcagtatgagcaacatgaaataatgtctttattgcagggaggagaaaatgcttctgttcttccaccaccctcaaattctgctgaccttgcaaattcccatggaaagagacaatgtcaatctaactaatcagaatctgaaatactgcgattgctccccagtagaatgcaaggtacacaaaaggcaaggattcagttggctttatgtatgtgtctacatcctatgatagtgtctagtatataataggtactttacaaatgtgtgctgaatgaataaaaaagcactaaaaatggtggttatcacttgttacaaagtagttgttttcctctatcagaatgtgtgttttttgaagataggaactacctctcactaactattagaaacacatagttattctgggcactgtttaatgttttagaatgaatggatgccagaaaaaatattaatgaacagccctacactctatatgaaaagggaaaatgtcttggcatttcagataacatcaatataagtgaacaagctatcaaccatttaaaggaagtcaaataggttttgaccttttcaattacatccatcctttaactcaaaggcattattagcacttaaattacagtgtttgtgtaaacaaatttcagttcaactagtcatcttccggaggaaacaaaatgtgtccagtgtaagttgatctaattatgaagtagaaaatcagaatttgtcacaaaggagaaggtgatgatgccaacatatcgtttgccagtctgatcaggaaaaggaacacaaaacacagaaataaattgcactttcatatgtttatatgggaaaggaaaaactccaaagagaaaatctctgagcaacacaaaaggaatttcacctctgccacttgcagggtaaaacaaaacattttgaataatgtgtttccccagatttgtagcaaggatgactctggaaatttgacctttaacagatgactacttcaaacactccctttttttttttttacttttttcctaatttacgtgccaaacgggaaaagtaatttccattatattatgaacagttcatcccctccctcactgcattttctcagggtcaacacaatcatcagcagtaatggatgcctactatagttgaggtggtagaaaagccgagtcaaattgaaataaaaccctgacgaaaaatttatgcctcgagttttaatatcatcgatggtctggtaatcagacataatgtgttagaaatctgtggagattataaatcagatttttctgactaatagaaactttctaaaacattccctttagcaaattattttcttaagaagtggcagagatgatattttgcacatatttgaaaagagaacttttctggagcaaagcaatttttaagctaaaagagataacttatccttaggcaagatccattaaaattattttgattctttttatgaattctcaatatacttggggtagagcaaaacccctacttattatatttgtgtacctaaccagtgggttaccttctgcctttctaatcatctgcctatctaactacccacgtaacataaacaaaggattggcttattgtaaggcagagggtttaattaatcaaataatctaattctggaaatcaagtatgtacaacaatcatcacaatctaaatgttaataaataatgtctttatattactaagtagaactgaggaacctcagaacctatgtatttgaattcctctgaacatataagtgatatacagggtatttattcctctttcatttaaaattatcttagatgtacccagttaatatagagtatagaattctaacattcattttggtaatataataatagtatgatgcatttgtatagaaatttattgttgacaatgaatatgctcataattatattatttaataccaagtaacagccttctaacaaagacaaatgtcattagacattataaaatcaaagcttaaaggggtgaagtgtggctcatgcttgtaattccagcactttgggaggccaaggcggggtgatcacttgaggtcaggagtttgagatcagcctggccaaaatggcaaaaccccatttctactaaagatacaaaaaaaattatctgggcatggtggcaagcgcctggaatcccagctactcagaaggctgaggcaagaaaatcacttgaacccgggaggccgagtgagccgaggtagcgccaccgtactccagcctgggcgacagagcgagactctcttccaaaaaagaaaaaaaaaaggaggggggcgggttggggggttaagtaacttactaaagatttccagtttcagcaagatggtcccattttgattatttatgtgtatggaaaaattttaaagttaaaaatccaacacttatttaacaaataaatattagcttgttatctattcttactttggtgattggctaagataacattcacaaaagagttcaagaaattttttttctcaaatacattgacataaaatatattaccaactacttcaaatgtggtcagatttggaaggaaaaacagtgtaacagagtacttgagaacgcaagatctgatgccagtgtgttttggtttaaaccctaacttggtcattcactctctgtccttagactatttattctctctcaccttcagtaatttttcagataaatatggggaaaatgaacctaactcggagggttatgctgtggttgaatgaaataaaacatgaacagattgagaagggagccgaatacaagtgtcccacctacacattgcctatttgtttattaatgcatcaacaaggaatgccaaataaagagttgccctcagccactctggtattgaatcaatgagtatgtgtgtacatgttaatgtgtgtgtcaaggagaaaaacaaataattggcagctggataagaggagaaaataaatttcacaagtttgaaggtgaggatttgactgggaatgtcaccacttgctaacacagaacacctatatctggagtctgtgaaatgctctttgatgttacgtggagagaaaaacactccctgatcccatacagcagtcagtaaatggcatttcctataacattataggtaaaattttaataatttgtagaatcaacagctgtaatttgccagcagtggtgaaaagattcaatgaggcaggtaatcgctgaggcagtctctaggttattctgttttagatttttttaacttagatttattctgttgtatcatatgtagtgttacgaattttgcatgactactgcccttgtggtgcaatgtgaattaaatgggttttagaaaggaaagtggtattttgcaggaaacagttttcttcataagcagcttatatgcaagtctgttttcaaagaggtaaattcatatgatgaagtattggtgcttactcagtaagcaactaggaatttggaagcaagccaaggggccagtacttaacacatttaaatcaaaaccaatattataggctagcagacactttgatgctaatgacacattacattattcttcagatctttattacaaggactccgaaggtgcagcctttgataggtgacagccttgctgggtttcaaggagtagaaactttgattcctctgagttactaggtttcacagttgtagcaggttggacttgatattttgttggtgaattccaggacaatttctttctgctacaactacaaagtggggtgaattaagcatgcttgttaatagcaaagcagaggaacacaatttcacttatggttttttttcttttgaatttgattaggaattccctttctaaataggtatgatatgagcatttaaaaaatttcataatttaaagaaaaactcatgaaaataactattttttgagctgaattatcctctatgtttccttgtgaaataaaattgcagtaagtatatgtatacattcattttacagcatttcttcttatcaaaatcagttaaagacagctcagctctgtttgttttattctattatgacttgaaaagtttgtgatttattttctattatatacaagcttataatatgtattatgtaatggattaattaaatgttcttatatagaactggatattttattctcaagtgatatttgatattaatttattttatgtttttcaaataatgtatgctatcatagtagcaatagtaataacaataaaaaggcatgaaaatgggccaggatgaacatttcttatttagtacacacagttcagattgaaaaagccatctggtttagttttttgtaaaaaacatgtatgtgtttccctaaagatgaattccagagaacatctgataataagatatttaaattgaattatttgaaatagtgatagaacattatcttagactaatgtagagccagcatttggggaaaaaattacaagtaaagaaaacaaaggatttgaattgatttttataaaatgataggtaactgaagattaatatactcagtcctttatgtcatgtggatatttattgaagaatgactgtatgcctaacattgcactttgtatgcacacttgagagaaactctccatcaagtatgaatctctgtgctgagtcagcatgctgctgtggtttgagtatcattctaaatgcaaaataggtaccaatctgtgtctggtaaacagtgtatgcaagcataagtcctggtttgcactgacagttcttgggtacgtagtcagaaatcttgacaactcatacatcagtgcaaagctcttggccgacactggttgtcctctctacttaataacctctcttttttcccttcacattagttgcttgagttttgtctcccctaatttactctaattcattcctaaaacctttctaatttgtattcttctcacactaccccactgcaactgctattcccaaggtcaccaatgacctcctttttgctaaaaccaatcaacatttctcagtttttgtttttgtttttttcccacacatgaactggtacttcatctgacaccactgcctccttccatcttcctgaaataaatgtttaaattcttattacgtctcttttagtgttttgtctccttacttgggctctcttgcttcattctgtctcttcttaaatgttgatatttttaaaagacctgtgcttagccttttatttttttcttttacttataaaacaaacaaaacctctcttattccattgctgggttagttcatacatcttcataggtttatttatatttgtatggctcccagggcagctttttcccatgaactccgggtctatagattcggcagcataatgaatattcttttgactccacttgctcagattcatctactcttcttcttccccatgctatcacctctgtttaggtcacatcatctctttcctcaatgaattttaacatacacttcactgatatatctgttttaagattatctagcttcagtccatcaataatcaaaagggattttttataaaatataaatgtattcatgtcactattctaataaagctaaaactctccagtgacttcctccttcaaacagattacaacataaactacatactaaggcgttacaagatttattttgtaatagttcctctccttccctccacccccttgtttcagcctctgtcacttaactcaatgctattgtcatactgacttttttcaggttgatatggaatataaattgttctctctatctctgagtgtttgtatatgctgtctgaaatgccatatcattgtacttggctaattctgttcattgttttagatctattctcagaaagtactcttcttggagtattttctccacacactgaagactagtttaagcacctttcctgtgaatctcataatacctagctcctgagtagatacttgcttccttcattaaagcgtgattctggaaggccagtactgagtcttacttattgttattgtccttagagtttagcatagtgattggaataaagttggtgttaaataaatatctatggtgtgatttcaaaaccactactaccaactactccaaaaacctaagaagcaagtctacataacagaaggtcagcatattttaagatatactcttggattaacatagcattatgtcacagctgtatacaaaaatctgtatttttttctttgcagcagactgaaaggtctaatttatggccatttaaaatgtgagcacagatatcctactgacatcacagaaatacatggttcatgtgtcactgaaagtacatatgttttcaatgaaagtacaagaaaataaggaaaggtacagtctaatataacaatttaaaggtagagcgttttcagggttggttgatgtagcgtctgtacaaaactatcagaggcctggattcttttcagcactcagccctcccatactaattatcttggttctctggctacttacagttggtaagatatttgtagcagctccgcaaaagatattgcatttctgtgtctttattttaggaaaaagaattttcatcatttccacccttatcccagcaggtttctgcctatacattataagcaaaaatcaggtctcagttttatttctagcaaggaagatgggcttataactattgtcctaaattaataaagggagaagtataaatggatgacaagaagttaaacatcattgctaatacaaaaccaagtgccaaaaagttgccactatttagggtctgaatccaatgccaacacatagaatgcttctttattaagcccatatgtgaatatcatggatggaaacagtgaacaggtagttcttacatggtcagttaaaatagtataattgcaagcagatatagttactaaataattaaaggaccatctcaagttcaactagaaaaaacacaaaagttgattctagaggtaacagaaataatttaatatgagcaaaatattctgcagccatgagactaaaaagcagagttatctaatgtgattatcttggtaaacaggtcctaaagatgatttcaaaaaacattagccaaatttgtatacctggtaaaggctttatcttgaacaagaaaaatgtatcgtatgtcccgttagctcagcctttaatatatgatatataaatatatgttaatatttatatatatatatgtgtattccatctctaattacatatatttagtgaggaaaggtgggggagagagagagaagcaagaatgtggatatacagtttaatataaacataataaggatatagaaaacacacacacaccacacatacacacaaacacacacatacaaatgaacaaaatggcaatctatctacttaataaaacagtgtgaataaaagttccggatatagataacctacttataagttgtttcctagctctattattcactagcagtgtgactttcctaaataatcctacgttttcttatcaataaaattgtgatagtttgcaatttaggattgttgggcaattaaaggggaaaatgtgtaagtgttcaacacagtaccgagcatgctttaaacatcacttgaatattagctataataaaataaaaattattatttacaatattagacatacaatacagccataataaaattataagcaagatcttattcataaaactttttaaaattgtctattaaaatcttttatttaatcaggctcaaagagcagaccaaaaccattgcttctataggttcaatttctttcctttattcatatctctatggaaattaagcagagagataatgtcatacagatgaatattaggagataaatttgtgttgctgtaagttctttgaagctcacagtctacttgcaataaagttttctgaaaatgtgaatcacagatacgacattagggacgatagaaaacaagagaccaacaagaaaacatgaaaaagtgacacagtgtaattaactgtaacagttaattcatagataattttatcttgcgatcttgaaggaaaataataactaaagtctacccaaattttcttcgttcataatctgtggtcttggcctcttgcacaaataagcataaaatatccacactggggttgtagagtcatttgaaatacatggcattatttttgaaaaatttggatagactttagttatcatttactgtgaagtcaatacatagccatcaataagtataataagtgagtttgtttagtcatttccctttactttttgataacctgtgtgaacctaaaataaaattaggaagtcaaaaaaaatgcattagtggcttttgttctccagtggagtcactattaaggggtatgtaaatccttcatgttagagtagacaaagctcatcttctgtcagtacattgcatagtcaagtaatacaaaagactgaacacgtggaagatgctttgagctctttgcaaagaataatccatgataaaaataatttacttgtcttgcatgttaccatattttattttaatcattttcataattttcttatactatctgatgttttctaatacaatcatcaagtttacaaaatcataaaaaaatcattacagtacaaatgtaggcacatgcattatcagtcataaggtttatttgaattcagcttacatggtttcagggttagcagttacaaagctgttagctgaaggggaagctctaatgtactggaaaacttggacaacacagatatagcttcatagtagatctaaatttgtattgtatgccatcttcaaattgttgagcctttttactcaataatcaatatttcatccagcacaataataaaatatagaattatttatggttataattaagatgtactttttcagtcacaagagaatgaaaaagttactggagaggtgatgtgatttaatgaaaaggccattgaataagcagctaaggctctcaaatgagacaatgaatgtgaaagcctttgaagaaagataaagtattatgcaaactcatagtattaatattaaaagcctaaagtgttcatttctagtagacctcatgggttttttggctgtctatcagaatcacattaaaaagtattctataaaaacagtaatatttggtaccatatgaaaatctaagactcatgttttaacatcaaacttggaattttctccttttatgatattaaagggtgacccttaagatccgttctgcaaaaaatattttaactttttttttatagtggcattcggcgagtgttcttgtcttttacttttaggaaatgtgtaatagcaactgcattattaaaactaggtatattccaaaaaggttgtcagagaccatgacacacttggattcaatctcagtggagtaactgcaagtaattgtcccaaagtcatcacttttggatgtctcaatgaatctggctttgataacatgaaaatttttatttaggaaagctcgtggaggaaggaacatgactacttttgctgtaaaatgccaaattacacagaaatttaatttaaggtttaaattaaatttaagaaagccttaaattaatttaagaagccacagccatctctctctctctctctgtctacttcagctgacgcataaatgtgtttcaaagaagcatgctttacaattaaaattaatatcaattaaaattaatatgtattcatttcatatcctttcagatatcttttccaagtgaagttcaaaaatcttcataaaacaatcccattaatccttggagcattcttatgtggaaagtaggaagagaaatgttattcatccttttataaagtttgaaaaataaagtataaaggattttaggtaagctataacaattaagtcagtgggagatccagacatacaacaaaggttttataattctttttcttttactttactctaataatggcatttttaatgcttttacttttctttattgattaaaagatcttatccctctcttctcagtggaacatgtgctcctggaagaaaggagacataaaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacacgtaccctaaaacttagagtataataaaaaaaaaaaataaaaaataaaataaaataaaataaaattatatctctaatgcctattctaatgtgcagaaagcaattaataaatatatttgaaattgaattaaatcaaatgtgctttgtttttcatttcaaaagcacacacacacacatacacacacatatatatgatatatatcatatatatatatgtgtattttgtttttattcaaacatcgcaaaagagttacacagtgaaaagcaggtatctctcctctctagatatatatgccctgatccagaggcaaatgtctatcacttttttatatccaatctatctttctatataatttaatgtaaattaatgaacatgtgtgtctttgtgtttctatttatttttgaacaactgggagcaaaatgaatatactgttctacatttgtgggtttttaacaacaatatttattggataacttttaaaataaactcttcatttggaaataattttaaatttaccacaaagtagcaaaaattaaaaaaaatgaggaacattcatctacttttaaccaaaattcagattctgctcttatgaatattttatgttattgtttaatcatttgtttaatccttttatttgtccctccagcccctcccctgactctctttccaaaatcatttgagggaagttgcatacatcatggtcttttactcctaaatatttgtatttttattgcctagaataactctttcatcttatattaccacattaaaattatcaacatatttaatattgatatgataattttaaataatacatggctgcatatcaacgttgcctgttgaaatgtttgccttttcaccccttcagtatgggaccaagtctagaattaggtgttgcatttagttatttcttttgagctttttttaacctgaattatatcagagcctttctttgtctttaatgtcatggataattttgaagaatacaatctccccactctcacagaatattcctcaccttcagtttgtctgacgttcatgattagttttaaattatgcattccaggcaaaaaaataatacacaggtgattttgttatctgggaaacaaatctgggggtacataatatccatctgtccctcactgataatgttaatttaaaaaatgcaattaactattttctggttttccacagtaatgattatttttgttcttccttgaaactaataggaagtccttggaaagtcactttatgactatacatgtatcatgccccacaataaaattagtccctggatttagcatccattggtgattcttttctcatcccatctttactactacggaagcaaaacgacaattttccaagtatctctccctctaacatttccaactggctgtctgaattctaatgtaaaaaaggatcatctcttttcccctaattactaactctttattattattacgggctcataaattttattttgtttcatagcttataatttgatacctcattattttgtttgatagcttgtaattcattactgctccaaattgtttgggttctgacatttttgtagattgggtcatgacaccattcttgaaagtctagaaggagcagagtggtctcgcctaagaggaaaaagatcgcttagatcagtagagagtgtattagcagcagttgattgcaggctggcctcagatactagacctgtttgactgctttatgtgggaaagcactttataaagtgcctcctaaaatgcaatgtaacttcttccaaccttcacttcaggtggttaaccatgtgtcaaaaggcctggtctgacaatgctgacaagcctttagcttcatactcactacctgtctgacttggcccaataagccactcttcctgagccttgcctgagcctgctttgccaatccagctctcaaatcatctgagactaggggagggggggaaattgagaaaataccactgtatttacctttggtggcctcccagtgtctcagaagttatccacactctactggcaacctccatcttttcactatacaatcacactgcccagttgcctccctttgctggggaccttcacatggctgaggttctaggaaaatatttaagggctttggagtgagatttaaattctgcctagggcctcaacctcaagtagaacaagttcccttttatgcagttaacaggcagacattgattatagagctgcacccattcagtctaactccagagaacgcgttacaaaaaatctccatttgcaggatcctgcaatgcaaaggtgtgtaagacattccccttcagctcactcgccacgaagctggatttggtaaacatagatactgcctcaggttcaatctatctttcccttgaatctgcatcatttcatttatttaaatgacctctcagattcctttattttgatactttgtccatgtgaataggcacggacccttaaacaagtatcttttttgctatttcttctattgaatatttcacatgtaatgactcctttttaaatcctgtactttctgtttatcaggacacattgactttggactaaagtttcaagagcctttaccgattttatgattttatttgattgtccggggaagtactttagagtagaaaaaatagggtctttaaaggcaaatagaaagaataaaagagagggaaaaatggaggaagggggtggctgaaaacctagctgtcccatccaaccttacctttatacaatggcatgcataaggcaccaatcccccactccccaccacatatatatacacacacatgtacacatacaacacacacctcccagctccctatgggctctaatggctcttcagaactttcagcgatgcaagttaagggaactgactctagctactaacagagcccaggaacaagacaccttttagatattttgcttttttaagcagattaacattaaggtggccccaagtgataaaatctgcaatgtgactcttgactttcctcttcttcaataatgggttgaaaataggggtttctaacccaacatgtactctttccaaattgtctaattagtggcaaacactgcagccatttctccaggtctccaaactcaaaatgagtacatgagggtacagtttctttttgagctcacagggtaggcatctggccatctcatctggctccaataatcaatttttcttggttactgacaaatttttctcaatcaaaattattcttgttgggtgagctctgctacttgcaaacttagggaaattaataaaatatatctaacaaatgatttggcagtggcagctgacagtcacttagaggtctctgagaatgttctgtgattgttccctgtggtagacacaccctgaggtgaccctcaatgattcacattcttgtcttattccctccccttgagtgtgggcagaacctgtgacttacagccaatagaataaggcaaaggtgatgggtcgctcccatgattttattagactatgtaagattccattttagcagacttaaacaagagattctcctgctggctttgaagaagtaagcttcacttttatgaaaagcccatgaaagagcctcctggcaaggaactaaggcggcctatagattctgagggtggtatcctactgatggccatcaggaaaacagggacttccatcctacagctgcaagaaacagaattctgccaaaaactacctgggtctgaaaacgaaccctgaactccagagagaaaaaaaggttagtagacacctctattgcagcctccagagacccatgaataaaagacctatccaagctgtgtccatatcactggcccaatgaaactgcaagataataaatgtctattgctttaagcatctaaatttgtggtaacttgttacacagcaatataaaacaaatacatttttcatgcagtgagaagagtccaggaggagaaaagactggccatattcagcctgcccctgtgacttctaaggctatgctgctgctggtggtgtttgtcatttttctcactaaggtaaaaaagtgaattaagatgaaagaaatgcaagagaaatgcttataaatactaagaacagcagcatcttgcctaggtcatgcctacgcctacacgcacataagcaacacacatcctgtactttctagaatgctttgcactgtttaatgatgctgggcggtcatttgctgactaccctccaggcatgtttttaccaattagattaggaaagatggtgactgccacagcagctcgagggctgtgtcagaaactctcaggatgtaagttgttttaccaacaccattggggcaggagacagacagggattagtgaaggggtgggtttcattgcctccttctaaaagtagctttatctctcacctcagaccttctagttctggctctaccactaagttctaatagagctccccaaattaaactctaatagagaaatcctttcagattatggctccctaaagggatctaagtctggggtctctcatcatacattcatttaatcagcatttaatgagcttctactctgcgctagcactgctgatacagcaatggatacaacttataaaatcccaaaacacataaagcctagaggctaatgggggacacagagaaggcaatggtcaatttaaatacattacagggaaagtgaaaatgctctatgagcacaaaagagggacacctcactcatcaaagaggttctaggaagaaaccccaaacaccaccagtaacgatgaaaaggaattgacatagcagagttcttcaaacagaaagaacatgtgccaatgcccagaggtgagtttcaggagcagcagaactgaagcatagggtttatgggtgagtaataataattataagggacagcatttatccagcatgtactgtgtcagtgcagtattaagtgggtggtatgcattatctcatttgatcctcacttcatcccactgatgaggcaactggggcacagagaagttaaattctctgctcatagtcacaacactggttaagtgggaagccaggaattaatgcctagccaactgactcctaagcccacactataatggcccactctaaactaaaaaaaatacaccaaatggtgagatcagccatctacccttcactaatagaaacaccaactcatcctatgggtagaaatccaccaaggttctacaactccctgatctcagacactccgtccagccctcgagttctcttgccaaaaacagagaggagcaattaggtctcctccagttactgggtcccaggttagcatgccaggtttctagattaaggttctgcccttctaggcttcctggaaactacaatcttgtctctgagttcagtcttcttgcctagattcctcctatcagacatcagacaccatgttctgcctccttttttgaacttcgttatattttggccccatgggcatcctcaaattgtttttgggtctctgtgcttctgtctggtttctagggtctagtcatcttcagtttagcccgaatacaagagatttctgagtgagtatctttgtcacatagaggtggctgtgatgtttcctaggcatagtattgtgcccaactgttccagtttcaaaaccccccttttgatctcaatttctctgaagccatggtgcatcccagtcctccttccatgttagctcctagggttagtactcaaatcctgttactttgtttttcaaactattttggaaagaggtagaatataattttcctcctctttagattattcaaaaatatcttgccctcttctacaacaagaacaaattaattaaagtgatttttttctaagtaaatcaaaaatttcttgagaataaatctataatcatcatagagctaccagaataaatagctcaatgtgtagccaaattttaaaacaaaagtttacaccattatacagttttacatatttaaattaaaataatttgtatatacatacacattaattgtacattcatatttatatattagagtgtagtagtattttccaatccaaccgatttttaagctgtgtctaaaatatacctttctctcttttggtttcagttaatttctccaatgtcttagagtttaagagctcttctatttagcaggccatgaatatctcctagtgtaccattgcttttttttttttttttttttttttgagacagagtctcgctcagttgccaaggctggagcgcagtggcttgatctccgctcactgcaagctccgcctcctgggttcacgccattctcctgcctcagcctccggagtagctgggactacaggcgcccgtcaaccattgcttcttagagtatcctgcaaccttctagagagtctaggtcttcattccagaaggtttctttgtttatttgcctacacactcatgaacagtttaccatctataaacatgcttataaatggctactgaaagagtcattttaaaagaataaattaactgctgagtaaatgactcccacaattttctatatttttggatatattgctatcttttgttctaactgtgcttgaaatttttaaacgtagctatatgttctataaacactttatttattataaatacgttttgtacaagttatgaaggccaatttacaaaggtaaatgttacttaataattcatatatctgcccaccaaatcaactttttccattcctgaaagggttattatttgacagttctgaccagcaagtctttattccttttctgttgtaaattgcttgaacatgacttcaactcctaagtatcaatttcctgctggactccttgctatctaatatctcaaactactttctttaaggccaccagtgaccttccctgcaatttaaagtgcaattttctttgttctatattttgagactttctgcaccctttcatatgatgggacatcacattctcaattacattctttctagttttagtagcatcagttataccctggtacaagttttgtacaaacacactcacatacacagtttctatgatgagtctgtatctcttcatatccttcaactatctgtgtgttacaaatgaccattaggatacaatattttttattattctgtgcataactcaaaatgcacaatctgttctcttacttaaatacttatataattagttatagggttacacacatattagtgggaaggaggctgcagatatgggcatgcattttatttatgctctaagaaagtccactcaaattttatttctatgattaacattcagtagcatctcagtactttgttgttcccaggtgtaaatacactttttgcaatcttctgtttactcacaccatttattcacttgaccatatatatctagctgatttccttactccagacactggaggttcagtgctgattcagagtagactctggccattactttcataaagattacagtctcgtgggaagactggcattaacaatttaatcaaccaagaaagcctacaatggaaacttttgaaagtgttaaatactgtgttaagaacctgtaatagggatatctggcctcatcaggaaggtcaaggaggaattccttaaggctgtgcttctttaactgagaattgaataataaatttgaagtaaacatgtggaaaaggttcagaggaacctgctagccagacagaatggcataaactaaggctcagtggtggaactgaagaagaaattgtaagagagatgaaaagaaagtaaatgttgctggaacacacagaccatcatgctgggccttatgaagcatactagttttgttattatcctgtacgtaatggaaggccactgaagagttttaggtcacaagggaatggaaggaagattatggggaagaggggaaaggagtgtcatgttcagatttgtatttcctgcatagaggtttcagaggattttctaccctcagcaccatcttttccttcctgatctgaagttttaatagtctagatgtagttatcctccttattcaaaggctctttgattctgagtctcctttgtttgttcttcctcctcttcaccacttttaaatagaggaatttcctaaggcttcttgataaccaatacctacatgtcttatttgctctttagtggacatctcaagcatagcatgtctaaagtacacaaagaaagaacctagtttctcttccttccttccttccttccttccttccttccttccttccttccttccttccttctctcaggcagccagacattcattcagcaaacttctgcagagcactttgctaggccataggtattcagaaaagaattagggagaatctttgacctcaagagagtaaaataccctctatgatttgtgactacaaccctgtctgtggatttttttttgttctttcccccaaatatttacctttctatatctccacctccctaatgcccctcagtttatcctattttctaccctcagaaccatgttctctttctcatgccaaagttatcacttgcacgctcttatgcaagaatgctctgagagttaatattaaagatacaggcaagtgagaagcggttcccttccaagtagataggcaattgtcttgcctcttctgtcatgccttttctgtcctattgcctgttgtgctctgctatgacacacattttcttgatacaccaccaccaccatccttatgtaacttcgccacctatcagaatgcctataacattgtagatgggagcggtcatacataaagcctaattctctttggataccatctaaatatatcggaatctcaccatgatgaaataagtgaataaacttagaataaatttctgggagacagcctaagagacagctgtgaaactagctagtgttatgctctgttcccatgctgagcacctctttccatcttcccccattatttatttgtgttcactgtaaatcacatgccacttgagaaaattttacaccaagaaaagaatgacacaatgcttattgttttcttttaaaataattatttaatatataacttttatataatgttgttcagataatttaaaaaataagtgcaatgaactgagttattctataagaaggggagttcctttccctggattttcccactgaccccagcccaatagtaaagcattttgtcattcagcatcatacacttcctatccctagttcatgtttgctcaagttcataaatagtgaataaatactgacttcagaaactctttcccaaactctggtattcctctcaattatgtcatgtgtgacccacctttctattcttgagtaattaatcaccccatccaacattatccattatttaaaataacttaatagattgatatacctagtaaagttagcggaaattaatgaagtagaatgtgttgaccattcctgttcctttgatgtgtcagactgctttaaatggtgccaaataatcctgcttcttacctcttttaggaagcattcctcattttctcaaaaccacagtgatccatctcatcacagcccttctagagtatttaaaatttgaataacctaatttaaacatccagccaaggattaaagttatgcagttatgacagttgtccttactggttatttacaattagaatctgttctgataccttggtgcaaatttttagctctccctcactcctgcctttgcttatgataagcaacttgaccttaactgaacacactgtgctttctcttctcattttgactttgttcttaatgaggtccctctatctgaaatatcctttgcccacctgtacctgaaaaagtctctaattttccaaaactcagctaagtgacagcttatttttaaagattttccagatttttacacatagaataaatcactccttgtgggtgtcccctgagcactctgtgcatatctctaatgtaaaacttatcacaatggattgtaattatttatttccaactttgtgttggtcactagaccatgaacccctggagagcagtggtggtgctctgttcactgctggcatgccataagtgctcagtagttgagtggctgagctttaaataatttgtagaatgagtcagagcacttaaaagtgaagggaaaataccttagtggaatgaatagatttttagaaaatgttttacacattcattaatgccttgattctacaagattataaacagtggggaagaataacctaatttaaacattacattttttatccttttctatttgtatctctcttgaggtagtattaagtacatgttagatgcttcattaaaacaaaacaaacaagcaacctacacacacacacactgagagagagagagagagagagagagagagagagagagagagatttttaaaataaaaacatactttgcctctaatgactatgttaagaatacagaacgtcatgagtaaagaagaactgaaaaactttaactcaattctatcaccacttcatcaccaatatgagacaatggactgttgaaaagcagagactgttggtctctacatatatcagacaaataaaactttcataactccaggtttgaaactctcattgacttatgaaaaatcatagaataaaaagtagcaaagtaaaacagagtaaaagataaaaggtaaagctataagactttctattttattacgtacttagatttgtatgtatatgatatcccatattatatcattttagatttgagaaaagttcctaaaagttatttaattcattttttatcttacaatagttaaaattaaaacatcagaagttttatatgcagtaaatgattaacccgtgtttaccaacaaaatctacaatcagcatctagtttcaaaagtaattagtatgattggttcccaaaattgtgtttgtactataccagagttttcatgttagtgaatagcaatttttaatgaaactcctgaatgaattaaaagacacagacacataatactaagcaagtcagtaacaatgaaaacaatgaaaatactaaagagaggcaatagtaattgaacatttactatatgcaaggcactgttctccatgcttataagattagttcatgaaattttcacaacaaacttacgaggtaggtacttttatttcccgttttttttttttttttttattatgaaggcatgaagactgaaaagggtggaacaacaaattgtattccggtagtctggtcccagacttttaaaaatattaaaagtcaacatttaaaacccaaatgtaacataaaaatctattttagattaaaacatacctgagaacttagagacacacagaagcacaagaaatgcaaatgaatgtatcctttaacttatgtttcctatttcccataaagtttttggttttaattagacacacctggtcccagactacctgaatacaatttgcacgcacttattgcatattcttacatgcaacaagtgcacgcaaacaaaaaagaaagtgtctttaaaagcatctgctcttttcttgctctgctgagaaaaagtgttttctagcatgatcatagcctcttctgtacttcaaatggagaaaagttgctggaacttaactttacaccttgcctctcatcacagcaaattgtgtcattttcttccccatattattggtttcactcagctccatattttatctgactgactgcagcacaaatatgtatactcagttttaggcaaaatgcattttccacattgacccaaatgttaggagatacccttgagagttttatggtgtgccatggcacacaggtagagagccacttacttgtgaaaatttacctagacaacctttatgatatgctcagttccatgccactgagaccagtatcaaacactgaacaacaaattctctgcttttagcagaatttagcattaaaaagtactgttgtccatttatattttctcatcaaaaacactattaaaattaattcatggatataagttgttaaaaatagctaaacccaaggcccagtacctttagtgctattaaacatctactgcttaatagctctagattattttttcattttatgcagttcgaatgtgaacaagcttctctgtctctaactctgaaagaagtggaaaagtcttcataatttattaacccctgaaaagggcacattcgtttgtcatagcttcagaggcagagagagaaagcagataaaaaatcacattcgtactttcaattattgaattctaattttactgtcttattctgcatacttcaaatgggcattactaaagggactaagttcagggctattgttttattattatgcaataggaccacagtaaaatattttgagccaaatcaagtgtgttcagttaacttttgttgtacaatttatatgtatgtcactagacagattcttcagtggctaattaaatgatactatctaaaaacaatttatcttcaactgataggttctacgtatggattggttttctctgaggaggttgtattttaggctttttatttcttttaaatcactgagtatctgtaaataagttgaatagcgaataaatatcactttttagtgccattgtcctaggaactagcattagtagctaccaagacagtgaaaaaattggccttaaaaagtaaattgtctctagtttgcttgttcaaacacaaactactatcatttgggagatattaagtttttaattaaaataaaaaaattcttcattttttattattttacttatactataaagaaccttgtccaaagtcaaacaactgtaaactcggcatactattaccagcaaataattgattgtaaaatagacaataaaaataaagctagcttgcttgaacatacattataaatacaagataactttgtccaaaaatgattgatactgttttgatatctaccacaagctattttattcttataatatttcagtgaccacattcagaatcaagtatgagttataaaataattgatagacttttcacaaaacccaaatataatgtaaaaatctattttagattaaaacatacctgagaacttagagacacacagaaacacaagaaatgcaaatgaatgtatcctttaacttatgtttcctatttcccataaagtttttggttttaattagccacaccttaaaatacattctacttttatagtaaattaaagatgagagcttttcaggtagaaaaaaaataatatgtgcaacaacaagaatttttttacattgttcagttataaatgccaagtacctagaagagtgcctggcacgaagtagatactcaagagaagtgactgattagataaccggctgtattaagggagggagggagagagaaagagaaagaaagaaagaaagagaaattgattgatttggggcactgaaatttgtaaacctgtttctgagtcctagctcctccatttactgacttactgactgggtgatctttggcaacaagttacgaattattagtctctgtttccttagttgcataatatcaattactttatcacatatcaattgttaagaattaattgtatatatacacaaggttgataaaaagatcttttaaactttaaaatgcataaaaacattacatttatgtacctaaaatatacacctaaatatccagacattcacacaataagtccaagctgtccaaaatgacatcatagttactatattttttggcttaagtaaaaagttggcctggaatgcccagaatttcccactgtcaagacaagcatagaattcatgatcattcaagtgcttgaactgagaaactaaaaaaccaagcagtattgtgcattcaatcattacatgaaactaataaaggggcttacaataaactaaattctaggaaagtgttaaaatatacaaaagagtattattttgcaataggtaaaaacataatttgaggagtcattttcaaaagaaaaaatatatcacccccagcatatggagtatgcagagaacttcagaagagttaataagtatcttttcatggctatttttttccatctcttcttaatactggttacataagtcagacaaagaacatatgtatttaaaaggaggcagagaatagggcagtacaagtaacatcacacatcatttatttatgtcaccctgtactgggaagccttcctagggactttgtggcataggaaattgctatgatatcattgatgtcctctcttaaattaaaaataataataaaaaactttttgtgaaatgaatgaagtccattagctaggtagctcatatctcgtgtacttgcgttgtataaagttgtccaaaggaaaagaaggagataagcaatttaacactgcagtcaccatcaatgtagtgcatttgtgactagcaaggctaatactgaaagaaggaatcatacacagaaaaaaatgcaatttaaatgtctagatcattcattagctgaataagattttcttcattgttgacagaatgatataaatagatttttaaagaattaattattaggagacaaatgcttttcccttagttaagtttaatcacctgtgaaaatgacacagtcagtaccactgggtttttcaacttcactatagagtacttagggaaagaaaaaaaattcatttcaaagcagtgactcatgctttcaagctcatattatccaaaacttttagatttcactttaaattttgaaattcacagaatataccaacttaaatttttctcagcaaaaaattgactctagatgtatattggaagctttttgaggttttgttgattacgtattgttgtggctgagacattaagctcacttgtttagatttaattaatacacgtctgacactgtctataaacttagttttgttcagacctgaatggactaaaggagacaattcgaacaacagtaatgtctagagctgccaaacaggactgggctagcagaagacacagagtgtgacatagctgaaaaacccctgctgtcttaaagctcaactcgagaatctccaaatcctgagttttaattatcaaaattactagtttgcaaaggcagaaatattctatgttaaaggcacagtaaaaataaatctaaaaagcataagcacatcaacacttgatgaacaagccattattcaaaagttttataaccctaggaggaatggagatgctattaaaataaaagagcacgttaaacaaaataacaattaattacacttttctgtggctttatttcataaataactgcatccaactttaaaataacaacagtatgctactttataccataataatagacaacatttgaggggatacaaatgtttttgaattcttcatttgttatcatgtgaacattctcagtcaattgaaagcttttagtgtagtgacttttcaggttctctgtcacattcaatcacctatccatagcagttcaacagctctaaatatatttgttttgctacaatataacaagatcctcaggcataaatgttactactgacaaatgattaaataatataaagatatatttttaggatttaaatattttctggctatgtaaagacagtattttattatgcaccaaaaagcataacaaaaatgcaataaatgattttaatatctcttaattccacaaagaaacccttacatccattcttaaaatttttcattattattatttccaaatatttaaatggtaaatatgaatgtaaagtcctacaactttatttcagaagccagagcctttgctcacttggtaaactttgttttccctgtataaatgcaactttggaaaactgtcccaaagaactgccatttaacaattagaaactttgactcattttaagtctacagcaacactacttggttgaccatttctaccactattctttaatactaatagaaaaatatagagaaatgatgcagaatgatatacatacacatatacagttttaaaaacacattcaaaattgtggtcttataatagcagtattttcctttttctaaagcgaagccggatttacctgcctttcattttctgctgcaaattagtttgtcaggtacacgttagcaagctctttttttaattcattttgctaactccatagtcctttaaataatgataaacattcctgaataaaagcttaccagatagtaatcctttttgacccttataatattttctctgtaagacacatctacctttattttaaaagagaaggtaaaacagaagaagcccttaccagagacagagaaaacaattcgttcagctagatccaacagtgctctgtgcagcctggaagcatgagtgatccttgggcctcacacaaaagcgagataattggctctcaatgaagagatgtaaacatccatcataatggcactgtgctgaaactgaacgctacctcagctgttctatgtactctgactggaagatgatgtcacaaacatcaactgggtgtactctcattggcttctgttacctggaatcatatcttaaccctaaactgtcagctacaaattgaaatgcacatttctgactataatttctgcctttaaaaggagagtgaaagtaatgttgagctcctgggggatcacaaactgaaaatactgccctctaattatgctaagactgatttacctaattaattaatcagaattagtgaaaattttattttccaaatgtgttttgttaagtagcagtgtttataaaaggtatttgacagaatggatattaaaggacaagatgtatgtaatcataacatctggaattttaaattttgtaattactttgcattgattttacagtactagcccctgagatttaagaaactcaaattgagaaaaattataatgtagtcaattgtacagtgaagtttttaatcaattttttcagagcagccatttgtttttaaatcttctaataaaaccacaaaaatggaaatgcattttattctctgagtgttaaacactgtttgcaaagtttcatgtaataaaccttaaagtttattacatgatattacatgaaagagatattaaaagcacatcactaatacaataatgttaaatattggtttttacaaagagtaatttataagccactggaacttcagacaatcccatttcagtaattgaaagctactctatgatatagtgctgttctttttgagcacacacagggaataattatccatctcttaccttctatcttgacaaaagccccagatttctccccaggcttaaatccagtgggagaggaggataatgggctaagctggttgcagcagcttgctgccagagggacaaaactacaatcaccttgaaatatacccaagctttccctactgaaaggagctgtcaaccgcataactgtgagatgcaagaattaccagagctattcaatgaccagttccttctaaatctagcccagccatatcccagggcaagccctttgaaagctgtgcagctcagcatgcgaacagtacaagcacctggagaaagagcaaggaaattcacttcaaccaccccaactttagggaaaggaaagtcaccaacagtgcacttgcatgactttatgctgtttcatttatttctgaataatggattcagggcaaatacttgttacattccctctgcatttacagtgacagaaaattatttttactcaatggcctcaataagagttcaaaaagttgataatatatgaaaatacactttcatatgttcacatttcctcccaagttctgacttttatgatagtcagtttatttgattactctgagaagcgagttagcatgtgacatgggagcaagagttctagactagggttgaaatgattcatcctccagttcttgctccaccacttactatctgtaaaaactctggtaacttagcatcttttatgtatagactgagagtggtaatgctacatacagcaaaataataataataaagatatggggatcagatgagacaatgcatagaagcttgttatataaaataaaaagtattacataaatataagataattaatattatcgttgttatgaaaacaatcaaatgcgttaattttaaagacacatggaagatttaaaatttagagttactttggtgccctcaaaataatgatataaatatgttaaacccttaatatttcaactcaaaaataatgttgcaaattaacttgatttataacactgactcactcaattttttttttgtttgtttgttttggagttttaaccctcccagaataatttcagcatgttttctacatgcaacaggatataatctatctatctatctatctatctatctatctatctatctatctatctatctacattcagttaatttttaaagacaaatgtattttctggtgattttagtgcacagaaatcataacctctcttatttgttttgcatttgtttgggtgacagaatgccacatataatgtgcctagagaaatacagcaatataaagattgggaaacttaaatactcctagggctctgcaggcatttttgtttgtttgttcatttatttatttgtcaatttccacaggtatcaacgtataggcattttgtatcaataacccacatcctacacaaaatttgtttacaagtgaataaggtacctagtaaagaaagctggtttttgttattaaaatatgtcagtgagattttttaagaatatagatttcaatgcttaaatattatacaagatggagtctctaatgaattacttagtattttaaggacatacacttattacatatgaaaataatttcatatttaaaatttgaattgtttaaaaattaacaaaattattggcttatactttaattcctaggaaaattgataggaaaaaagataatgtactagaaatacttcatactaacgttggactagaataatgagtgaatctttatcacatacattaagtcaacttcaaattttgtatttatttattaggacagaatttatattttagttttaaataattacatttatacactcaggaacattcagataaatacaggatataatagttcatatatgaatatcagttttattactccaaagtatattttatacataaggacagaagaaaatatatatacatatattctcttacagtggggagaaatcattagaaagtaataattagtagaatttataaaatttttttgtgattttttagtggtgtttcttttggaaaagtagagatactaaacttcaagacctttcagtaatttattttcagaatgtcctttggaaaaaagtctgatgatacttggacatcagtctgcacatgtatctgggttaaggtcaaaaataagatagtgtgtatgtgatgtgaacattgataataagacacgtaactgttttctactatactaaaataatattattaagaaatacaacctgattacaaaatgtaaaaaaaattctaaatgtaaaaatgttaaaactttaagaaactacaagaaaaataaaaggatggtgtcatttcttgaatattctatttaatatacacatgtggaaaagtaaaatgctgcatatagctctaatttcataaaggaataataacaaacactgcatttgagaatgaatttaccaacgttgtctcattatttattacattcctccaactaaaatggccagctagcatttgtgagttcagagaatataaaatattttaactttaatagtgtgtaaaagtttaatatgagggggcaaaacactctatagacatcaatttaagcttcattctcagtaaatgtatattagtaaatatctataataagatcatttcaatagttttcataactcagcaccctgactagtaacataatagccccatgtcataaagcatacaacactagatatgaaaagtcttattttgttttttcctttttttgaacaacattgttacaattgtaacacctgtaattcaagaaaaaaatttgttgaatgtggtgagaggaagctaaccaattttaatgtaggcattttactattcattagcattattttactacatagacacataattaacagataaataggctttattgcattagggtatattaaaattaaatctgctcaaaaaatggaaggacaagttggagtatcaaataaaaatttatatcaaatacttattaatatgtttgcagagaattaggtggtaagagaattaaaaacacagagacaaaagagaaacatgcccttgtaaaaacgcttgttgtccacagctggctcccacccaccttttattgtttcaaccccttgctcccactgaaagtaagcacatctgtcccttaaagtactgtcttaattctaaactcgtttctcaatgtaccctgtttaatagctatgtggttacttagggccttttaaaattagaatatgatgcaggcacagccataccctgataggcagaaatagccagaagcctactaccttttatttttaaatttatcaaagttaacattgaataatttacaatgtgccaatttcctaatagaaagaaacctccaaatcaaattattttcatagtaaggtgtgtttccataggaaatgaagcagagttagttattatctgcacttactttctctagaatagctccactattagaattggatcagagcatagagtgtaagtcagagattcttctgttcaattattgactgtatattttatgcaccatgacaaggagcaagttatttaccttccctgaacaatgttgtctaacttgtgatctttctcaaaggcttcttaaagttattaaaaagagaaatatattatataaattatttagatcattatttagtacttgctaattggtaattgctcaagggacaaatttttcccatatcccattatatttttatataataaaaatatctttgaaacagaaacaaagctatataccttttttttccattgaagagaaaggtttgttcattaaacagcatatatagctactcaaatgaaggttttgttcattaaacatcatatatagctactcataagtattaaacagaaccatgaggaacaatggagcacatgataaagtaaaactgtgtctgagagaagcagcatcttaaaacatttgtgtggcagttataaatacttgtctagcactaccttgtacagagtagtagctcattaaacatgtattgaattgatttgacattttaagaattggtgaacctctgcagcagaacatatttaaaaacccaaattgcatcaacttcacttctattcattcaatagacaaaaattgaagaccttatataatgccagacattgaattaattgctatgatgcaaacatgaatatgactcatacttcagtttcaaggaaaccttagtcaagggagagcttgaaaccttaaataaaatataccagaccaattttcttactggtcagttaacataaacgaaagtttacctagaaggctgaaatgtcaaatatttctgttcctcatttgaattagtaaaaaaacatcagcaagctattagaagcaatttcctgagaaaagtaacttttaagatatataataatgtcatgactgattcagaccaatattttgcaacccgtgtatctatcgtactctattgattttcaatatgcacaaccaagaccaagaggcatatcaaggcactcaagtaccttctgaatcatcttgaattgattaggtgtaatggagttcatgattaattgagagcataccagaagtgtgttgtaccttggggtttcactctgccttgtaaggaagtaagaattacagtgaagggaagtaagaatcacattacagaatgtaaatgaaggaaactcttaacatccctcccccaccacattcatgccttgtttaaaatccttcagaagttcttgttcttataaggagaaaggcaacccctttaacccatttatgcctcaggttgcaattttttgaatttttgcaatcagatcttggctatgacattgagcagtaggatataaataactcccacatgcttagcgttccaatattagaacactaggcataaatttaatatagtttacaatgtcctgtatgatctgaccacaatctctctagccttaccttccactagccttctcatctcactgttgtgtttctctcttctccatcgcaaatgacaagtttcagtcccatttcttccataatttattttgttacagagcatgttcatatatccagacagttgtttctacctggaatgctttctacccattcttcctttcatattactccttattctcacatgtcaagccatttgaatctatcagtcactcatagtcatattgtatctttcagccacaggctctttgcatatgctttctattctaaatacttttctatgcatgccatctttctttttatctaggtgtctctactcattccagatcagctatcccttttcaaagaagtcattcttgcctagcttattaaatcaaatctctttaagtgaccttatatcctgatagctctcttttgttgcatttatcattgcaatagatttacttctgtgacttttaagatgtttgtatcttccactaggttcttgaaagcagacattctgtctgcttttgcttactctcttaggcatatgattcatttttagagtacattcatatatagatattctagtatactacacaaaatatgcatattaaaaactttggcatgaaattggaatttatttttaattttctaattttaaacatcacttgtatttgataaaccttttaaaggtaatttctgcctgcagtcagaattagagaaaagataagccattttaatatgttttctagcacttactaaaatattttacttattatttgtacttccaaaatttttgaccgactggatttccatatggaatatttttcaactttattcctagatatagtaatgttgactgtaaaaactttgtcatttgtttaaaaggttttattttatatattttctattaaaagagtgatttttaccctactatataaaggtgaaagctttcttttccaaatgtaacttacatttctttttcaaatgtaatttcaaatgtaattatggggttgtaaccccataaattggtagatgaaaccaaagatcagtgatatgggtctagattggaagagccaaacaaatattctaaatttttatttgtgtaaatttacgggatacaagtgcagttttgttacatgcatccatcacaaagaggtcaattcaaggcttttagggtatctatcacccaaatactttacattatacccattcagtaatttctcttcacccactctatctcatcctgtcacccttctgagtcactattatctatcattatactctctatgtccatgtttctacatttgtatgtccacttatgactgagaatacacaatatttgtctttctgtgtctgacatatttcatttcagataatgtcctccaattttgtccatgttgctgcaaatgtcataatttcatatttttttggctgaatagtactccattgtgtatatatgccaaattttctttattcaatcatctattgatgacacttaagttgattcaatgtctttgctactataaatagtgctgcgatgagcctatcagtgcagatatctttttgattcattgatcttttttcttttggggagatacccagtagtgtgactgctgtatgaaattgtagttatacttttagttcttcaagaaatctccatactgttgtccataaagcttgtactaatttacattcccaccaacagtatatgagagttcccttttctctaaattctcactaaaatctggtattttttgtctttctaatagccattttgacaggcatattatatctcattgtgcttttaatttgcatttttcagatgcttagtgatgttgagcattttttcatatacctattggtcatttgtatgtcttcttttgagaagtgtctattaatgtattttgcccactttttaattggattacttgttttggggtggggggttgttgttggtgggttatttgagttctttctacatcctggatattagtcccctgccaaatgcatagtctgcaaatattttctcccgttcaacaggttgtcagctctctctgttgattgtttcttttgctgtgcagaagctttttagtttaagttcagtttgtctatttttgttgcgtgtacttttgaggtcttagtcataaattatttgcctagaccaatatccaaatgagtttttcctaggtttccttctagtatttttatagcttcaagtcttatgtttatgtctttgatatatttttaatttatttttgtatatggtgagagataggggataggagccgtgtttgtttgtttttgttgtttgagggccccgttttgattgcaggagaggcccgtctggagctgccactgcgaagacgcgggctgcagcgggggaggcggggagggggctgcgcactccacagagccaagggaagcaaggaacaggtggaagtcccgcccccttccgagttagctgggcaggagcctcctgcttcccaggtgaagctgcagccacccagctgtgtgtgcggacccgggcatttctgtgctcttgggggccagggacaggcagggtccccgcctcctggggtgcagctacagccgcccaagccatggctacggacccaagcatctctgcactctccgggcccgggaagcagccccttgccccagcaggctcagaagtgcctgctctcactgcctggcctctcccggcgccctctccgatctcagagcaaagttgaggccaagcccaggtgctgtcacaaacccagtcggctgtgcccactcttggggcagtgctgacacatcaggcccctgccgcctcagccctctctggattttgggcactgacgagcatgggctgtgacaccctctttggggctctgcggttcctggcatctccaatcttctgggcgctactgcgttccctggtgccagccatggaagctgcttgcagtaagcctggtctagccgcagcctcacagggagccggcacccgtgcgggcacctggagctgccccaccccccgacccccagccggcatgcctggctgtgcgcagtggccagaccccacctcgctccctcatacatccctcactgctccacgcctggctcacccatgtcaggtgtgacatccaggccagtagcgcgagccaagcgcagcctgccaggccaaaacaggcagaacgagcccagcaggcccgagcaaaactcaggcaaaagcgtcaccagccacagaggttcccagctggcgaaacaacaccccaaggatcctgtgacagtttcatttttcttcatgtggccattcaatcttcccaccactgtttattgaaaagggtgtcctttccccaatgtgtattcttgtttactttgtcaaataccagttggctataagtatgtgactttatttccgggttctctattctgttccattgatttacgtgcctgttttttataccagtaccacgttgttctaagccttgtaataaaatttgaagtcaggcgatgtgatacctccaggttttttccttttgctttggatcactttggccattcagggtctttttggtttcatatacattttaggtttgctttatctaattctgtgaaaaatgacattggtattttgatatagatttcaatgaatccgcagattcaatgaaagtatggtcattttaatgatatttgtgtttccagtccatgagcttgggatattttttatttgtgtcatctacaatttctttcatcagtgtttcaccaaagatcttttacttccttggttaaatatattcttaggtatttatatttatttttgtagctattgtaaatgagattaccttcttgatttggttctcagctaaattgttgctggtccatagaaacactactgatttttgtatgcttttttgtatccttcaagtttactgaattcatttatcaaatttaagagctttttctagaatttttaggtttttccacctgtaagattatatcttaaataagcaaagataacttgacttgctcttttcgagtttgtataccttttatttctttctcttgccttgttgctctggctaggacttctagtactatgttgaataggtgtggtgcaagcgggcattcttgtcttgctccagttcttaggggaagtgctttcaacttttcctaattcagtatgatattggctatgggtttgtcatatatgacatttattattttgaggcatgttccttcaatgcctagttaaatgagggttttatcatgaaaatatgttgaattttatcaagtgctttatttgcatctattgagatgatcatagggtttttgtccttcattctgtttatatactgtatcatatttactggtcagcatatgtttaatcatctttgcatccctggtgtaaaaccgaatttattgtggtgtattatctttttgatatgctgttgtatttggtttgctagtattttgctgaaaattttgtgtctatgattataagggatattgttctggagttttgttgttgtgattgtgtccttgtctggttttggtatcaaggtgataatggcctcctagaatgagttagaaaaaattccctcttcctcaattttttgaacagtttcagaaggattgctattagttcttcatacctttggtagaatttggctgtaaatccatctggcactgggattttctttgttgaaagatttttttttttattactgactcaatcttgctgctgtttattggcctgctcaggtttttaaattttttcttggttcaatcttaggaagatgcatgtttccaggaatttatctatttcctttagcctttttagtttgtgagtatatagttattcataatattctctaatgatcttttatatttcatatctcctttttcacttttgattctacttttattgtctcctgtctcttattggttagtttatcagttttgtttgtctactcaaataatctagttttgttttatcttttgtaatttttttttggtcttttttcatttagatcggctctgactttgttatttcttttcttctgcagttttggtttgtttttgcttttctagtcccttcaagtgtattattagattgttaatttgtaatctttctacttttttaatgcagatattgaagctataaagttctctcttagcactgctttgctgtatctcacagattttggtaggctgcatttccatgctgagggaattcatcaccactagacgggacctacaagcaacactcaaaggtatcttaaacttggaagtgaaaggtagatgttcaccatcatgaagacacctgaaattatacagatcactagtaaagcaattacacaaaggaagaggagaaaggaatcaagtggcaccacttcaaaattctaccaagacgcaaaaacagacagaaagaaacaaagaatttataaattttaaataaaattttagatttattaaatctgtatagttcagagctgtctttttaattcacagctgttctttcaaatatttttatatgcactagactgtagtaattcaataaaggggggaataaataaaccataaagagaatggaacgttataaaaatatctgaagtcagtacaagctagtaagtaggcctagactggaacaccattgaataaatgcagagcaaagatgaacatatttttaaagtaaaaatttagacttctcttgatttgggaagaagtattgttaagatcttagaaccagattttcacttataatatggaattcatagaattatgtagacgtatcaattgcaaacaagcaatgcaattcctgagtaactctaatttaatttttcttaccaaaatatgactaacatagtggcagtaggacagaaataggttttggtggcattagaatatattgaaactcatagcgacatccccagattcctggggtgaagttagatttgaagtatcaagggatctcattagagaagatgcttagaaagatagctgtgtatgtcaaccttgaattataaattcttttaagccataaggagaatgctttcatcagtcttacagacttatggagttgtacagctactgatggccttagaaattattgatctcaccatctcattcagcctacaaattttacagatgtgaaaaatgaaatttttagtcaactagcccaaagtcttttagctaaagacatccttaattgaaagccagactttggactctggctgtcaggtctccatctctttgttacacacttcattgtattaatatattcaactggcccatcacaaaagagttacttactatgtcaaaattttgctcatatagatttaaaaacattgaaaaatacatgatatataaaggatttttttttcttcatcttcttcacttcagtgaatgtatattgaaacctttattttttcccttttaaacctactatctaccatacttttacggactcatagatttttgaagggtccattaaaaacattagtaaagagaagatacaaccttaataaaatattttgttgtagttatttaattggcttactgctcaaacaaacaaaaggatattaactacatatatatatatatacatatatacatatatatacacatatatatatatacacatacacacacacatacatacacatgtattttttggctctgccaacaataaattcatttttattgtttatttcagtttttaccaagaaatattattattctgaaagaaagtaaagtggcacatttttttcttcttagtaattatgcatatacatttaaaataaaaaagaaagggtgttttttttttgcctgaaaaacaagtagaggagatattacagtacccctttcgaacaccatcaacccaccctcacacacatacacatctcatttgccttttgtatatattctttcatacttacatatatatatatatatatatatatatatatatatatatatatatatattcttttcttttaattctcacactatgtggagttttcactaacctcatgacattttatttaattgttgtgagctcctcataggccttcagcagatatttatgagttcttcaaaaaattgtagagcacaaagttgttataattatatctatttggaaataacctgcttaagtgttttatatcattatgtcacttagaatatctttagataggtcttacctcatctacatatttgtctttattataatactgagatatgggctcatttctacttatttccaagaaatatttaagtaaagtttatttttttttcttttggtcatttatataagtgtagtcctgatccttaattctattaacatttcttgacagtagtcaagaaaattccaatttaactacagtcataaaatgtgattgttagtatattccagtcctgtggcacttaggacaaagacagttttacagtgttaactgaattataaactctccaattcaggtttttttgtttttttttttcctggttgccaggtgtagaagagatctccagtatttttcactttctcctcatttttcttcttagagaaactgcctcaaaaatggcaatatcttctttgtgcttaatgaccctaacttcatgaagacttggcatataggtgagcacttgaatattgaaatgaagatattatgagatttagactatattaatggaggaaagaatgcataaaaagtcaatatagttattttgttgatatttttgatggtaccctggttcccaatctccttgaaaatgttacttgattcttcttgtgtatccatatgaattgtagttttttattgtgataaaatatatataacataaagtttattattttaaaccattttggttgtacaggtcagtatcataaagtatattcacgctgttgtacaagcatcaccatcatccttctctagcacttttcacctcccgtagtggatctctgtttttgttttgttttgttatgttttgttttgttttgtttttcttttgagacagagtctcactctgtcctccaggctggagtgcagtggcatgatcgcggctcactgcaacatctgccccctgggttcaagagattctccggcctcagcctcccaagtagctgggattacaggtgcacaccgccatgcccagctaatttttggcacttttttaggagagacagggtttcatctctactaaaaaatgttggccaggctggtctcgaactcctgacctcaggtgatccgcccgcctcggcctcccaaagtgctgggattacaggtgtgagccactgagcccagcccatagtggaactctgtaccattaaaaaagaactccccatacctttctccttccagcccctagcaaccacaattctattttctgtctctatgaatttgactactctaggaatttcatataattaaaatcatacaatgtttgttcttttttgtctggcttattttacttaccatatttttttcaggtttcatccatgttgcagcatgtgttagaatttcacttacttctagattcaatgcaatccccatcaaaatatcaacatcattcttcacaaaattagcaaaaacaatttaaaaatttatatgtaaccgaaaaagaaaagtgcaaatagtgcaagcaatcctgagctgaaaggacaaagctgaaggcatcacatcacactacctgacttcaaaatacattacaaggctatagtaaacgacatggtattggtaaaaatacacacatggaacaatgaaacaatttaaaaagcagaaaatgtcatgtatttataactaactaatcttcgacaaagatgacaagagcttacattgaggaaagagaaccctcttcaataaatggtgctggaaaaattggagagccaaatgcagacaaataaaactggaattctatcttccacacatgcaacaattaacttacaacaaattaaagatttaaatataagacaagaaaatacaaaaaatactaaaagaaaatctaggaaaaagtattttggacatttgtctaggcaaaacatttatgaagacctcaaaagcacaagcaacaaaaacaaaaacagacaagtggggctatattaaactaaacagcttctgcacagcagaggaaacaacacagtgaggagaaaacctgttgaatgagagaaaatatttgcaaactatccacccaacaggggcctaatgtcaagaatataaaaggaactcaaacaactgaacaggaaaagaccaactaattacaaataatcccatacaacagcgggcaaaggacatgaatagatatttttcagaagaaaacacaaatggccacaggtgtataaaaaatgatcagtcaatatcactaatcattactgattaagttaaaagcacaataagctaccatcttatacctgtcaaaatgattattattaaaaagacaacagatgttgatgaagatgtggaaaaaagggaacacttacatattgttggtgggggtgcaaactattaaaacagtatagagattttccaaaaaactgaaaatagtattaccatttgatccagtaatctcattacttgggtatcggtctgaacaaaaaagaatgaatatgtccaagggaaacctgcacttgcatgtttattgcagcactatccacaatagcaaatatgtggaaccaattagttttcatcaatagatgatggagtagagaatatttggtatatatacagcatggactattattcagtcattagaaaagaatggaatcctgtcatttgcagcaacaaggatagaactgggaggtcattatcttaagtgaaatgaatccggcacaaattggcaaatatcacatgttctcacttatatgtgagattaaaaatatttgatcacatagagatagacaatgaaactacagaaactgggaaaggtgagtcagggaagggaagaggatgaagagaactggttaaagggtataaacatacagcaagatagaaggaataaattcaatatttatagtagagtagggtaaatatacttaacaaaaatatactggggctcatgttatgaatatcctaaatacactgacttgattgctatgcattatatacctgtaacacaatttcccacatatcccataaatttgtgtaaataaaaaaattatttattcgtaagactgaataatacttcattgtctatataggccacatattgtctatttatccttagatggacatttggattgtttccatgttttggctagtgtgaatggtgctgttatgaatgttggtacacagacatgtatttgagcctatgcgttcaattctttggctatattactagaagtagaattgttatttttttaaagaaaccatgatacaatattgttaagatttgtattattttaaacagatgttccttcacctaggatacctaagagagattttttttttctaaacaatcctcaactaaaaactaatgcaataatgatatctaaaataaatctcttccaggtgcagctcatgcctataattccagtactttgggaggctgaggtgggcagattgcttgagctcaggagttggaaaccagcctgggtaacatggtgaatccccaactctacaaacaaatacaaaaattagccaggtgtggtggcatgtacctgtgatcccagctactcaggaggctgcactgggagggtcacattgagcctgggaggtcgaagctacagtaagcagtgatcatgccaacacactccagcctgggtgacaaagtgagaccctgtctcaaataaataaataaataaattaaattaattaaatatttgcattcattgtacagatggcggacaaaggacctgatgttaggtttgcctgacaatgaccctctacatcataaacagcaacatagctcttttttaatattaatgaagtgtccattaattatttcctgttttcttagaacagaaaaaaaataggagactttttggagtcctttaaactggagatattagtggtgtagatagcatgttagcaagcaggattggagaaatatttgaaaaacaagagttgacaagatcaatttcctggatgtagcatggatgttgattaaagaaacaaatttttgaggttaaattactggattacaattctgacttcattatttaccagctgtgtgatcttgggcaagttacttgattttcctgtatcttagacttctcatttatagattagtaacaatatttatttctttggtactttataacaattaaataaattgaaagacaaggctcttagactaatggaacataagaaaaatatagacatatttgttaaatatatttagaggagaaatatataaatattgtttcccaagtttatggcaaaatgattgaatgttactatttattatgataaaaaccaatacaaacaaatatatacaggaagcatgtttaattttaaatctgcatgcaacatacataatctttaattttaagtgaaaattggactgtccaactatgaaactgagagataagagatgagacctggagtcacaatgtggaaattcatcagtgtacagattatataccataacatagggtcattatataaataaaatgagggtcttgtagtgagaccccagtaatctacaaaacttaagagatttgccagtgtatacactgcatacgataacagagtgaatatataagtgataagagggcctagtgatgaaaccccaataattcaacgtatcatgaaaccacaaatagttttaatccaacagaaactttatgcagctctgaagctcaaaaactttaatggtacttgcaccttgtattagaccgttctggcattgctataaaaaaataccatgtaatttataaagaaaagaggcttaactggttgacagttccacaggtggtacaaagagcgtaatgctggcatctgctcagctcctggggatgcctcaggaaaattacaatcatggcagataatttgtaagctcccctaagagggagcacttgtcttacacagcaggagaaggagcaacaaagagagtgagggaagaggtgctacacacttttaaacaaccagatctcatgacaagtcactcattatcaggagaacagcaccaaccggatggtgctaaactattaatgagaatcacctccaagatccaattacttcctaccaggttccacttccaacattcaagattaaaatttgacatgagatttgggtggggacatatatccaatcgatatcacactcaaagacactctagtctttaaaaagtggatatcatctaaataattatttaactatatatatagtatagtatatagttatatatgtttcccattgataaaactgccattgtgctagagattatattttttaatatgaatacaagtcaacataatgtaaagcaatagaggcaatcttcatcaatttatagaacaaacccttgaaagtaaatttggctaccgagtttttgcaccagataataatgttaaaaaatggctgctagacaataaccaagaactcctgggcagatttacagatggaatgttccataattaagttttcatgggctatatgaaaagcaaaagtagtatttaatagaagaatatttagccatcctctgtccacattatatacccagattggctggagtcattctattacattaaggtgaaacataatactggggtcagttgtttgcctccagacttgccagggcagaatacagaagcaggcttgaaagtcaatttttgcctaagagttaacaccattctgtgaaaggaagagtgtgagaaaagtggacattgacagaataacaaaagctcttcttgcagaaaagcttcatgtcatcagactgcaaagattggctgaagggtagtcgaacatacggtaaggggcccacagacattttagcattgccactcgggttttgggaaactgaagttgtttcaaaaagtagataaggttgttcaaggaaaacaaagctaacctacagtcaacagttcattcatcttgatttaattgacacaatatataccattcagaacaagtatgaaatgtcacttgaaaattaaacgacaactaatatgaaatttcacaaattatcagctggataatactatcacaaaccaatctgataatattaaagagagtagataacataatggttaagagtaagagcactggagtcattcagataaaggttccatttctgtctctcaacttaatcaccttgtgatctcatgcagtctcattatccttctaaacttgtgtcctctgttgaatagagccgtatcataaggattttatgaaggtaaatgaaataatgaatgttaagcaatcagtacaatgcccagctgttgtagttggataatgacccccgaagatgtccatgtcttaatccccggaacctgggaatatgttaccttacttggcaaaaggaaagttgcaaatatgattaagtcaaagctcttgagatggagagattatacaaattgatccaatgtagtgacaaacgtgttgataagagggataaaggaaagccagagtcagagaaggagatttgaggattaaagcggagagtggagtgatgcaaggccatttgccaaataattcaggcagcctcaagaagctgagaaagacaagcattctcccctagaatctctagaaggaacatagcagtgctgacctgttttagatttctaacctccaaaactgtaagaaaataaattggctgggcgcggtggctcacgcctgtaatcccagcactttgggaggccgaggcggcggatcacgacgtcaggagatcgagaccattttggctaacacggtgaaaccccgtctctactaaaaatccaaaaaaaaaaaaaaaaaaaaaaaaaaaaattagccgggcgtggtgttggccgcttgtagtcccagctacaggctgaggctggagaatggcgtgatcccgggaggcggagcttgcagtgagccgagattgcgccgctgcactccagcctgggcgacagagcaagactccgtcaaaaaaaaaaaagaaaacaaaataaatttgtgtagttttaaaccattaagtttgtagtgatttttttacaagtataggaaattaatatactaacataattacttaaatttagctattattattgaaaaatatgtactttacaagatgagaaatctatttttcaatttttaattttgtaggtatatggtgtctatatttaacgaggtacatgagatattttgatgtaggcatacaatgtgtaataatcaccgcaaggtaaatgggatatccatcacctcaagtaatttaccctttatgttacaaacaatccaattatactctttcatattttaaaatatacaattagatggttattgactatggtctccctgttgtggtatcaaatagtagaaggtattcattttttctgtttatttttttattttttgtactcattaaccatactcaatcccccacttcaacacctgcactgcctttctcaacttctggaaaccatccttctactttctatctccattagttcaatcattttaatttttacctcctacaaatgagtgagaacatgtaaagtttgtctttctgtttctggcttatttcacttaacataatgacctccagttccatccatgccgttgcaaatgacagaatctcattctttcatatggctaaatgctactccattgtgtatacatactacatgttctttatccatttgtctgttgatggacacttagcttccctccaaatcttggctattataaatagtgctgcaataaatatgggagtgtacatctcttaaatatactgatttcctttcttttgggtgcatacccagcagtagcattgctggatcatatggtagctctatttttagttttttgaagaacctccgaactgttctccctagtggttgtactaatttacattcctatcaacagcgtatgagagttccctttctctatatcctctttagcatttctggttgcctgtgttttggataaaagccgttttaactggagcaagatgatatctcattgtagttttcatttgcctttctcaatgttgagcacatttttatatacctgtttgctatttgtatgtctcctcttgagaaatgtttattcagatcttttgcccatttttgattattatttttcttatatattctggttattaatccattgtcagatgaatactttgcaaatattttctcccattcattgggctgtctcctcactttgctgattattttgtttactgtgcaaaaagctgtttaacttgacgtgatccccatttgcccatttttgttttgattgcctgtgcttgtggggcattactcaagaaatctttgcccagtccactgtcctggagactttttccattgtttcctttttagccttttcatagtttgaggttttagatttaagtctttaatcaattttgatttcaattttgtgtatgacagaatagagtggggtagtttcattcttctgcatatggatatccagtttccccaacaccatttatttaagagactgtcctttacccaattgtgttcttggcacctttgttgaaaatgagttcactgtagattcatggatttctttctgggttctctgttctgttccattggtctatgtgtctttttttatgttaggaccatgctgttttggttactatagttatttagtataatttgaagtcaggtaatatgattcctccaattttgattttgttgtgtaggatagctttggctgttctggggttttttggggttccatgtaaattttaggattatttatctatttcatttaagcatgtcattggcattttaatagagattgcattaaatctacagattgctttgagtagtatggacattttaacaatattcttacaatccagggaacatgaaatatatttccacttttggtgtcctcttcaatttattttatcaatataatacagtttttattgcagagatttttttcacttctttggttaattcctagatatttaattttatctgtagctattgaaatgggattagtttgttgacttccttttttttttttttttttaagatggagttttgatcttgttgcccaggctgcagttcatgacatggtcttggctcactgtaacctccgcctcctggattcaagtgattctcctgcctcggcccctcaaatagctgggattacaggtgtctgccaccacacccagctaatttttgtatttttagtagaagtgggatttcaccatgctgggcaggctggtcttgaactcctgacctcaggtgatccacccacctcggcctcccaaagtgctgggattacaggcgtgagccaccatgcccatctttgtttatttctttttcagatttttcactgttggcatacagaaatgctactgatttttgtgtgttgattttgtatcttgctactgtactgaatttgtttatcagttctagtaatttcttggtggagtccttaggttttccaagatataagagcatatcatctgcaaacaaatataatttgacttcttcctttccaatttgatgcaatttttttctttcttttttctgattgctttagctaggatttccagtactatgttgaataactgtggtcaaagtgggcatccttggcacgctttctgtttttccccatttatgatactagctgcaactctgtcatatatggcttttgttgtgttaagctatattccttctatacccagtttttgtagagtttttatcatgaagtaatgttgaattttatcaaatgttttttagcaacagttgaaattatcatataggttttgtccttcagtcagttgatatgatgtctcacatccttatatccctgtgataaatctcatgtgatcataaggaatgattttttaaatgtgttgttgaatttggtttgctagtattctgtttttgcctcaatgtttatcatggacattggcctgtagttttatttcttttcttttctatttttttaatgtgtctttgtctgattttggtattaggataatactggccttgtagaatgagtttggacgtattcactccttctctattttttggaatagtttgaataggattgatattaggtcttcttcaaatgtttggtagaattcagcagttaagccattgggccctggccttttctttgctgggagatttttatcatggcattgatctcattacttgttattggtctgttccggttttggatttcttcatagttcaatcttggtaggttgtatgtatctagaaatgtattgatttatattaggttttgcaactgataggcatactgttcctcatagtagccacaagtgattctttaattttctgtggtgtcagttgtaagtctccttttcatttttgattttatttatttgggtctcctctctctttttcttagtctatcaactttgcttaccttttcgaaaacaagcaacattttgttttgttgatcttttttattgttttcttcattttaattttatttatttctgctctgatcttttttttttcttctactaattttgggttccatttgctcttgatttcttattctttaataagaattgttgggttgtttatttgaagattttctactttttaaaatgtaggtgcttatagctttaagcttccctcttagtactgcttttgctatatcccatagattttggtaagttgtgttcccattgtcatttgtttcaagaaatttttcaattttcttagtttctttgtgggcccattcaggagcatactgtttaatttccatatgtttgtatagtttccaaaattccttgttattgatttctagttttatttcattatgatcagagaagatgatttatatgatttcaatgttcttgaatgttttaagacttactttgtgatgtaacatatggtctaacattgagaatgatctatgtgcttaggagaagaatgggtattctgcagcccttgaatgaaatattctgtaaatatttattcggtcaatatttattcagtcaattggtctatagtgcagattaagttcaatttttttgttgattttctgcctgaaagatttgtccaatgctgaaagtgaggtgttaaagtctacaggtgttattatattggagtctatctctctctttagctctaataatatttgcttcatatatctacgttctccagtgttgggtgcatatatatttataattattatatcctgtcattacaaatctattttttaggtgaagcagttatttttattttaactaaatttatattattaaaaggtaactatttgaaaaatataaaaccatataaagtaaatgtaaactgtccttttgactcaagatccatggcctaccatttcggatataaagcttcaataacagattaatgcatatcttttcagaaatgtttcaaaaatttagaatgctttttcatgctttattgcttttaaatttcattatatagatttgtttatttatgtcttattgtgtccattattgctatttgtgtttggaacctctcttactagtttacacattttgaatttctatcctttttttttttaaatgaaataaccctttatcattgcgagatgattttcaaaaataactttgttttcttttactatgaatttcacttttgctgactttattatcatcacttcagttttcttattgtttacatttacaaagtacatattttatcttattacttttaacctttgtagtcttttatgtttagtatgtgctcttgtacagagaatatagttggttccctctttgtttaatgattatggcaatctttgtcttttaattagagtgcttaatccatttaccagtaatattattattgacatggttatgtccgtcatcttgctatttatattttgcttgtcttgtaagttttgtgtttgtttgttttctattatcctatcttctttttggttgcatacatttttgttatttccttttctgttgtttattggctctttttcactgtgcccctcccttcttttggtagtttttatgacttacggtatacatcttctatttatcagaacagactctcttgaaatcatttttgttaaaaatttaagaaacttacattggtatactttcattttccttgctaagcctctgtgcaattgttgtcacacatatgttttctctattttccccttcctatccctcatttcctccccctttccttcctctctccatccctctcaatataaaatatatatccattttgtttccctatatacatagatatggatgtagatagaaatagagatatatctgtatctctgtatatgtatcttcaaaatgtatcatcatttttattaattatattttggagaagttttataaataattattggaagacttttatatttaatttttaatttttctatttttttagaggcagaggtcacactatgttgcccaagctggtctcgaactcatggcctgaagtcatcctcctgcctcagccttcttaattgctgggatacaggcataacccattatgccggatgttttttgtataaactccaacttttataatgtattattgtattttaacccagcaaacctgattctgcattcttatcatgcagtactgtttgtggtaggttttctgagcttttgttcatgagaaaatacttttattttgcctgttttttgtgaacactatttgaaggacacttatttctggagtataaattatatttcaacaattatattttccctttctttagcctttagtgacttcattttattgttgcttttatttaaagtatgagaccacagtcaatattcttccctatgtaagtagaatgttttcccttctgcctgctttaaaattttctttatatttcaattatagcattttgactatgttatgtacatgggggctttttaaattttactttgctcagtatttgatgtgattctttcatcaccagactagtgttttctttcaaattgcaaaaagatgttttgccatgaagtaatcagcctcatacaatttctctttccacctggaatcccagtgacacataaattagactgcttaatattttccacaggtccctgtggcacgcttattttatttaacactctttttctctacggattactttcaatgatttacatttttctatcttcaatctgaccaataatttcttatacaatattctatctgttgttaaacctaatccaatgccttctttttggttttgaatattggagttttcagttctagaattttcatttagttcttttttgtaatagttaccatttttctactgaggtttctttttgttaatttactgtgtttatatttttctctaaatactcatttataataacaaaataaaatattgaaacagctaatcctggtataccagtcataggtatttgtttctaatgatgatacttttttcttgcttctccatatatctagtaaatatttattacatattgtggatattatattgttcagtatctaattaactgtgctcctttaaagtattaaatttgttctggcaatacttaatctactgatatataaccttgattatttccagtcctgtttttcagctttttgttttgttttgctttgttttcgtttttagtgtgattctagagtaaagtttattctaggactattgcagcccaactacaaaagcttttctatattgcatatcttttctggactcttgattaaatgattcgggtgtttagcaaagcattttgttatattatacccagtgtgtcttctagcactatgaaactttagatcaaagctactcagtattttttctaggcaaaaactttcaatatatcatcttgggcatgtgcaactcagtgcctggtaaaagacaccaaagcaacatcatgcaaagtcctggagccttttgtcttcataccttccattggcaattacagccatttcaccattgttgaactctcatttctgcctcctcagaacaatgagagcactatgcttttcttgggttctaccattctgccttccaccacaataaaaaaaaaaaaattcttccaaatagaaaagtgatgtaactgtgaggttcacctcttgtacttctcacatccctattctgtttgttattcagattctaaacactgttgcttcacctattttgtctgttcttatagtgttttatagtggtagagctagcctgtcatggacataagtggaaattatatatttatgttatatcaagttatattatatataaataatttccactctttagaaattcttcttctctctcttaaatactgtacatatttagaacttttaatctaagacaggacataagagaagaaaaaaatttaaacaatctccacaatggaacaagtttggtttcttcttaactattctagtttttattaatatgattaaatatgaaatcaaaatataataacttagcatttcacatgcttaggctaattctgatacagcgaccatgggtgatatactgtttgttgattgtttttagattttcaaagctctgagatataagtgtattctgttttcaactatctgccaagagcataaatagttgagctttaaaatgacacctggctacatctctatttgtctaaataaatgtctgtatgtgacatgtttatagctgttggaacactgcttttcttcaccctgacagttctgtagagatacagtatatcgctatatggaattcaaagcatgttcaacactttgtgctaaggcattgctgcctcaaaatgtttacaatttgatcctctgctgcatctattaaatctactacaaacattacatgttgcacaggactttatatagctgaataaaagataagcataaagttttctaagacttaaaagtattcaaacaaaaatatatttgtatcatctaagctaaatgcactggctaaaagacctccacactgtttttgtgaataaagcataacatgcaaatacactatccagggttgggaaatataaatcaatgattctataacaggttgtctcatttaaaaacaattttaaaatattgaatacacaaacagacttaatagtaggtaaaaataaaggtatcctttagtcttctgagatgaatgtttatatatatataaatatatactaaatgcacatttttttcctctatctctttactttgagaagataaaaagtaacaatgtggtcctcgcaaagcttctctggagacacctcttctagaagtagtgatttcacctatttctaagatctagcccaggatataattatttattagacgattatgctgaagtttaaactagtctgaaaaaatctgccaaaaaaatacccaaaaaacaaatcatatatccctggtgaaaatattttataattccacccttatcccttatgtttattatgacttaattatagtagaagttgtcttactatcaaatacttctaataattgaaaagaaacagtggaatcaaataggaaaccatgaaaaatcatttgtctgtattaaagatttgttttgacataaaccatgtaagtgtacactttttcctagtttatatttaaaacttcttcttgtggcaatagtctgctaattagagttccatgcagccttctcccatgtgcaaacaaccatcatgaatataccataatctccaatttctgttaattttagatggaagaaaaatgtaattcagaaaatcctgagagcatatgtcatctgcacagtcaattattttttcagtaattttcatccttatgtaatagtattaattttagcaactaaactttggttgtctaaacattagacaaaatttcatagaaacaaattcatatttcatttgtgctcatattttttactgtaaataatattcactaaaattcaaaaataccataacaggaacatgttgggcaaacaaatttgagatcaaacacatttaaatcttaattgataaaacaagtggagggagtagaaatgtacatcatctccaggtactagccttccagtcacaaatattcggcttcctatagatattagacactatattttgctgtaggaatgaagggtgttgattcaatgagagtcagttatgtaagggcctgttaagagagcttaaagtaccatattcaatgttccttttatcttgtagaatgttaagcttcataagagcagggatgttgactattgtgttcaccaccgtgtatccagtgtgtagcattgtgctttgcttgtaataaaaatcaatatatatttaatacagaaaactcatttatacaacacacaacatacacacaaaatgcaaatagcatacaagaatatttaacaatataggacatcaaataatgattctgggagctttccaactatcaaattttgacaaaagttagaaaacaataattactgaaatagaaatgagggagcaacacatttgcatattattgatggaagtgtgaattgatacactgattctgaaaaacataattttagactactatatgtgctcaaaagtctcaaaaatataaatatacccctgatgtctttagagatgtatgtaaagatctgtgtaagatactttttacagttatgctcatgtccataaaaattgcaaattgcctaaagatctaacagaggatttattaaataaatcttatgtatgtaataaaatattataatgaaatattatgcatatatttcaatcatgtattcacatattctttaatgacataaaaatgcttacaaaacatgagaaacagaactccacatttataaaatcacattgattataagacatacccacacattcacaaaagaaatacaacaaaccagaaataattatttattttaagggtgataaagtctttgcaaacgtttattgtttctctttatttttcttttttctataataaacatactgtgtagaaataaggacaaaattgtcttaaaaggcaatttttaattcttgtatccttttcttgtcctttaaaatatcaccaggaaactagccttgattattatatttagtgagttggagacaggatgtgacgttttatacacattaaaatgctagcctagcatgactttggcttaaatttgagtgtgtcacatgtgataaaatgttagcagtaaaaagaacattagagaggccctaattaaaattccatctttagcagtaagtggccatgcactatgtctacattaagctttccatcaaaatgtgtttcaaaattggtagtacttatacttgtttgagaaagagaaattgctatacagacaataatacaactaaccagccaatattcctcacactattaagcatgtacgtttttaaaacatggcagtaaatgaatattcattaggcatgaaacctttaaaattgaatattcatgacagtttatagtttctaagtgaaaagtaaatttttctttttaaattttattttaggtgcaggggaacatgtgcaggtgtgctatattggtaaattgtgtgctgcaggggtttggtgtacagattcttttgtcatccaggtaataagcatagtacacaataggccatttttctattctcattcccctcccacccccacccccttgtaggccctggtgtctgtggttttctactgtgtgtccatatgtactcaatgcttagctccaacttgtaagtgagaacatgtggtatttgtttttctgtacccctgtaagttctcttaggatgatggcctccagctctatccatgtttctgcaaaggacaggatctcattcttttctgtgggtgcatggtattccatgatttataagtaatatatttgctttatccagtctaccattggtgaacatttaagggtgattccatatctttgctattgtgaatagtgctgtgatgaacatatgcatgcatgtggctttatggtagagtgagttatattcctttgggtattcaataatgagactgctgggtcaaatggtagttcctctttgagatctttgagaaatcaccaacctctttcccaaagcggtgaactaatttacattcccaccctacacacaccagggaagtgtataattatttgccttttcccccaatctctccagaatctgttattttttttaccgtttaataatagtcattctgactggtgtgagttggtatctcattatggttttgatttccatttcttttttttctttatactttttttttctttttaattatactttaagttctgggattatgtgcagaatgtgcaggtttgttacataggtataaacgtgccatggtggtttgctgcacccatcaacctatcaactacattaggtatttctcctaatgctatccctccgttagcccctccaccccaccacaggccccagtgtgtgatgtttccctccctgtgtccatgtgttcttattgttcccctcctacttatcagtgagaacatgcagtgtttggttttctgttcctgtgttagtctgctgaaaatgatggattccagcttcatccacgtccctgcaaaggacatgaactcatcattttttatggctgcatagagccaaaactgtgccacatattctttatccactgtaatattgatgggcatttgggttggttctaaatctttgctatcgtgagcaatgctgcagtaatcatacgtatgcatgtgtccttatagtagaatgatttataatcctttgggtatatacccagtaatgggattgctgagtcaaatggtatttctggttctagatccttgaggaattgccacactgtcttccacaatggttgaactaatttacactcccaccaacagtgtaaaagtgttcctatttctccacatcctctccatcatctgttgtttcctgactttttaatgatcactattctaactggcatgagatggtatctcgttgtggttttgatttggatttctctaatgaccagtgatgatgagctttttttcatatgctttttggctgcataaatgtcttcttttgagaagtgcctgttcatatcctttgcccactttttaatggggttgtttttttcttgtaaatttgtttaagttccttgtagattctggatattagccttttgtcagataaatagattgcaaaatttttctcccattctgtaggttgcctgctcactctgatgatagtttcttttgctgtgcagaagctctttagtttaattagatcccatttgtcaattttggcttttgttgccattacttttggtgttttagtcatgaagtctttgcccatgcctatgtcctgaatggtactgcctaggtttttttctagggttttatatggttttaggtcttacatttaagttttaatccatcttgagttaatttttgtatacggtgtaaggaagaggtccagtttcagttttctgcatatggctagccaattttcccaacaccatttattaaatagggaatcctttccctattgcttgtttttgtcaggtttgtcaaacatttccatttctttaatgattaatcatgtggagcatttttagtatatttgttgaccacatgtaagtctttttttggaaagtgtctgttcatgttctttgccctctttttaatggggttgtttttcccttgtaaatttgtttaagctccttagagattccagatattagacctttgttggacgcacagtttgtaaaaattttctcccattctgtaggttgtctgtgaactttgttgataatctcttttgctttgtagaagctctttagtttaattaggtctcattttttaatttttgtctttgtcacaattgcttctgatgtctttgtcatgaaatctttgtcagggcctatgttcagaatggtattgcctaagttgtctcccagggtttttatagttttgggttttgtattgaaatcattaatccatcttgatttttgtatatggtgtaaggaaaggatccagtttcaatcttctgcctagagctagcaagttatcccagcaccatttattgaacagtaagtcttctctccatttcctgtttttgtcaactttgttgaagactagatgattgtaggcgcatggcattatttctgggctctctattctgttccactagtctacgtgtttgtttttgtaccaataccaagctgttttggttactgttgccttgtagtatagtttgaagttgggtaattggatgcctcgggctgtgttctttttgcttaagattaccttcaccctttgggctcttttttagttccatatgagttgtaattttttttttcaagttatctgaagaatgtcattggtagtttgataggaatagtaatgaatctgtaaattgctttgggccgtatgaccatttaacaacattaattatttctatccatgaacatggaatgtgtttccatttgtttgtgtcacttctgatgtctttcagcagtgtttggtaattctccttgtagagatcattcacctccctggctagctgtattcctaggtattttattccttttgtggctattgcgagtgggattgcattcttgactgggatctcagcttggatgttgttggtgtgtacaaatgctactaatttttgtacactggctttgtatcctgagactttgctaacgtgttattttgctttactatttttaaaaattttaggtttttactgttgaggaaattgttttcccaaattcatagttaactcatagatcatagtctcctttgcatttgctttgaaaacatatagaaagttaataaaatgtggacttacaggcccacccataaccactctgtaggttagcatccatgctttcttttttccttaaaaagagacatcataggtcatactgaaaagacaatggagttactagctagaaggattctgaatatctaaatcactttttttttttttgagacggagtcttgctctgtcacccatgctggagtgtagtggtgcgatctctgctcacggcaacctctgcctcccaggttcaagtgattctcctgcctcagccgcccaagtagctgggattacaggcatgcgccactgtgcccagctaatttttgtattttcagtagagacgggtttggccaggctggtcttgaactcctggcctcaggtgatctggctgcctcagcctaccaaagtgctgggattacaggtatgagccaccgcacccggcctctaactcactttttagataaaagctacgcaggagagcagcagcacaatcagtaatatcccaattcaaatttgcatgacaaatatcacggagggtttgagatttgcagtagtcagcattgattatacagactaataaaaaaactggatccttaaagtgagatattgacaaaacaaaattgaaacacatattattaacttagtagggggtgacagattgcaagagaataaagtaggttggtcccttggtgattaaaatgaaaacacattttaaaccataacctgacaaaatcatttgtgcatcaaaccccaatgacatgcaatttacccatgtaacaaacctgtatatatcgcctctgaagctgaaagttaaggaaagaaaaaaaaaaaaagaggaataagttaaagtaaacaataaccacaagaaaccataacccatggtaacttggaaggcagaccaaagctgactcagtttataggtctaaaagtgtttgaaaaatacattcttgcggtatgttactattattgacagttttagcagagtattacaagaaagagatgagctcagaaaataattagcagatttaaagtgaagtgaaagggaataaggaagctcggaaaaaggtaagagttgaaatttaaaatgctttgaacaaccaagacccagagaaattgggtcagctgaacagtgtatcatatttgtgccaaagatcagataaagcacatgttctgcccactcaagcttgatggtcacaagcttatctgactttaaggtgagatacaaagaggcatgacagcaagatagcaaagaaatgaaacatagttgagaataatgtctggtggtttgagctacttgtacctgaaactgactggaagcaaatagtttgccaagttcttaaaagatttatattgccaaatagccacaagtccgggttaaaaagtatttgactctgcaatcctagaaagaactcttggacatgagcatgaacatgagatgggttctgtaagctggacagccaagaaatagatatttttaatgtgtaatttagataaagcatggaggatgagaagaaatagcattcactaaatttggttttcttaacaaggtagttactcccagggaagatcaggtctaattgagaagctttctttttttcaccaggaagtgggtcctcacaatatgttcttagctggattccataaatgccatggatcaatgacttctgtgtgccttctattctcgtgttttccaaatgcgggttgttattgatattagtgtatctgtatctgtcattatgtatatatgaaggatccaggggcagaataaatggatttttaacatgcagattacaaagcatgaatatgctactacatgtggacctaacataggtatcaggttggtgcaaaagtgatggcaaaaccccaattacttttgcaccaacctaataactgcaattagccaaagattccggaaataaactgaatactgtgaataggatttgggggtaagtggaagatatgaaaaatagcactaatgaaatactgggtggccaaagggtagactataacaaagacactgctctatttttatcaaagcatatctacctccttttggactcacagttaaagctatgatttcaggccccatttcaattagcttgggatcatatgactaacttgtgtccacacaattttatgcttgattctccacattcacctccttaagataaagacagagacatttgaggattgtaggagcctgttgttactgcttggaggcaaaccactcaggaaggaattagcaacagatgaagtttattaagccactgagatttctggatgtttggtggtggtggtggtacagcaattagtgttaataactctgaataatataaatacattttagcaaaaatataatgaaaaattataattttataatgaactattaaaatatttttttaaaatatcatattttagatatatagatataactactcctttaacttactagaaagaggtttaagcttttcctatttctgtgcaaagacatcaaaattcataatttttcagtctattatttaaagaataagaagaaaaaccctactacttttttttttagtgaagagatcaggagagctattccatttggaaaacactgattttcagcagggcccattttcccccaaattcaaggaacacaaaacaagttaattcagaaatgtggatatagatgactgtctagaaataattaatgataacttctgaagagctgtcataggtaatgtgatgtctttaaattaataacagtttacatcacccatattgcgttccacgaaaactgctgttccattctatttgaccttaattggtataattgataacagctacagcttggagtgtcattttaatcatgttggtagaagtctcctgacagaagaaaataaaatcgctgttgtgagttatttattattagtgggaaaacagaaaggtaaaagaaatgactgttttttttttttttaaacctgcaactttgggacttctaaattataacaggcaatttactaatgggattaaagggcttgtgctaattgctaaaaaattaatgaaaactagttcatatgtaatttgacataattgaaaaaatgagaaaattagttggttgcaggttagagatatcaataaacaattcaagacaaagagaatattctaaaatgttctaaacgttagtacgacccctggtgaataagatttctataacagatatgctgtttagcgctgattatttaaaagttcaatttttaaatttgaagtagaaattgaaaattatgctagttataaatgtgactatttcttgctgatttgaatgggttgttcagtgtgtgcatggagacagtgtgtacatggggttaaatgttgaaaaaaatagatattgttagtttaatagtctttttgtgataaacagagtcaatagtgagtctcctaagccctttttctaccaaatattgctgaattattataagataatgagctggtctttccaagaaaacattttgtctctcacctttatcactactttttagatatttctttctgtttttaaaaaaataataggaaggcaaaattcaacaataggaactcaggattttaatttttttgacaactgaaaaatgtgtactctacctattgaagaaatctgaattctgagccatttcttatttcttgctttgttcttgttttttaaatttgagtaacatgcattgtctcctttatgacttataacaattgagtcattatgatatgtttgtagcttagtgtgtgatatggtttggctctgtgtacctatccaaatcttatcttgaattgtaatccccacgtgtcaagggagcacccaggtggaggtaattagatcatgttctcatgatagtgagtgagttctcacaagatctgatggttttataagtgtttggaagttcctcctgcattcactcactccatcctcctgacctgtgaagaaggcatctgcttgtcctttgcctcctgccatgattaaaggtttcttgaagcctccccagcaatgcggaactgtgagtcaactaaacctctttcctttatgaattaatccataaatcacaattgtctcacttttcttctttgattcttttgctctaactcctagcaacaaaatctcccatgatgcagtgttaactccaccagtgcacacaaagatcatgacaaatattacaggacatagaatggtgcctggctcatagcactttagaaattaaaaaacaatattaaaaaaaaaaccacctatgcagttcaactgtaacttagacttctttagaagctattttacttagctaactcgtggctagtgaaatcactacagcagtggacatgtttgggggcctcctttcccatccctctcctggattgtctctaattaaattctttcatgtctttatctgtatcttcctagctttcgtctatcatgggggaaaaggtgttattcacactcactaaaactcctttttttttttaatctaaatccttgcttttatcactcttcttattccagaactttgcttccaaatttattatcttcctgtctagcaccacatgcctcttcgattgcgcttgttctcctctgcatgcaaatacacgcagggcttgactgttccgaaaatcaaaacaaaaagagaacaaagtacttcattttattcaactgtactttctcccagacaatctggttttctcctttctgcaactgtacaaaattgtaaaacaagtaatgtgaaatattcagtaaagtttttatctctggtttgtagtcagcatttgttgggggggaaaaaagttaaatacttttagtttcccagttgtctcaaacctgtgactcttatttcttgtcccagtatcagcagactatttggttcctattttgcaataatagtatttatttatcagaactccctcaactcactacttccaagattgcaaattcacctacatttgctcccaccattttcccttccttctctattacaatgaaagctttttatcaagggcgccccgtaaagtctttgttcacttctgccccttctaattcccactttaacaatatttgtcacataaatcttcttcaataattccaaaatttctcagttcatctttctgacttccaatcaagtcatcacaattacatggagaatggttctttaaagcacaaaatggtcctataataataatgcctttgcttaaaatcccttaactacttattattttattcaggcttttaatctcaatatattttagttctctgaaaaatagccataaacaatttatttaaatagtatacatatttcattattaaacatggacattttgttctagccttagtattctcttaaaattcgatttccaaagctataaaattatttgtgataacttttattttgcactatttgataaaagtaatgtgcctggaattggtggtttgttggtctcactgacttcaagaaagaagccgcagaccctcgcggtgagtgttacagctcttaaggcagcgcgtctggagttgttcattcctcctggtgggctcgtggtcttgctgggctcaggagtgaagctgcagattttcgcagtgagtgttacagctcataaaagcagtgtggacccaaagagtgagcagtagcaagatttattgcaaagagcgaaacaacaatgcttccacagtgtggaaggggaccccagcaggttgccaatgctggctctggcagcctgcttttattctcttatctggccccacccacatcctgctgattggtagagccgagtggcctgttttgtcagggtgctgattggtgcatttacaatccctgagctagatacaaaggttctccacctccccatcagattagttagatacagagtttcgacatacaggttctccaaggccccacgagagcagctagatacagagtgtggattggtgcattcacaaaccttgagctaaacacagggtgctgattggtgcattcacaaaccttgagctaaacacagggtgccgactggtttgtttacaatccctgagctagacataaagactctccaaggccccaccagagcagctagatacagagtgtcaattggtgcactcacaaaccttgagctaaacacagggtgctgactggtttgtttacaatccctgagctagacataaagactctccaaggccccaccagagcagctagatacagagtgtcaattggtgcactcacaaaccttgagctaaatacagggtgctgactggtttgtttacaatccctgagctagacataaaggttctccaaggccccaccagagcagctagatacagagtgtcgattggtgcactcacaaaccttgagctaaacacagggtgctgattggtgtatttacaatccctgagctagacataaaaactctccacgtccccaccagactcaggagcccagctggcttcacctagtggatcccacaccagggctgcaggtggagctgcctgccagtcccgtgccatgcgctcgcactcctcagcccttgggcggtcgatgggactgggcgccgtggagcagggggcggcattcgtcagggaggctccagttgcacaggaactcatggaggtgggggacggctcaggcatggtgggctgcaggtcccgaggcctgcccggtgggaaggcagctaaggcccagcgagaaatcgagcgcagcgccggtgggctggcactgctgggggtcccagtacaccctccgcagccgctggcccgggtgctaagcccctcactgcctggggcccgcagggccggccagcggctccgagtgcggggcccgccaagcccagaactccagctggcccgcaagcgctgcgcgcagccccagttcctgctcgcgcctctccctccacacctccctgcaagctgagggagccggttctggccttggccagcccagaaaggggctcccacagtgcagtggcgggccaaagggctcctcaagtgccgccgaagtgggagcccaggcagaggaagcgcccagagcgagcgagggctgtgaggactgccagcacgctgtcacctctcagtaacagccaaaggttaaaatattttcttgtaaaaaaggcagataaagacaagtttaagttgtagatatctaattttccctggaaaagaaaatatttccctagtgaagtaaagaaaatttaaatatacagtaaaagaactttacagaagatgtgaccccaatgaaggaaatagaaaagataaacatggaagtttaagtaatactttattttcaccattgacaaggtgacttaggctttcgaatcctacaaaaagctctgaatatttaagaataacattagcttgtgaatatttaagaatcataataattatgtcctggagagtttatttctgtacaacagtgggaggcaagattttatgtagctcaatctttgaagcacggtaatagtatgattttgcacgtgatatgcaaatgtgtatgtgtatatacttatatatttacacaaaatgttactaaaagaaaaaatacattttatatagaattttaccttacatattattttatttaaactacatttgagtctgtgcacattaagggagaaaactgtaaaagcaagttagttgcagaatgattaagaaacaaaatctgagtgtagactttccaaatcccttgtggattgataatgctatgaatgtgtgagagactaaagagatttccattgaaaaactctaagaaaccaggaggagggtctgatcctaaaagacagagttggtgctgataagatttgggtttgttgcacctttgactactatcaactcatacacaggtggtttatgaaaacccaatgcaattttaacaaaagaaaaaaagggaggatcgttcatcctatctattcagacacactataaagccacattaatacaagcatgttaccaacatacataaataaaacagaaaggagaggtcatttaaatatgagagcttgatgtttgataaacatgacatcaaaaatcagtgcagaaataatggattttaaagtcagtgatgggaaaaaatgatttactatgtgaaaacatatatataaagatatgtggatgtaattgataggttgttatataaatacatacatgcataaatacatgcacacaactagtagaagacggtgaacagaagagggtgtagggcaataggtcatgctttggagaaaaacttaataaaagccctaaagggtaaaaagcaaaagttaaaaaaaaatcaatgggtttaactgtatcaaaataatgatttctattcaatgaagtacaaaattatgcaattcacagcagtaaaaatctaaatggttaataaacataaaatatttaacttattcatgaagaacaaaaatacaataaaaatgtattatttttcatgtttaaatcatcaaatattataaaatgggataatatttatttcttacaggtttgtcatgagatggcaacttgtatatagcattggaagtcaggtaaatttgctgcaatctttctgaaaaccgatttaatgttatacatcagcaacttttatatgttcataatttatgacctaggaattctatttctagaattctgtcataaaggaagcatcaaaacaagcataaacaagtttctcataacatcatttattataataaacactggaagaaacctaaaacctcaaaaatatggcaaagcttaaataattaatgatggtctttcagataaagctgtgaaaaattgttttggagaaattttaatgaatttttaaaattcttatattaagttggaaaaaacatactgagaaacctgttgtgttgaaataaaacagtaatcatggtaatctatttattctggaagtcaactagtagactgtaagcaagaaatgagaatattgtattttacctctaaatactcaacagtccagcagttagtatatctataccaatcactcaataagtggttattaagagaaaaaaattgaatttaaatttatttatattttctatacttttatgtaatctggaaattatcaccaatgagtgcatatcctttttataatcataacacatagtactatttaaaacatatatatgttacaactccctgtaagggttgggaataaatatgctctttgcttttctttgctggagtatagttaaagaatcagaaaatttatagaatactctgatcttttcagtaaatttatttatttatttatttatttttgagacgaatctcgctctgtcgcccaggctggagtgcagtggcgcgatctcggctcactgcaagctctgcctcctggggttcagttcattctcctgcttcagcctcctgtgtagctgggactacaagcgcatgccaccaggcccagctattttttttgtatttttagtagagacggggttttaccgtgttagccaggatggtctccatctactgacctcgtgatccgcccgcctcggcctcccagagtgctgggattacaggcgtgagccactgtgcctggcctcttttcaataaatttctacctgaaaatgtctcttttatatattggtaaataaatatgtcaatgagaatttagaaatgaagagagcttgtttgtcctttagtttgggtcaatagagacaaacaatttttaatatattaactcagctttctcttttgggtttgttaggaatttttaatacaaaacacttttacattcatgaacttgatacagctcaaataatgaaattatataatatttaatgtaaaagctttctaatttacaactgaactgttttttgttcaacatattacacaacaatataaaaggtatttgctttgggacaatatgccaaattatatcttctatattgagctataattacataaaggagtatattttacttctgtgtgcaaactgagataaaattgtttaaatatttagcattctgtttttattcccatttacctaagtaataagtactgtgtcagaaaatcaagtggaagaggagactggaaataggcaaagaatctgcaacaaaaatcaatatttaataaactttgcattttaagaaaagaatgagtatatgccctttgcagtagatttaactcaaacttatcaatttcagacctgaatttcaatttgctgagcaaactttctctatttggacatgttttcttcttttctggctcagcttcatctctactgatgcctaaaggatttgtgtgagttgggttacatttacaaagcacccagtgtgaaatggcattttattctctgtgcatccaatttttttctattctttttctttgttgttagttggaaattgacaggagtttcacactgtgatgcaggtcatcaaaaatacctatcatggaatacatacatactttctttgattaaaaagtaaattgtagcagaaactggttgtcagcttctgaccatccagatattgtcacgaaatttaaaaaatgaaacagacttaggaaactccatcatcacttaaagtaaaataataaattgtacatggccattcaaatcagtaattctgaaattgatcaaaatctgtctaggtatatatagagtacatatttttaaatggaatgggaaagacagaaaaacaaaaaacaaaaaacagagaagggtggttccttcatgacaagaacaaatgtgaagtgattgttttaaccaagaagtgatagcactactaagcagcttcaagttacatatataatcaactagtaaacattttgttgttaaaaagcattagcttgcattgtagcttttaaaaaatatatataacctgccatgtagcaaaagatcccccctcctcatcccccactctaaatttttatgaaatctgtttcacttgcatttcataaactgagtataaaataaagttgtactgcaaaaaatagcaaatcaagtcaaatgggagctactgagagataaaaagttatgttagatatgatcctcgattaggagtatttataagtcatttgtttcagtctaaggagggatatctaagaacaagtaaatcaattcaaaacagtggggaacttgctctaaattagctatttactatgtgctatagggtcatagaagagagactcaaattcaatctcgtgggagcagaaaagtaagcagtaattgacattaactctttttaattctacttttcaaccctttacaatttatcaagtgatagtgcaatgtgttggtcctctttaactcattcacgcccaggggctcactaacagtgagaggtgtgacatatagaccatctcaaagggttgctagaggaaagagataatgttaagctggtctttgtaactgaaagagtcttgtaattactttcatagataagaatcatttatcatgagctcatttattttttatcagtgatattttcaagcctttaaaagtttgctaaacttcactcttgagtataataaataatttccttgtttacattaccaatttgcttggaaaatggtttctattttacacatcatagaaagtcaattccagttcatactatggttatcatgagctacaaatcagtagtactctaaaatacattgtacttaatgaatgatatgctccttggtatagaaatatttctgcttttacatttgtgttcttctcaccaaatcaatgacacagtatttgagtggatgtatcttctagttgattttgttgttgttgttttgttttgaaagacaaattatcctctattttcatctgacctctgcatatggatgtgtgatatatgtcaggatgactgtacaattctgttataaactgtttctactgtaataagaaaacaatgaaacatactctaacatatcatgccatatttcttcacatattaaaatatttttctcattttaatacttctcaaatcaagattcatcctaaattgctacgtgcactgatgcaattttgcagacaaaatgtacaatcaaggtttatgatatatcttatattaatggaatcttagaattgataacatgcaggattcacaagaatatctgcctataggtgaaaagtcaacatcaactcctgtgacttcctaaagagaaatttatgtatgttctgcattgctgcaatatttcattaatctattttaattacttatgaaactctagaataaatctatttttaaataaactttttttaaatcttagccccaaagtaggtttaaattcagtcatgagaattattcttttccagaatcagtgttttgctccagtgtgtaagcacacaagaattcaaactttacggcaatagaaatagattagatataaagattctttagcatacttcaaataaatcgaagccttgaaacatctaattaaataaaaacagttgaaatttttaaaaaatcagcaaattataaatataccttaggagaatttgattgcctctattgtacaagaatccataatttgtaggaaattgacaaggagacagaataggcagttgcagggtttttgtttgtttggttggttggttggttggttggttgggtttggtttggtttggttttcgagacggagtctcattctgttgcccatgctggagtgcagtggtgcaatgtgggcgcactgcaacctctgcctcccgggctaaagcgattctcctgcctcagcctcccaagtaggtaagattacaggcatacgccaacgtgccccactaatttttgtatttttagtagagacagggtttcaccatgttgcccaggctggtctcgaattcctgatctcatgtgatccacctgccttggcctcccaaagtgctgggattacaggtgtgagccaccgcaccaggacagcagcctcttttatttatttgttgttgctatttacttactgatctcacccgattcattttctaccttaggaagattacagaatctgagactgccagtcgaccaatgatttcaacagttgacatacttctgttagatgaatttgaattgaggaatggtggtgtgagggatgaaagctaagggatcaagattccaagaagcaatgacaagttttaccttgaggaaaggaattcagggtctaactcttcccgcacattttgtgaagacatgaggttcttccaccagctcagaatagaacttcaactatttttctcccttcgttttctgatattaattttacttctctatttttctcctatttttacagtattctcactgtaactcaacattttaacctccatcctttgtggagctaattttagtttattgctataataaaaatgaagacaggagaacttagaatttgatataaactgatatacctattcttttaaggtgaattaatctaagatgttattattaattgattatgtctgtattcctttctccagagctctgaaaccatgccagcctctctgaattttcaaattaaaatacaaaacatagaatctaacagcattacttggatatatttataagctattaaatctttaaaggagaccattagctgcattgtccctataggaatagatgaaatcagaatcttatagtagagttccattcgaaaattctattaatatctcttcctaccttgagtcagatcttatacagctgggattttaaactaaaattttataggtataacttggagaatgattgaaggaagacacttaaaaaaaaaagaataaaactactgcaatccagagtttaaaaaaaaatcaaattcttttctctggcctcatcaagctatgtaaccttaaataattctggctcttggtttctgcatatagtaatgaaggctattatattattaccttctgtatacagaaacataaaaattaatcccttaaaattatattacttatgattaatacactaatttcattttacttttgctagaacatattagttttcaatggattaaatatctaagaatgtggtaatttttactttgttacgttgtgaaagccaatgtctttctctctccatccctctctctgtcttcgtctgtgtgtctctttctctctccctctcctttctctctctcaacctctatatatctgtgtcatatttatttactggaatagaaagtaggcattccaagtaaagcttgagttgataataggtaaatgtctcacaaatacacaagacaaataagttatatttcctcatagaatttcagtactgttagcagtttttattccttcttgatgttaaatttccatttgaaatgagaaagtggcttttctagaactataattaataatcaaaatatttgaggctgtattatatcagtgtcaaaaaataaaaattgttttcagctttccaaaatgatttttgctggcagataagctttttttgttgcaaacttgtgtaagttcactctttgagctgattttttcaatcagtaatgttctgctgattttgtgaaacaagttgttgttatttttggcatttttgtgaaagagcttgaaggaaacaatcatttacatactctactttctatctgataatttctaaagctattagattaagagaataagaaaaaatagcaaaatcaaaaatttatacttattccaactgtcaaaacttatatgcatcatcaaatatcctaatatatttaagaagaaatgaccaagcttttaatcatgccattgtttcttacatattcaaaatgggaaatataccaaatgtcatgcatcctattctatgagtttaattgttatcttccaaaaaactgtttaaattttaaccctatgtacctgtgaagatgaccttacctgaaaataagttctttgtagattttaataaggttaagatgaggtcattagggtgaaccttaatccaatatgacagatgtccttataaaaagagaagagatgcagacacatgagaggagaacgccatatggcaatagagccagagattagaatgctgaagatgcaagtcaaatgatattaccaaatggcagcaaaccaccagtagctgggaagaaggaagagttctcctctacaggtttcaagagcatggtcctgccatcaccttgatttcagacttctagccttcagaactgtgagacaataactttctgttattttaaatcacctagtgtatgatacttgttatggcagccattaggaaattgacagatatctggtctttatcaaaaataaatgtagttttaattctgatttaaattaggtttggtttaaaactgaatataatgatgtccaacacttcacttgaatagtaagttaagaaacgctgttaggcctggtgcagtggctcatgtctggaattccagcactttgggaggccgaagcaggcggatcacctgaggttgggagttcaagaccagcctgaccaacatggagaaacaccatctctactaaaaatacaaaattagccgggcatggtggcgcatgcctgtaatcccagctacaagggaggctgaagcaggagaatcccttgaactgaggaggcagatattgtggtgagctgagattgcactatagcactccagcctgggcaacaagagcaaaactccgtctcaaagaaaaaaaaaaaaaaagaaagaaagaaatgctgttatgttttgattatgggaataaagcctatattatttttaacaaattttttcaatgttctatgtaacaattttaaattaaatacctcttaaaataatatatatagtcattcgttggtatccatgtgatattggttcaaagactccccatgaacaccaaaatctgcaaatgttcaagtcttttatgttaagtggtgcagtacttgcatataatctatgcatatcctcctctatacttacgtttatcactagattatttagaatacctaatacaatataaattatatgtaaatagtttctatgctgtattattacatttgtaatttttcttgttgtattgttatcttttattgttgttgttttttaatattttcaatctgtgatttgttgaatccagggatgcgatatcagtggatatggaggggtgactgcacttacttacttttatataaagttgttcacattcaccctttacccatctttaaaagaaattgttttactttcagatgtacattatatctttaatgtatatctctcctctatcgaggaagatggaaagatacatattgcaagaaaggttgaattcatattgattaggtaagaaagtctaatttccaaattagaacttgataaaagaatacaattagagattataatcactttgagaaaaagatctggcagtgtcctataaacctcaagattcacctcttatgaccctacagttccactcctaggaaattactcaagagaaacagaaacataggtctacacacacttatcaagaaagttaatagcagatttaagcaaaataggcaaaaactgaaatcttcctaaattgtcatcatcagaatggataaacaatgtgtatataataaaaaactgtttagcaataaaaatgaagtaattattgatatatacaataacatggattagtctcatataaaccatgctaaatgaaggaagtcttacacaaaagaatacatgtagtatactttcattgataggaatttctaaaagagacaaaattaataaaaatattgattacctctggggttgggtggtgaagtgtttgacagtaaaaaaagtatgaaggtatgaaggtttttcctttgtgatgataaagcatgttttgtaccttgacaggtgttggattgaacaggcatatgcaattgtcaaaattaatgtaataatatgcctaggatttgtgcattttattctgtggaagtttaattgtaaagtgaattgtaaacaaataatgacctttacatatatacatgctaaggtatgtaggggaacagtgcagcgattctacaaatatttttgaaatgtagaaaataataagatgattgaactatagacagataaagggatacgtgataaagaaagtatagtacaatgtagcaaaatataaattaggtacattgtaatattagtgagtataagggtattatgaaattctatttttcagtatgtttgaaaattttcataacaaaatgttgaaaaattttaataagaaaaacttacacacacatatgcagaaatcatttttagaatgatttttctagtagattcaatgaaaaatgtcacttctatgtccagaattcttcaatcatattgatccagagccattcatgataattctttaaaatagagatactctttgaattcaaaacaggtaactgtcagttaagatagtttgcttattaaaaggttctgctaaatgtctgtatttattataataactgtattagatttgtctcataataattatgagaaattatctttatagtgttgtggcaaatgtatacttattaactagcagcattggcatgaattacataaaataaactatttatttctacattgctacattgtttataatcttattttaatcttacttaatacatgttttatatagtggatttaaaataaatgtttgtggaagaaaaggatggagagatgcattccatttaaagtgataataagaattattactatctagccatgagctggaactaatcaaaagggtctacttagatgcaaatggggtggagaaatgctgtctatgctcgggcaactgcttttcagcaacaattttatattaaatagaggaaggtcacagttttctgtagaaaattagacatcttgcccacatttattttgttttgaaatattttaaaggcagtatttttcaggggcttgtttgagtacaatttctttcttttattttatttatttattttttttgagacgttgtctagctctgtcgcccaggctggagtgcagtggcgcgatctcggctcgctgcaagctccacctcccgggttcacgccattctcctgcctcagcctccagagctgctgggactacaggcgcccgccactacgtccggctaaattttttgtatttttagtagagacagggtttcaccgtgttagccaggatggtctcgatttcctgacctcgtgatccgcccgtctcggcctcccaaagtgctgggattacaggcgtgagccaccgcgcccgaccatttgggtacaatttttttgtattatttttgtacaatttttatatttgtattatttgtatatttttgtgttatgttgtattatttgtattatttagatgtacaatgtttgatatctaaggacgtatttgaaaacatcaattatgtttatgtacatacatttgcacacacagacatgtataatgtatatacaggacttttgaacatctttcctaatgaaatatcttaaaaaatttgatgcatttattgaatattttgttcctttagaaaagaatttccaaatacctattttgtttcaagtgcctgttagagagaaaaatacaaataaaacagcaacactattcctgctgtgctgagagtttttatatcagtttctttacaaatacagatttctgaaaggtttgaatttacacaaatctcttaaggcttattaccaataacaaatccaaattctctttcactcaaaagagatctgagggaaagaaaaataaaaggatgttttcttctgcaaaggaaaaaaaaatagggatttaggcatttatttgattgtttgttgtttcacgaaaagcttgattggttgcttggtcatgttacagcctaatagtgatggtaataatttcagtaaatagatttttaaaatggcaaaatacacaaaaactgagaaggaaagttaatacaaagaaagccattctttcttgcttcaatcaaatacagaagtccccagtagataatcatatttttcctgtagttatatttagtatgaacccactatggttgagacactgtgttaagtattttatatacattatttcacttgatgtttacaaaaatttttgatgtcagattgtgatctctgttctatagattttttaaaaaagaagattttgggagaagggacttgtctgaagtcaccagtgaaagtttgaactgattatctgtaaccagagagctatattttttgaagagactatttagtgttaatatttaacttaataaaaagaaaagtaaaatctcatctttattaatacccattctgcttccataataatgataaggtctgattctatcaaaaaattctcattttatcagttgctaacatggtattcagatgattaccactgtcccagtcttctggtctttaacttgcttgctgattcagaacaaaatcaaataagtattttggcctttctttataaagccctaaatgttgtggatcttctgataaatgcataattgagcaaaaacctggacgcaagcaagtgtattcagcttaccaccaccaaaaaacttagttgccaaatacaagtgccctagtccattttgtgttgctatgaaagaataccatagactgggtaatgtactgtaaagaaaataagtttatttttcatagtctggagactgtgcagtccactatcaaagtgcaggcatctggcttgggccttcttgctgcatcataacatagtggagggaaagaaggtgaggacggggggcaaactcatcctttaatcaggaagccactccaggaataactaaccactccaaggtaacagcctaaattcatgcgggctctgccctcatgacttaatcattttctaaaggtttcatctatctacactattgcattgagaattaagtgtccaaacatgaattttgggggatacatgcaaaccattgcaacaggttagtaaaagcaaaatatagatttttctaaattgttggtggcaatattataaacttcctctgaaacaataaaacctaggggaaagcatattaataaatggctgtgttgcttatcttatttctctgatgacctccttattcatgaatatattgtccagactccaacagattttatctcgagtccaaaattttaaaaataatttatctctcttgcacagtgtgcactaaaaataatttataaaatagggaagtgtataatctgtattggtaggagaaggagaaggaggaaagaaagatacgataaagcaacaaaaagaagactttattaatagagtactagaagaccctattaaaaaaataaataatagaaaaagaacaggaagaataaaagtgacagtatgaagtagagaaaccagtgagctaagggcaagatgagggaggagtcaaagtgttaagctagggtctcaaactcaattttttttttttttgcctgaggtcaggcaggtaatgtgaatgagtaaattgggctgattgtaagaagaatgtggccagtgtttcatttctttttattttgtttttaaatcagctttctttccttgcatttgataggggaataaacatttctttttgaaataaacaatagtaaaagtgaaatgatcaaaggtagtgttctcagtctctggaaaacaacaaagaatggtatggcaaaccagcattcatactggccctggaagagggccggtggtaggcaccattcagctttgtccagtattgatagtattttttaatcagaagctgaaatctaaattttaagagaaatctgaaatactgacaactcattaaaaaaaagtttaagttaatgtgaatactctcatagcccttactgactccattcctacaggttggggattgtggcctatggctaccagactgcatgcttactattaaaaagttaagcaggccgggcacagtggctcatggctataatctcagcactttcaggggctaaggcgggcagattgcttgaggtcaggagttcgaaaccagcctggccaacatggtgaatccctgtctcggctaaaaatacaaaaaaattagccaggtatggtggcatgcacctgtaatcccagctactcgggaggctgaggcaggggaattgcttgaaccagggaggtggaggttgcagtgagccgagatcgcaccaccgcactccagcctgtgcgacacaatgagacttcgtctcaaaaaacaaacaaacaaaaaaacaaacaaattaagcggaagggaataaaatgatatcctaactttacctctagctattctcaaggcccgatgggtcctgctgcttactctgctcttctccagatgacttttctatatgtgagactagcacaaagctctccattagttacagtcatgcatcacgtaacaatagtggtgtgttctgagaaatgtgtccttaggtggcttcgtcacggtgcaaacatcctatagtgtacctacacaaacctaaatggtgtagcctactacacacctaggctatatgggatagcctattgatgcttggctacaaacctgtatggcattttaccgtactaactctataggcaattataacacagtgttaagtatttgtgtacctaaatgcatctgacatagaaaaggtacagtaaagataaagtataatcttacggggtcaccggtgcatatgcggtctgtcgctgactgaaacataatgcagtgcataacagtatttgatttttaaaagggttttaggatttttgctttggtctaaactaatttttttaataagagccacacagtgttcaattctggcttatttgttgtcatctattttctgagatcaagtctattccaaggaataggtcctgcacacagagctggcttcatgggtatggcatcactggaattgcaaagggttctgcactcagaaagaagccccgtgtttagggtttaatacaactctgtgaatgttgtctttaaattattactaattttatgcttctgtgtgttttagaaggtttgatgggacatggatcaggagctggggcttagagtctttgtccacaggttgtcctgcctccttctgacctccaccatctccccacttccccatcttgggttcttggttggcaatgccccactcctgtacagataccactggcactctccactccagcaagggcctggacacaggtgttaggagagttagggtatgcatatacattacagggaccaagtcatggggctttgcccaaggcacctatgaggccccatgattgaggggtcacaatattaaatagaaaataaaaaacaccacagcaattcaagaaagaccacagaagaaaaaaaaaaggtgggttttgttttgttttgttgtttcgctttttgcacaatgtgtcctgcattttcattttatactggattctcaaaataacatagctggtcctgcttctcagggtattttatcactgcttacctactctttcccttgcacttcacaaacctcttctttgcctaaaacatgcaacatcaaaataaatggtccagcaaaacctgaaggtgctttaaaatgtagttaaaagaaacaggaggcaattctatttagaagccgcattacactctaccccaaatctggaaagtgtgaagagaaaatgccagcataatagctatcactctttgttgttaacacagctgcttgctcactttagttttctcgcacatataaggcagagctgtgatgtactcagacagatcacattcaaattctcattctgccacttgctaagtgatgaccttgggcaagttactcaaccttccttagccagcttcgctcttataaaacggttttaataatgaatgttcttgcagtgttgttcaggttgaatggtgtaagatgaaacaaatttgtagcataatgcctagcatataatacaagttctttcattcttatgaaaacctatatatatataatgtaaataatattttatatttttagtattttaatgcacacaggtttaactcctttttgtgtcagagaaaaacaaacctttcattttagctgaaatgattagaagtcatcatatagcatttataaggctatggctactgagtctgcattggcccatcaactgtcattgtagggaagagatgagtgggctgagtgccctgcagtagcaagcttaatttatggcttttggaagaactgagccccaagcataatattcaaggtctttaatatatcaaaaggctttttttcttagataacaaaaatttcctctggttttttgatatgtgaaattttagtgtgcataaaatggagctctatattagcccactctgcatgttttaatagtgttacagtggtggctaatgtctatgataatcaacagttagcaaaaacatgaatttggatattttcacatttattatacaaaaagacagtattttttttaaacggtattgttttaaacagcagtttaaaacacaataaaattaaattccaaataagccataatttttatcagggtacttttaagtaatctgtgtgaaatcattgagggtactcacagatgatgcaactaatttattcagtcttaaaatgaaaactcacaatgcaggtaagagatatggagaaacaatttttgcagacacaaatttaacttgtattaaaattttattatcctcttttcaaaatcatgaaatcagcatatttagccgtaagtaactcatatgctgattactaaaaaatagtgtcgaagtcagttgatcagtgaagtctatgcatccattaaaagcatagctagctattgattaatggaaatcagcaaagacctataaggcagttaactaaaagcagaaaaaaacacattcctacaagtgagaaaagccaggagaaaaattttaattactctctcacgaactcataaaaacaaagaaacaaatatgcaatcaatagaaaacagttgtttttctgtgactaggttaactaaattacgtcttagcaaaggagctaatatgataaaataactaaggtctaattaccaagataattagaaatatttgtttggctggtgacaaatattagtattaaataccgaaagcttatgaatatctaaaaacattttccaaatgatctacaatgtctatagaaagagaattagcatcatgaaatgagatgcacaaatgtgaaacaatcttaaatcattgctgaaactatagggacctaagtagtagttggaattaattcccattgaagtaactaaatgaattacttctgcttcaatgaattaaactgaaatatatttgctctaatttacatttgtgctgttttgttctgtatcaatggaaatggataagtgtttcctatatttattatttcaggagcacaataagctccctgtcagctttctcaaatatcgtttttcatcttttggccccattcactctccatcttcttatagaggttacttaaaagcttagcacaatgtaatgaagtttgtaggatgctttatcatcacagaattgatttgataaaaatagagagatggaggagagagaaggataagagataggctgggcgcggtggctcacacctgtaatcccagcattttgggaggcccaggtgggcagatcacgaggtcaagagatcgagaccatcctagccaacatggtgaactggaataagacaagtatgctcactctgaacactcctattcaacataccactggaagtcctagcccaggcaatcaggcaagagaaaaaagtaaaagtcatccaaataggaaaagaagtcaaactatctctatttgctgtcaatatgattctatacctagaaaacactaaagaccctatcaaaagacttttagaaatgacgaaggacttcagtaaagttttaggatacaaagtcaatgtacaataatcagtggcatttctgccaataatcagtagcatttcaggcaaaaaccagtagcagattctgccaatagcatttccccaacaacattcaagttgaaagccaaaccaagaacacaatccaatttacagtaacccctaacattaaaatacgtaagaatacaattatctaagtaggtgaaagatctctacatggagcactacaaaacactgctgaaagaaatcacaggttgcttaaacaaatggaaaaacattccatgctcataaattggaagaatcagtattgttaaagtggccatactgcccaaaggaatctacagacacaacactatacccatcaaactgccaatgtcattttttacagaattagaaaaagttattctaaaattcatatagaactgaaaaaaaacaagcctgaatagccaagaaaaccttaaaaaaaacaaataaaaaacagaacaaagctagaggactcacattatactacttcaaactatactataatgccacagtatcaaaaacagcatgatactggtgcaaaaatagacacatagaccaacgaaacagaatggagaaccagaaataaagccacacacctgcaataatctggtctttgacaaagttaaaaaaaataataataaatgggaaagcactcctgattaaataaatggtacttggatagctggctagccatgtgcagaagaatgaaactggacacatacctctctccacatacaaaaaataactcaagatggaataaatatttaaatgttaagacctcagagtatcagaatcctagaagaaggccgggcgcggtggctcacgcctgtaatgccagcactttgggaggccgaggcgggtggatcacgaggtaaggagatcgagatcatcctggctaacacggtgaaaccccgtctctactaaaaatataaaaaaaaaattagccgggcgtggtggcgggcgcctgtagtcccagcagctctggaggctgaggcaggagaatggcatgaacccgggaggcggagcttgcagtgagccgagatcgcgcccctgcactccagcctgggggacagggcgagactccgtttcaaagtaaaaagaaaaaagaaaaataaagaatcctacaagaaaacctaggaaacaacattttggacatcagtctcgggaaataatttatgataaaatcctcaaaagcaatgtagcaaaaacgaaaattgacaagattgacaagtggtacctcattaaactaaagagactctgcacagcaaaagaaacgattaacagagtacacagataatgtaaagaatgagggaaaatatttacaaactatgcatccaacaaaggtttaatatccagatctatgagtaagttaaacaattcaacaagcagaaagcaaataattccattaaaaagtggccagaagacatgaatggaaatttttcaaaagaataaatacaagcagcaaaaaaaaaaaaaaaaaaaaaaaaaaaatggaaaaacgatccacatcactaatcatcacagaaatgcaaaacaataccacaatgagagacaccatctcatcagtcagaatggccatcactaaaatgtcaaagaaacagcaatgctggtgaggctgcagaggaaagggaatgcttatacactgttggtggggatgtaaattaatttagtcactatggaaagcagtttaatgatttctcaaagatcataaaacagaactaccattcagcacagcaatccaattactggctatatatccaaaagaaaataaattgttttactaaaaggaaacatgcattcatatgttcatcacagcactcttcacaatagcaaggcatggaatcaacctaggtgcccatcaacagtgaactgaataaagaaaatgtggtacacatacaccatgggacactaggcagccataggaaagaatgagatcatgttctttgcagcaacatagatgcagctgaaggccattatcctcagataattaatgcaggtacaaaacaaaacaaaaaaacaagttataagtgaaagataaatattgagtaccaatggaattaaagatggcaacaatagacactggggactattggtggggagggatgaagaaataggggaagggtgggaaaactaactcttggggactatgctcactagctgggtgatggaatcaatcataccataaacctcaacatcacacaatatacccatgtaacaagcctgcctacgtaccactcattctaaaataaacattgaaattatattataaaaaagtgataagccctaagccaaaaaagtaatgaaatgaagcaaaaagttttaactgaaatatttaaaaattagtgcaatgtttaaagcaaaatcaaaaaggaatcaaggaaagaagaaaggacagaaaaaagaagggacaaaagaaggaaggaaggaaggaaggaaaccctagaaaaacataagtatacaagaagaaaaatataatagtaattggctctatttgaacaaatttacataaggctaatattttatactttcaacttttatagtcaatctattcacaaaagatggaagacagtatagtttcagaagaatgcctgaatattattaacaaaaaagagcaaaaacattactacagatggcagaggctgtgtgttagaagggaagagagaggtgaaggaagataggagatataattttaaagaggaaagtcaaaaaataatatcattagttgaagaaataagaaatgcaggtttgtattaaaaatagggatatacatttctgggatgtgtaaacatttctggtaagagaaaggcaggtattctctaaaaactgataaataaattagactcaacaatattaacacattgttgagacatttatatgtgtcagaaaaaaatataaaaatacacaggtttaaagaagtaatgtgttcttttgagtatgacattgagagtaggaaggatgtgtgactgggatggtagttttgactttgggcttattttatgtagataacaaagcaaacctctactcttttgagaagttaggatatttagtctgagaagtttgagtgtggagtatgaggcaactttggctaaaaatatagaaggttttctaataaataacactggaatgaaccatcttgtaaagaagtgaattaataagatatttcaggaaagtttcatgtatataagagacattacattcgaggttctatggtctaacgtgcctttagcggaaggattttcaaagaactgctactagatggcaaactcaagttattttttaaatatgatattttaactgaatttttgcaataagaaatctcatagttatccttttccttctccatgtttatcttatgttaaaagaattcagcttttagaaataaagcaacaaatttaacttaactcaaggcaaaataaggccttatattaaattttcattgaagataattttgatgaaaacctctcagagaaatcaaaggaaaaagaagctggaagtacataaacaaattataaagtagaaattggttctgtgaggagagatttatttggtttaattttctttgggtaatataaaatatataatctattttatgaatttttttgtcatttttcatattaggtttgaattcatacctgaaagaactagatgaatgttactatttcttttgagcctgaaatttctttccaacacgcctcacattattgaaacattaatactaagcagtactgtctacacctgaaggagcagccatcacagagctgggtgataaatcactgctccctgatgtctggcaatgtccaaaatgcaagccagttctctggaagtgttggtgctggcacctgccatcccacttcactcttcacaattgttggaacagccttcttcatactgagcccaattctagaccacataaataaagtatacggcttttccttaaaatattatgtctttttttgtagggtgaatattttttgtaccttaaacttactgtatagttggcttccagatctaagtcatgaacaaaaaagtcctgactatattatactatgttgtatgatgttgttttaattatattatagtattatatttatcatattatatgtaaagtaaaatatatcccttctcagtattcacccaaccatcccaacggcacatctttaagtggcacaaactttcactgtttaattatttaggatcatcccaggtttgttattaatggtttttaggctgctgttctttatcactctcaagaggtgagacttccagttttatctctgacttttacctctatggtcttatacctcagtcattaagtgttagtgatcaagacatgtttttaaagtctatgctttttcccactcttctcattttgcctgggatttcaacatctatcacccaagctctatttcttaagatgtgacaaacacctaactacccttctacaagactcagggaaaatgtttcctgtgagaacacattttctgacagaccacagataactacctactcctttctactcctactgaagcccataatcatatctatgaaggaagaacttattacaagggactcctagatgacttcctatgtcctctatacaccaaatcatgcataatttcataatctcttcccattacttttaggataaaattctaaagatttaacacatttagcacgaaatataaggctcttcatgatgtgatctcagactgcttctttagatgtactgataccccacatacatgcataagaaatctctctcatgtcaccccagcaacccatcccatttccacgtagtccatcaaagaagcagtgaataattccttcatgtcattcagatctaagtttaaataccttactatatttattggggcatttattaactcctgaataaaatggtctacccaatcactcatatcccagttttatatcacttagcatttatttctgtcaagaatggtaatacttgtttgcttttctctcttcttccattaaaaagcaagtggaatgacactaggatgttgtctctatttctgctgaattcctaacacttaaaatgttggttatatttttttaagtaagtgaatgtatgaatgctggctttgtgagaaatgaaatgtttcttgtcaagttacctaggaaatattatattagcatcttgcatttcccccttttcacatcaagtatctgaaagttgaaaggggctgaattattacctctcccaaagtgcccaatattttaggattcaataaatgataaaatttttttaaagtccataatttgaaaagaagaaatgaaattttaattctcataaattagtaagaaaataaattcacgatgtactgagtgaatttagttttacagagaaccagttccgtggttcttattgtttttcttttggaatactgtaaacttcaaggaaggacagactgatatctgcagttctgccctgggagcctctgacccagcccatacttcctgacactacaagatctccctcaccacgtcttcttctaaatccacttctcttgtatttctttttttactctcagcttggtaaaggaaactaatctgataatcctgtctgagaaaaaaatattgatatctgataatggcttaattcatcttttacaaaggtttgcaacagccagtaacccaaaggaatgaataaacaatttaatgttttgattgtaatttccagtagggaaggtgttaactttcttccagctccttgagttaaactacataaaaagatgttctgcataaaggtggtctagattaccaaagagtggcattttcttttcatactattagtttattaagacttaatatttttcatggtaaaaatagtaatagtaataacaataatagtaagaactgaaatttattgagaatttgccatgtaccaaaaactgtgccaaatgcttttcaaacagtatctcatttcatggtcatagatgtactatagaaaatcacttttatcccaaatttacaggtataaaattaggcttcaacaggttaaatctcactgctgatcagtggcagggctgggatttatattatgatctgtataattccaaaaatcatgattttctacagcctctcaaaaaaacccatatggttttacaactgggttatgatttatctgtcattaagccctaggcatgaatcccttactaatagccttgagtggtgacaaaaccttttctttctgaaaatgaaaaactaaatgacatcataaagtagcaacttacatttttatccagctctaatcgttaccacatcatttttcttaatggatcaaaatctaccaactatataatttgcactatttaatcccattcttgctcctaaacaattaagataggaaaaaatcaaaaatgtaccctaaaaaacttctaatttcatattctaaagatgtatggaaatcttttaatagaaaaaaactagataaatcttaaaaccatttttatacatttttaaagtcactatacctttttaaaattaagggtcttaaagtatcaatctttcaaactttcaattttattacccaacattctctaaaatctatgtgtgaaaaattattttaaaaatttgacaattaagagaaaaaagacatgatgtgagaattcttaagataaaagaccacttcagttacattagcaaatattttgatttaacatgtcttctaaaatgtagcattcatatccttgtatttctatctctattttgatttaatttaagttatgccataaaatagatcatttacacttggatgaagatatcagaaacttcttttattttccagaccaaatgaaacttttcagttgatttctactgagcttcagggagtattttgatagtttgggatttatttattgttttaattttaagagctaatgagtaaactaagacacaccattgaaaacaatactagctgaatgcttttaaaatgctgaaaatggccgccagaaaatatatttattcaaatgccactatgttcttttttaaaaatgtcctcaagttatacttttttaaaaatcagagacctgtgagataccatctcacaccagttagaatggcgatcattaacaagtcaggaaacaacaggtgctggagaagatgtggagaaataggaacacttttacactgttggtgggactgtaaactagttcaaccactgtggaagacagtgtggagattcctcagggatctagaactagaaataccatttgacccaggcatcccattactgggtatatacccaaaggattacaaatcatactgctataaagacaaatgcacacgtatgtttattgtggcactattcacaatagcaaagacttggaaccaacccaaatgtccatcaatgatagactggattaagaaaatatggcacatatacaccatggaatactatgcagccataaaaaaggatgagttcatgtcctttacagggacatggatgaagatggaaaccatcattctgagcaaactatcacaaggacagaaaaccaaacaccgcatgttttcactcataggtgggaattgaacaataagaacagatggacacagggtggggaacatcacacactggggcctgtcgtggggtggggggaggggggagggagagcattaggagatatacctaatgtaaatgacgagttaaggggtgcagcccaccaacatggcacatgtatacatatgtaacaaacctgcacgttgtgcacatgtaccctagaacttaaagtaaaaaaaaaaaatcagagaactgcttaaatggttcattctaaaccattggtttagctattgaactaactttggttgctattacatttttagacatataatcttaacagattataagtttctttcttttgtttctttccttatttttctaagaggatgaagccaattcagtattatatttattgtttagaaaaaaatgaatttagaggtttcttaattttttttatttttatttttatttatttaaggcatctgctggtagagctgtcattgctcttactttgttataattcattgaaaatggtcaacgggaagggcaatttagttgctttgacttgcaaacagaatattttccctaaatattaccttctagcatttttacaagtccaataacgtgttcatatatgagtcatagagcatatatttttagattgcaaaattatactagcatgagacaaggtactttagatttggattgtgaaaatatcagttttaaatttatagtaatacttgcttcagtttctgtatacattgtcaagtttattgcaggaaatgcggaagagttaattttatattttattcattattcaaataattattaagatgtttataaactcatcacaagcattgctcatttttattggcttgcaatcagcacttaaaatcctattgtaaaactctgcaacacatgaggtttgacagataatataagtttacaggaatttgaaagatctcacaaagcccacagaaatattttcttggaagtttttttttttttaatgttaactatacaatgctgtttagtgatatactcctgctggaaaaacaatttataatttttatatttctcattgcaatcctaaataaatacatatattattcaagttttctataaaaattaagtgtttagttaatatcacatgtatctctctaaagttacatgaattcagagtaaattattataatcatccatattttaatattcaacttgctttttgtatcagtggttaatttggtaaagttttaatatatttcatctttatttcctaaaataatattaaagggatggtaatatgaaaaaaaccacaatatttatttaggatcgtaaaataagatatttttcaatatgcagaaggcaaagaaaaacactaagtatgtaaaaagataataatacagttaatttaatttaaggaaaatataatatccaaatctcataggtgttctgtttcaaataatcacttaacagaaattcacagcagcaaaacaatataactaccgtagtaaatacatacatatatataaatagacgaaatacacaatatatcttatttttgtatatttactaatcaaaattattttaaaataactttatagcttcatgcttcatgccttctcattgaaacattttccgataaaattgttgatgcttccgacaattcctattatcgcaatttgatatttaaatcaagaactacctaaagctactaaatctttgccactagcctaaatgaggcaatattcttctattcccatgaattattcaagtttataaaatggtgaaatcagatgacaaaatattgtattttaatatggactatgtattcttatataagctattacgaatcaaaagaaaactggaagtaaaaatgaaacttcaattagttttattttttctttacattgattaccggaagcataatttctttatttttaattaaattcagcaatgtaaattaagtatactgtcacaaattcatttatcttcactagtaaaatctccacagttaaaaacaaatagcaatttcttattctatggttatgtattgcccctttcttttagttatctatcttacaaatttaggcagattctcatgggtggtaaaagagtggtagatagcactgtttaatacatcctcattaaaagcaaatatgtattatgttgtattagtgaccacaaatgagcttgattttatttcatgttttgtatacataatttccatattcttacattcttttaattctttttgtgcattttggttacttattaattaaatatattctacattaattttattttattttgtttgattttgatatatttattattgcttttaatttaatttagtagtagattatattgctaaacatgtgagttaaatccaggagtaattagagcatatttcatatgtgtcactttattaagtgtaaatttgaaagggaaaatatataaataacattaattgtaccatttagaatattctaattttgtattagcaggtaaagcaatgagaatatatacgctttgacaactaatccatagagaaacgagagttgttttttttttctgcttgtgcaaagcaaattagaaaaacaatcaatatttcttttccagaaacatttgctctctgccccagatttatgttggaatgtttatttggtttgtatgactctcaagagatgtggcttaatggaagtacttggataacagtcttagaaatctaatgacaattgtttgtttttcccaaataaccacttcctaatgattattattgagccttgcagtgttaaaatgacatgtttagtttcagatgagcatttaaaaattatttcagctattctgttacttggtataaaataaatgtcaattttttgacctattgtagatgttcagaagcagtcaattgttttaatataaatgttgcattcttcacttatgcttcacacatggatgaacaacaatttgaagctactagatcaattctatatatgttatttgcagtaagtatacattcaagtacagatatttatttttttagattggattgtctcttaatataatttaattcacagtaactaccaatactgaggattatgaaaagttttgtcctccatgtaaacatgtattgatatttttccagatttttccacattaagttctcattaatcattgtatattccagcagcatatcaaaaaattaggaatttatttagaacttagtagagctacactatgtagagtgaaaaacaaaacaaaaccttaccccaattcacaaataagtgtacaatataatattggcacatttctaattttgcaatcaaaaaggattacagttcaatcctgacttgactactttgttctgtgcatgagcaaatccaaagatctctatagcttattatctgtaaggtgggtaaaagagatgtagcattaaaacaattaaaatagtgcttgaggctgggcacagtggctcacacctgtaatccctgcattttgggaggtcaaggcaggtggattgcttgagcccaggagttcaagaccagcctgggcaatatgtcaaagccctatctctacaaaaaatacaaaaattagcctggtctgctggtgcagcctgtattctcagctacccaggaggctgaagcgggagggtcacctgagcccaggaggtcgaggctgcaatgagcagtgatcataccactgcactcttgcctgggcaacagactgagaccctgtctccaaaaagaaaaaaaaaaataataatgcttgacacagggttccctatacagtcatttttattctatttattttattacattcttcatgtcaaaatggcaaggttaatattgcttgggctttgaagttaagaccatcttgactctgctaactatgtaactgtgagcaaattatattactgatctgagcttgcctattatttagaataagaataatattttattttacataatattattggaggattatgtgagataaaataaatatatttttatattaagcggccaacaaatatttattttttaccctgtcactcagctgaagagaaaaaatatgagatctaatgtacagcttggtgactatagttaataatgtagtgtatacttaaaatttgctaagagggtagatctgcagtattctcatcacacacacacacacacacacacacacacacacacacggtaattatgtaaggtgatttatatgttaattagcttgattgtattgttcatttcacaatgtatacctatattaaaacatcacagtgtacacgattaatttatacaattttatttatctattatacctcagtaaaggtgaaaaaagaaaaaaatgaattacaaagagaaataaagcattataagacttaaatctactaggctttttaataaaatggtaatatttttattccagaaaaggtagatgaaattgttgaagagtaaataactagtttagattctaaatacatgtggatcatattttatgtcacaaaagggaaattttgtgtttgtaaaacaaatatatctaatcacttataaaatcaagaaaacccacttgagcctttacatttgtcagtgtgtatcgtaccattttctatttcatacaaaataaaacagtgtgaacaatcagaaatgaaagcagttaataaataattaaaggcaaaatattttaactaaaaaaagtcactttaaaggagccttacttcactctttaaacaataataacaaaaataagacaataagctagttaagaaggatgattcagacaattgtcaatttgtattttgatgtcaggaagccttttatattactgcttcaaatagcaggacacttgtcagatggctcatccaccctttctaaaacttttccctacaatgactaaactatatctttataattagttatgtatgtactcaagataatagacatgtaaggactaatgcaaaacaaactataaaatatgcatttaccattatcttattatcctatttttcatttatctgtctttttactttgtttcccaggaactgccctcatttatctcccagcactatattatagtcctgtgacaagccatattgaagctgaggcaaaaggaaaaatcagtaatattgatcttgtctttgttttaaaatttattttgttaattttggattttttaatttttttattttcattgtattatattaaaatattatttatttagattgctgagttgattgatgcatactcaaactttcactcaaagtgagtgcctcacttgcttcagcctagtcaccaccctgctaacttttgcttggtttgtactctttcttaaagctgtgtaaacctggtgttctttgaaaacttgtggttcatgagtttgcttgttaatgcaaaccaagaacatcacatctactgtagtggaattgaaattatataaatcaaatttgtttaagtggaaaaaattgaagaaaattgaggtaaaaagaaaataaaatttcaaaattgatgaaaactctgacttaatatatttaaagatacacaatgatattgttaccaagaaggaaattccacctacaaaaaaaattgaatatgcagagaactgacaggagttcttggttttcaatcaatctgtttctttgttttctccactctactccatctttcataatttgcacaaaaggtatctttgctgcaagttcctgagactgaggaattccatagcatgggatcaatgatattatttatctttccccactgacagcttaaggtttattttttttcaaacgtttattatttacctctagtccagaaacttcccagatagcaaaatgttgttgcattgttctagacctccaacctcccattttcaaagtttgtgtcttgaaatgaaaacaaaacactctttagtgtcattttattggagctcaaggatgggaagtagatgtaagtgttcaatgtgccacctttacattaaatttagctttataaatgtttaatgtaccattatatgtaccaataccaataatgtaccattagtaacattaatataccattaattaatggtatatgtgaaaaacctacactgacatatttatgagagaaaacactgaacatgtttctaaactttgagaatacaagaagcaaatcaattattaccactgtgattcaacattgtaatagaagtcccagccagtgaaatagggtaagaaagaaataaaaatgcaaatgttggaatggaagtcttgattatcagataacactagtatgtctatagaaaagtctatggaatcgacaataacagtaatagaatacttgaatttgtaagtaaatttagcaaagtcataggattcaaggtcagtataaaaattaattgtatttctatacagcaacaatagaaaataaaaatattaaaatattaccatttataatagcaccaagaaacatcaagtgggaataattgtaacaaaatttgtgagattcatattatgaagactacaaattgcttcaacgagaaataatataagacaaattaaatataaagacaaatatcatcttcacaaacgagaagactcaatgtttctttagatcttaattatctttgatttgttagctttaatgcatttttaatcaaaatgttacaagaagttaaaacaactcataagctgactttaaaataaaatagaaagggccaggtgtggtggctcacacctgtaatctcagcactttgggaagccaaggtgggcatatcacgaggtcaggagttcaagactagcctggccaacatggtaaaacttcatctctactaaaaatacaaaaatcaggtggtgtggtggtgggtgcctgtaatcccagctacttgggaagctaaggcaggagaatgacttgaacccagggggcagaggttgcagtgagccaagaccatgccattgcactccagcctgggcaacagagcaagactccatttcaataaataaataaataaataaataaataaataaataaataaataaaatagaacaagatgtagaatggtaaaaataatcttgaaaataaacacacttgttagagttacataaccttgttccaaaacttgctctaatgcaacaaaaataatagaaaaatttggccgggcgtggtggctcacgcctgtaatcccagcactttgggatttactttctatgtttctaagataagggctggttcagtggacatagttacatatcagcagaatcccaactccttaaactagtattaatctttcacaaatcttgtcctgatctactttaatatgtaacttttatccatagcagctgtcaaacataatattttctatcctcttacatttagctgacatgcctgccaaaataagcaactaattcttactaaacaccttcttcatacctttcctgattccatttcctatgccaagaatccctcagttttcttcaaagcctaggttcaaatcaacatctgcaatgtacttttgctgcttccctcagctgaaaatgatgtctcattcgtcttaatactataaactttataatatactttcatattaagtaatacttaatacttcttaatggatattgacattttcaacttacactttatagttaaagctctactgtattttaaagtgtatattaaatttccccactgtgtatcatttccatggtgttagagttaaaaatttacaatggtaaatcccctgcagatctctgcacagtttcatacatagttaaccctcaacaaatgcttgtaaaataaatgaatggatgcttttaataatcataggtgtttgtgtgtttctttaaactatttcaaaagatatccacagaaaatttcataatttattctagacaatactagttatgtattccatgtcataggacacaggaaatgctacctacaaatatagacttattgtagactgagtattttaagctgaaggaaattaagaaaaccatagaagcagaaagatctctctgaccttctcctgtcccctcttttgaggaccctaatgtgatatgcacttactcatatctatagggtaggaatgttacacaaagaggccaaaaagaatctgaacaaacaggccttgccaagttactccccagtttattgccattagtacgtatcatttttatcaaattattcttttacataactgtccattcttcattccaccccatggataaaaatacatttttcaccatttctctgggactttattgctgaaggctcctgtgtcatgtaaaactttgaataaataaatttgttatacttttctcttgttaatctgtcaaggagtgccagccagaaatcttgagaccaatgagaaaaatatattggcatacatatggcatttaatatctaataagtttttagtagcttttgttgtctactgaggtgtgatgcttactgaattctctatttatttacaaagtctatctgtaaatattttgttaaataaaccagtgattacataacttttggatctgtgtgatagtcttatttatagaattatctggttttcattatctgatttcattcagtcaacaaaatgttttgattacttattatattacaggcactatgctaggcactgtatatagtgtttaagttttgtgggagagatacacaaataaacaataaacaattatacttattatggcaagtgtcatgaagtaaaagaagtctatgagagataatggctagattgaaatgttacaaaaggtctttccaaagagatcttcaaactacttcagcagagtctgagaaatagggagctatcatatagcaattattatccctatacatgtatatatatgttagcagtggtgaatccatgtgggtctgcagcaacctcaactctggtcttcttagaagaaagaattcgacctggggcaaaaggcagagtgagaggccaaggcaagttttagagcaggggtgaaagttaattaaaagttataagaaggaagggcatgaatgaaaggaagtaaagtatacttggaagagggccaagcaggcaacttgagagattcaagtgtgaagcttgagctttgacttggcattttgtacattggcatgcttccaagcggttgcatcccttctcccttgattcttcccttggggtgggctgtctgcctgcacagtggcctgctagcacttgggaggggttgcatgagcagtgtgtttactgaagttatacgcatgtacaactgtggcatttttcccttacaagtcgaatgtttaaactctaccattttgccccttagtgacttgaggcatttttcccttcccagttgagtattcctagaggaaggtcatataccagttaaactctaccattctgcctcttagtgtgcattcttgagcacacttactcaacttctgagatcttattaggaaactgctgatcaccagtttctggtgtttctatctattaggagactgcttttccctggcatgggctgcaaccaataattcttttagagagacagtttaacaactgcctgatcataacctgatcgtctcctggcattcctggtggttggtagggaggggcctctcctgccttgctcatgtctgcctgactacctaatgtaacatgtggagcagaggaaaatttacgaaagatagaactatttaaaactaccactataatctgagcagcaaatgtttgtgaaatcttgtaaatgtctctaacaaatacaacctaataggttgtatatttataatagtatttataaaaacataaaaaacacaaaaggtctaataggttccctacagtaatgccctaattatgctttaattcatcaataagaaaattctggtttatgttgagtattccacatttacacaactgggacaaaattaaaagagtataccatgtaaatgcagcgtaaaggcatcatttgtatctacttggaagagtctttctttgctacttcatgaaattatctcatttgttttggattgcaatacagaatataatgaacaattttaaattataaaaatagaaaaaaaatcagtttatgttgctcatttacccacagtaaagacttttgtcacggcatgctaaaaatactttagaaagattttactgattgctttcatttaactgccactttgccatttattggcttaattttgcacagaatgaagcacacttaaaactcaaggaaagatattaggttttagttttacacactccatcatgaaaataataaaatgaagaacggatttttttttctttttttggtatttgccaagtatctctcaaaaaaaaagaaaaaaaaagccccaaatctctcaagtcactcaagacaatctaagcacacaaaaataagcatattttccttttatattcctctcgaattcaaaccaatatctatctcattttacaacacatgccattgtctttcaaaatatatgaagtaatcaagtaaaatttccacagtaaaaagccatatcgtaattgggaaaaatctttactttttaaaggtttttttttgtgtgtgtgtgtgagacttgcttcaaagcagctctgcattttttcagtgtaaattaatgagcttaagtaaatatccttttgtttaaataaataaaggagctatgaaagtgcatccatcaagagctaggccattaaattgaaacatatctataactacttaattatcagaataaatgactgtgctaaaagaggacaggttgattaacattttttttgttacaaacacttgcatattaagtgatagtcaagtttttgtgaatccttttgctgttgaaatgtttcaagggatcatctaacatatgttcaagttaccagcagaaaaaggctatatgaaacaagcatacatcatccaatagcatgagtctgacgacccctgaatatgacctgctcccagaggaaaccaatataatgctctatcgcacacagagtagtatgtatgaatgacagaacctcctgataaattaatgacaggtacatctgaataggattccttctaagtcacttatctgcagccaggcaaacttgtctcaccctcactttcaaagataaagccacatggcatgtttccttagcagattctcacaaagcaaacagcccccattggccattattggggaaaaaaattccccttattatttcaggtaatgtgacagcaaatggtataaagtgaaaactatcttccagttgaaaattcatcatttacccctctctctcaactatcaggccttacgtcctctctaactttcacaggctctgtgcctcttgctcttttacttttatttttgacagttctgctatcccagagttgtagccatggcagggttcaagaacaaaacagcaggctatcaaagacaacttatcacaggccaaacagtgagcagagatggccaccattagcgagtagccaaaagacagactgatgacagagcaaagaagaaaagtgaaccaagcttcatcattaactgatagcttattctgtttagaaaatccaagagaaaaactgggataataaatatatgtcctaagtatttaggcatattagtcacagagatttttaaattatgttaaaaaaaggcatggaaaatgtttatttgtgagggatcttatttacacactttatcaaccataaatacattggaatagcaaaaccatgtaaaaccatatgccttaaactgaatatcagttaatagcacaaatacattatcttcttcagagttaagtatctattattcttttaaactaaacagtaaaacaaacatatcaattctcactttctgtattccttataagaatgcagaaattgcacttaatcaagactatctcattatatatcttaacaaatgccatatcatattaccaggacagttatatagcatagtaaaattcagtaacacaaatcaacaggactcacgttttagtttctgtagagatagcctttctcacgcagaatcagggctgtgctttctgggtgagtctgtgttaaattaaaatgacaaaaatcttagtttctcattccactgtcacttagaatgcatgcaaataaactcccagttagtcaaggggaaaaaaattgcattaaagagtcctgatttgtaaatgtggtcttttcaaatgtagatgatgtttacccctctctctcccccaatatctttgcaaaatttcagcccaatgaactcattgctgtagaaacttaactaaggctatggtcagttaatgaaattcaagtctgggattaagctccataaacatgcaaaatggctgggcatctggaattgggagagacatggatgatgctggaaagaaaaagaaataagccatgtaacttagagaataaacaatatgatcaatttagctaaattatctgttgtcctatatatgaggtgattcacagtaccctaaatgtttaagaaataaaagcaaaatgttttgaaaatattaccaataccatatccaatgacactttgggggatataaatatagctactaaatttaccttctttgaaattacacaggtttaattagattggatgtatttcctttatagccgcaataatttaaaccacattaaacaccattcaaaatatgaaagaacttcagttagtaggcaataaaaattattatttctggtctatttagctactatgttatagtgttacttgatttgcaatgtacttcaaagtcatcagtaatttcttagaagttttagcaaatgcagaactaagatgttcaattaaaacattaaactctacctgtgaacctccatattataataatgttattttattttttatgagttaggaaaatgtaaaaatgtattcagaaaaattcatttgaatatttaaaattttaactgctatgtattattccccagtttatttaaattatataaatgcatagtcataatagtttttccattattacatgtcaagatttttatactgtattatggaatatttttgaattttctagttaactatccattaactcaacaaatataaatgtagatcaggaagcccttaacattccctctgcttgactgaactatatataggtttctttctgactctaggcccctaacctctttttacttagaacatttatttcagaacacttgttattttattatttttctacccctttgagatgtaaatcttctctctgcaccttgctagttttacaacccagtaaagtctttctctaggatccagagatacatccctttgaaatgtaaacataaagaaaaataatggccttatctcccagtctctatgggagagtataagcctaacttagatgagcaatattagcaaacacagatggcctgataacactggcaaatcccctcactaatatcctctggtagaatggtttcttggggttggttccaggaacctcacagataccaaaatttgtagatgctcaagtcccttaaaaatcatctctagattgaggagagccaaaattacctggtgaccatccagaggcaaaactctttatctgtggaattcagaagtaattatactgttatttaaagcccacatcttgttccaggtttctttgcaaaaaacatatagtaactagaatttctatacatctctggaatgcatgactatcaaaactcattgtgcaacccttactgacattaaggcaccaaaatgtctacaaatgtaatcatttatcatgacctacatggctaatatggtccaaaatactcttaatctcccgctttaaggtccatatatacctctaaagaaaaatccaccatggcatgctcagtcctctcttgctgaagcgtcccactgcactcttctgcagtgttctttctaacaaaaccttccttttttaaacctatactgatgttgataaattcttcttaccaacccttgcgtcaaccactttccaatgcctgtactttgccacctccctggcatagattacttaataccatgtaagtgttatgtaaatagttgctatcctgtatttttatttgtattatttttattgttgcattgttactttttttgttttccaagtattttttattcacagttggttgaatcccatggatgaggaacctgcagatacagagagacaattatactttccactagttcacctaatttgcgaacaatcctaccaccttgtgtttcagtagagttcagttcaatatctccccttctttgtaataaatgccaaatacactactaatcttataaatcttccttgcctgtttaactctaagtgcaatttttctttcacattctcaggtgtctattatgtgccagcaggcactctgctaattcagtgctgtgcaaggtatgccttgataatacctactatctagcacaagactgatacaaataatttgatatttaaaggacagtgataatgctgtgtctgggaaaacagaagggaggtgcctgataaaagaggaacagagaataaaaagtataatagaggaaatatcatcaaagccagtcacttcatggtattatccaggcaattttcagtagggaaaacactccaggaggacatcagcacatgtgaaaacctagaaagaagataaacattacagtatgaagacaagaaaaatcagaatggctacagtgtattcagtgaaatgggaggggtgtcaggaaatgaggctaaaacaaaataagagaaaggaaaggcacttatttttcaatatttgtatgcgagttcacttttattttaatcaatagattaatgagcaagacaatataacttaatattcactgccaagggctttggtgtcagactaacaggttttgaaatttgactctacctctcataagttgtataatattaggcaagttgtctaacctctctaaacttcagcttcttcatttcattcataaggatagtacatgaagttttatgtggattaaagggaattgtacctaaaatattaacttaagtcttggtacacagaaaatgatcgatgatgatgatgatgtggtgatgatgatagaaaccaatctatgatactgacagtgaagtacacatatactatatactaggtcctgggagttacaaagtgtttgaagaaaacagaaattgctggagtgtttttaaaatggaaatatattatctaatttacattttgaaataatattctgatgtttttaaagttgggaagtggctgggcatggtggctcatgtctgtaatcctagcactttgagagtccgaggaaggtggatcgcttgagcctaggagttcaagaccatcctgggcaacatggcgaaaccctgccacttaaaaaatgtaaaaattagccagttgtgatagtcccagctacttgagaggctaaggcaggagaatcacttgagcccaggaggcagtggagatggcagtgagctgagatagtgccattgcactccagtctggacgacaggaatgaaatcttgtctcaaaaaaaaaaaaaaaaaaaagttgggaagtgaatgttataattcaggcaagatacaatagcggtgtgagaacagatagtagaagctaaaactttgtttgagtaaatatttgcagatacattaactaaaagtcgacatttactgaaatgatgggtttataataggatggcctaataataggataaacatacttctgctttttaactgttatctgaatgtaattattaatagcagagccttctacttataaaattatccttgtttggatgatgaactatgttgtagaagtctttgtaggaatcacttcatatgttttataagagaattgtttaatcaagccaatcaatcgagtggatgacatcttcaaaatataatatagcagcaatcataagagaaagagctttcaggtgcaatgttataaccgcccaatgggttcaccttgcctgcagcctagacagagctgatttaccaagacaggggaattgcaataaagaaagaataattcatgcagagcccactgtgtgggatactaaagttttattattactcaaatcagtctccccgaacattcggggagcagaatttttaaggacaacttagtgggtaagggtaagccagcaaactgggaatgctgattggtcagggatgaagtcatagggagtcaaagctgtctcttcccgctgagtcagttcctgagtgggggctacaagatcagatgagccagtttatcaatctgggtggttccagctgatacatcaagtgcagggtctgccaaatatctcaagcactgctcttgggagcagtttagggagggtcagaatcttctagctgcgtgactcctaaaccataatttctaatcttgtggctaatttcttagtcctacaaaggcagttgagttccccggtaagaaggaggtttgttttgggaaagagctgttattgtctttgttttaaatgataaactataaactaaattcctcccaaagttagttcagcctatgcccaggaatgaacaaggacagcttggaggttagtagaaagatggagtcggttaggttagatccccttcactttctcagtcataattttgcaaaggcagtttcagtggctgacgcctttaatcccaccactttgggaggtcgaggtagctggatcgcttgaggttaggagtttgagaccagcctggccaacatcgtgaaaccccatctctacaaaaatacaaaaattagccaggcatggtggcacacacctgtagtcccagctactcaggaggctgaggtataagaaccgcttgaacccaggtggcagaagttgcagtgagctgagatagtgccactgcactccaggctgggtgacagagtgagactccatctcaaaaaaaaaaaaaaaaaaaaaaaacagagagaaagagagaaagagctaatatttatttgagcacatttatctgtcagatgctgctttatgctgataacatgcattatgtcatttaatgccgaaaacaaccctatgaagttggtattattgttattattgttatccctattgtacagatgaaaaaattggagcacaaagaggttaaacaatctgtccaagttacatagcaaatgaaggcacatgaatccaaaccagagagtctgcctccagagtctgtgcatttagcccctatgcaaaaagtgccagaaatagagtagttttaagagcaggcaatgctcatatagggctactattatctaagaagatagtaaagaatcagctgtgggcaatagtagaataaactatgtcggcaaggtagaaagcacaaagatgatgatatcagagtagcttcaattaggaaatgatatttcagatagattttaaagaatgaaaagaatatttgcctccttaaaaggtctacttcaaatgaaaatttataaagatacatgtttttccttgattattccaatcaaatttgatcactcaatcttctaaatgtctttgtattaaacatatataaaaatatgttttcttaccacagacagatctgagatcagcaacattctgagaaacttccatacacttacattatttatatgaaaatttacaattcaaactatttatcttagcctctctgattaatattctatcttatagtatatacacacacacctacacatgcacacacacacacaaagacacacagagcaaattttagtatccaagacactcttgccacaatagtttttcttttcctcaagtacgccaaactttggcctttttcctttctctgtttaatcttttccaaatcttagattggtagctctttcttatgtttcttctaggctacagtacatagagcagcactttggttttattttttaaaatcttctggggacaaagcctttatctagatattgcaacttctcctctgctctacttcctgtaaagatgcttgtccccatttgaacattgaatatattaataagtgagtagataaatttggcttaattctgaagttcttgtccactaatataagttacaatctccagattagcttttataaataacagaagagttcattttgcttcatgtgcttttattctttatttcagtcagatattaagtaaatcatcttaaagaacataacataatttatatcttcaaattacttctataatttttatccacaatgtctgacactcagaaataatcaagtaaaagggaagtcaaggcttgattaaataccaagagaaaaataaaataaccagggaaattagaagacgttttgcatcagatgaatgaaaataaagcagtgtttaaaaaatgtttagcttgaaagcctatattcaacaaaaagaatgatttaaaataaccaaagcagccacattaagaaactaacaaagaaaggctgatctaatttccaagcaagaaaaaaagaaggaaaccataaagattctatagaagaacaataaaatagtaacagaaagataaaattgtagaaaaatcaattaaagcaaaagttgactcacttttcagataaaagctttgataaattttggttaaactggcaagcagagaagacagaagacacaaattttaagaatccaacataaaaggatatcattattgatgactctttggaaataacacaggttataaagatactgtggcttggaactagaagacctacacagtggaataaccaaatagaagaatcctgggttcctcatagagtgaacatgatagtgtgtgtacactggagagacataaaggagttcagaagaagtcttcacaagtaaacttttgaggttactctctcaccttaaggcccaagtttaacctggttgattttaagttctttaacaagaagtttccaaaatatttaaaagggcttataaaagtaaatatttaaaagggcttataaaaaaatataaaagtggccaagatggctgactataagcagctagtgcttgtggctctcacggagaggaacaaaaggggcaagtaaatacaacaccttcaattgaaacacccatgtactcacattgacattaatcacagaaacaacttgacccacagagaatgaagcaaagcaagacaagacaatggcccacctggcagcaacatggagtcaggggatcctccccagcccagggaagccataaatgaatgagccaccccaggaaactatgcttctcccacagatatttgctaccctagggtcaaaagatctccttgtgaacccactccactagggccttcaatcttcagtctgtcagacagagctacatggagtctcagcagagcagctgctcaggtgtgcatggaaaccatggagccttagatacttcgactttctggcaaaagtagctgctgctctagcaaagtagaaggttagactcctgtacataaccccaggcaagaggctgaatccagggggctgagcagcaaaagcccataggctgcatttccagagcacctcacaagattagacccactggcttaaaattacaatcagctaccagtagcagcactgcactcccctaagaaggatctcccagaaggagggtcaggctcccatctttgctgttcaggagcctttgccattccagccttcaggctttggagagcctgagccaacccagggcagatgggatcccccagcacagcacagctgctctaccaaaatgtggcctgactgctgctttaagcaggcactcaatcctgggcaggacctcccagtcaaggccttcagccacacccacctgagctctccagccatcagacatctgaattgccctaggacggcactcctagaggagaaggtaggtcgccatctttgctgtttgggtgacttaaccattcgagcctttgagcattggagtgcctgaggtgacagagggctgaagtggacccccagcgcagcagagctgatttaccaaaatatggccagactgctttttttaagtgggttcctgtcaagttccttctctctgggggggacctctcaactggggtctccagccatttcttatacatgcttataggctggcaacaggtccatacctccctgaaacaaagctcccagagggagggacaggctatcatctttgctgttttgcaaccttcactggtgatgcctccaggttctggaaaatctgaggtgactagggaatggagcaagccccaagcatagcatagtagccctatggaaaagtagacagagtataacgtaggtgcttgtttccatgtctcctcagcaggcaggtcctccaggtctggtactccagccacccctgaaggagctatcaagacagtaccaactcagcaactccctggaaagagcctccaggggcaattcaaagcctctctgccactgcctatgcagtggaactgcccttgccatccttgggctaatgaaggagcaaagaccctaagtgcctcatccacacctccatcaagcttcagccaattcaaggagaggtgtcagtctgtctcccacaggtcccacatacgctccatggctcatcaccacgcccggctaatttttttgtatttttagtagagacggggtttcaccatgttagccaggatgatctcgatctcctgatctcgtgatccgcccacctcggcctcccaaagtgctgggattacaggcgtgagccactgctcccagccatggtttttttttatattgtcatatatttccagtatctaatgcaatgtcagcctcaataaatatttgatgaatgtaacttggcagttagccatgccttttcagtgaatgattcataggaaacacccaatgcaatcgattgattataattaccaaagaaagatcgctgcaaacagaatgtattacatgttgttttcctcatcatgatgactgtctttactagatagggtagaaacataagtaattcaaaaaaactaaagagtaataaaacgactcaaatgagattgagatagaaagctcagggctgttttggaagtttgtggtcactaacgactcaggattcttgctgctttgccactcttaatggcttctacctttaaattacaacattgctacttcagttccaggtaaactatataggctccagaaagcagaagacaggaagagatgagggcaaaagaaacatacatatactggttgagcatgtccaataaaaagagctgttcttgacactgacccagtaacttcagctttacatgttattgaaaacacctttcaaaaaggaaattgaaatgtagatgttttgatcaatgtatcgtcacctcaaacaatatactgatctgttagtaagatagataggagaaatataaagcatttttctcctcccttatggaatgtgtccatttttagttatttgagcatattgcatcctaaaactgttttttttaacaaaacctattggaaatatgtcttggaaaaacatatattttattgtatattttcctttaagcctattgcccaaaaattctaaacaagggaagctcagtattagaaatggatttatggttcaaaacattaaaaaattgagaaatgcattgtgtaaaaccgaaagacaaacctcacctggattccagatacatacatgaagatacaacactatgtattacactgtgtacactttcaaatatatcttcatcaaaaatcagacgagacatcaacatcttatctatcgatcttccccaactaccctcttctcaactcttatgaagcctcattcagttaattctttatgtaaaaaactattgaagttaagccatagcagcaggaaagctttttttttcttttcatttttgaatgtgttttttttataggtctgtgtgcttacatatgagtgcacgcctgctgtttggccattctttcacaccaaacaatgaatccacacagagataacctgaattgggagtttagcagtgctgccatttcttcattctacctttgtttaacttttctgtcactagttctaagctaaaaacagaataaattgccagaataaagtaagaattgcagattctcaaaatgtataccctcccccaatgcagaaagatagtctgatatttgaattcccaagggaatttcttcagaaacattgaataaatggggttgaaaaattcaaggatgcaaacacttaagaaaggtatggatggactcaatacatttaaaagaaaaacattctaaggattcaagaatgaattacaatttgaaatgaaatcatttttatatttgtgcttacttttaactttagggactattctatcacaagggactttgcttttaattgattaggtaaggcgctgaagaactaaatagactactctttttattccttgacagttttgctgtttcaagaaagaaaagcattcctgggccaaaagaaacatgaactgacttctgaaaaataacacttttaaaattttgtcaaacattgttaatacaattatatgaaattaaattatctctctctactgtttcttcttagtgtgtcagaaatactaaacaggttccaattgattgtactttacacacattgaatacagactatacaaagtgtttaaagatttgtaagatttaaaagacttatttaagaaaaatgtcattttctttaagtgttaaatagacagcaatatagttctatctcttctcggtgtgtgtgtgtgtgtgtgtgtgtgtgtgtgtgtgtgtatgtgtgtgtgtgtgtgtgtagcggcaagaggggcacattgagaggaagcacaagatttctctagaggaagctgttgcccactgcattaatacatgtgacatattgacatatttaatccatcaaacataaggcttgcttccatttagtttgtgacaatttgaacaactatgtacaggtaaatacattgctgttagctttgtattttctataaacactcctaaggagaattaagataaaatcactgaagaattattccactatttatgcatgatgttttaatgtgttccttttttattttaaaattttaacacaaaatattttgaacagacaaatatgtcacacaaatgatacccaacataatgtaatatacttcagtttcaggaaaatgttaagaacatcatacataaagctgtgactgaccttaagtttctaaagaggaatcaagctgcactcacattacttgtttgcttattttttatgctcactttcttatttatttatttatttttattttattttatttttattattattatactttaagttttagggtacatgtgcacaacgtgcaggtttgttacatatgtatacatgtgccatgttggtgtgctgtacccattaactcgtcatttagcattaggtacatctcctaatgctatccctccccccttcccccaccccacaacagtccctgatgtgtgatgttccccttcctgtgtccatgtgttctctttgttcaattcccacctatgagtgagaacatgcagtgtttggttttttgtccttgcaatagtttgctgagaatgatggtttccagtttcatccatgtccctacaaaggacatgaactcatcattttttatggctgcatagtattccatggtgtatatgtgcacattgttggacatttgggttggttccaagtctttgctattgtgaatagtgctgcaataaacatacatgtccatgtgcctttataacagcatgatttataatcctttgggtatatacccagtaatgggatggctgggtcaaatggtatttctagttctagatccctgaggaatcgccacaccgaccttcacaatggttgaactagtttaaagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgattttctaagaataatatttcttacagaaatagcaaaaagggattttagtggttaattttacttccaaatttcaaccaaatttaaatgctatttatataaattgtgcccactattttaaatcctggtttgcattataatatgcagcatcagaagaaggccacctatcatttgctatacaaatatgggctataatactaggtagtttttttgtttttgtttttgtttttgttttttgacagagtctcacttcttcgcccaggctggaatgcagtggcacaatctcagctcactgcaacctctgcctctcagggtcaagtggtttttctgcatcagtctcccaagtagctggaactacagatgtgcaccaccatgcccgactaatttttgtatttttagtagagatggggtttcactatgttggccaggctggtctcgaactcctgacctcaagtgatctgcccacctcggcctcccaaagtgctgggattacaggtgtaagccacagtgcctggcccatagtttgttctttgaagttaacaaaccacaatttgtttaactattcacctgttgaaatacattattacaattaataaaaatatgccacttaaaatgctttcaattctcacattggaggataactgcaacttttgttgttatgcctggtgtgatggttaatattgagtgtcaacatgattggattgaaggatgcgaagtattgttcctaggtgtgtctgtgagggtgttgccaaaagagattaacatttgagtcagtggacagagataggcagaccgatcctcaatctgggtgggcaccatccaaccggctgccagtagggctagaaaatgtacgtggaaaagtggaaaaaggtggaataagcagacttgctgtgtcttccggccttcatcatactcccatactggatgcttcctgcccttgaacattagactccaatttctctggcttttggacccttggacttacaccagtggtttgccaggggctctcgggcctttgggcacagactgaagactgcactgtcggcttccctagttttgaagtgttgggacttggactgatccaccactggcctctttgctccttaaattgcagacggcctatggtgggactttacctgttatcgtctgagtcaattctccataacaaactccctttcatatatacatatatgctattagttctatccctctagacaaacctgactactacacatggcatattttaaaaacacggccacattaagtctaattataaaatatgtagtatttcatcactgaattcatgacttacagagaaatattaagtataaaaaaacacatggcatattttaaaaacatgcccacattaagactaattacaaaatatgagtatttgatcactgaattcgtgacttatagagaaatattaagtataaaaaaatactgattcctttcagttctatgcttaattaggagagccagtctctgagcacctttggaacaaatcccgtttgtctcagttccaagagtatacattgtcaattactcatatccctaggaactttacctgccaatgctaccttagctcccaataaaattataagacattttcatatttaagtacttgtcacctcgtatagacacatatttacttctggttctggtagaaaagcagcatggataacatttaaattatggttcattcattgggataggccattttacaaagagtcaggaaaaatcggaccataagcatagtccccatgtttcctagccaacaattcctgacacttttattacaaaagcattaaagtaaaattgttattttaactttacttctccttttttcctttgaactttcatgttctgtccttttaattttaattcacatcaagttgataaaatcatattttattctgtaacaatgtgccttcctaattttttctttaggcttattctaagtgtgataaccaaattaataaacatttccattatttgaaagatacacacacaaacattgtgtaactgttgtttagaatgatgtgtgtaaattatacttcttcaaatttagtccactgtgacaaaccttggatcaataaaatattcctaacatctagatgaattaaatgatttttatttacacttattgttcgaaatcattccacattttactttacctgacacttcagcaataaatgtgctacttctaaaagttgccttgcttgttcatagaggactcaaatacttttattattatattactaatatcattcactccttaatctttttcttcattttaaaaaatagaattcatttttctttttaagatattcttagaatccactgatattttaacttaaattcaactagctgttttctaggcctgttacctagttgggattttttttttccacataaatcttcagaatgtttcatcatttcttgttgctatgcatttctcttccttggattttgctgaattatatgcttaagtaatttcctcacaaaaggatgtatttcaaaataaattgcatacattattgctacctaaaactacatttatgtggccctggcacttgaatgatagcttgtctggggatagaatttcagaatttcgaaggccttgcatcaccatcttttgagcattttactcatgtagctttctgtatgaatctcattcaatagtacgtggttttttagttgtttaatttttttaaaatatgtttttcctctgtgaaaacttctgactcaatcattcgtgatgtttggtatattacaatgatgtgtatttatatgagccttttatcattctttttggtacttggaaacttttaaaaatcttgtgaccattttcctcaatctgggaaattaaaattgctctattaatagattttattttaaataattattatcaactttgtggaattttctattttatcacttttattataatatcactcagtttaaaaagatgaaccacacctactgactaaaattaagcattttgttagaattattctgtttgagctcaatagcaataaacagctcaatttaattttcttgaaactaaagttcttattgcttgggtttatttccactatattttacagatatgtggtaaccatgtccttgaaatcttattgtaaattaactaacaaagaactgggatatattttcactcataatgccagatgattggtgtgggaaattagaccaacactatgaatttatcttgctcagagaagctacttcctacccttttgtggtcagtgaaccagggcagatcattttaatcccataaggggtggaggtaatttaaggctgggtaatataaggccagatggctcactatacatctggctcatttccactgctagtaaacgttgtattggtattcccaactatgatcctgcattgtttacagagtcctcttccttgtaggttcctgagctcaaaatatcttcctcactgtagcaatgtcaaatcctctgctctgctttctagccacattctgcagagcctcttgtaaaccctctgtttttcttttctttgtaccatctaggaacgaactagtgcttcaaccagctaggaactctgctcattctacactttatcagtgcatttagaaagtacacttggccactgaaaattacgagctacaaaaacttcaagttaatttactctggatcacatagccagtaagaagcagatttcatacattactcagttttgttttgttttaactccaactttcagtacatctttactatggacttgctacatatctactgtgacaaatctcatttgttacgaattatctgttgccagtcaatattatctggaattgttaaatttatcaataccttctttctaatctaaaatgtaaatataatttattccaaatataatttattccataaattctttctaaactaaaatgtaaatataatttattccaatataaatataatatattccaaagttatataaatgttttaggaagtaagatgatacaaccaaaaactttacctatgtgatttcttgacctcctgtgctatgtagttcaagaatttggcaaattctttgaaggggaaactcaaagtttagggcttgcttctcttatcctttcttttcctagagattattgcccttgtatcttggataattcaggaaccccagactttaacatatttctcaagctctataccattgctgaaagctctgcagcccttatctggtcaccctctcttgctgcctggtatagcaaacgtcccaaggaaaaatgaagtgggctgaatgttgaactcaccttaatgggtttcttttgctattagatttggtcacaacttctgttttattcactgttgtattctaactgtgtagcaggtccatggtacaaggcaggtgtgcaataaatgcttaacaaataactaaatgaatgatgaataccttcaaatttattttacagagcaagcgtaagcctagtgacaaagcaagaaaatggaaactattgaccaatgcccgattctgttgcaactatagtctagatgttatttaagataatgatatcaaatggaattcacttatgcataaaagaaaaaagaacatacaatgattaggcttgtgccaaaaatgtaagattgctacctataagaatatatacacaagcaacacattgtaaactgtggtttacatattcagaaatcaatttgcatttcaaaaatctcttcaaatatttgtaatagcaacaattagcaatttttaatatattttacaatagactgaaatgtttgatatacaattctcataagattgtggtggaactcacataattatgcatttctggtggtaatacaaattgacacaatctctttctagagcaactgtattttatttactttggtagttttttatttacctttatagacatgttgtttttttaattttctttttttcccaccatatatatatctatatatataaacccagttcaaatatatgatatggaatattaaatatattgattgatattaaatatgtgaatatatgatatgatttctaaatccttctctagtatacagcagtaaataagatgtacttcaagtacaatactttcatttctaagcagatctctggcctggaaaaatgaaggtttctctagagatgtactagaaattgtttagttccaaacctaggccaaatttgcctcacacatttccttcttgtgagactgtattataagacattttgtttaataatgatatataacaatacctgtactcttgttactcaccaatttctgttacaaaaataagtagagatggtagtagagatatacatatattttgtcaaatatttctgcagatgcagagataatgtacaggaataatcaagaacaatgaaacttgcctaaagtagaactaaataagggagagattgtcaaatacatttataaattataacaaaataaatggaaatcaaaattaattaaatcacacataatcctattatcctaacataattattgccagtaagataattttgaaaagcagttgatgaaaaattatcagaaactataaatattttttctttcaataatttcatttctggtaattaaccctgaggaataaaatcaaatgaagaatgctgctttgtacattgacatgttcagtttaaccttaattttaatggcaaattgttaaacaatctaaatatctgactggggaaatggtaaattattgcataccatcttaatcagtccttaaaattaagatcctaacgactatagttacatggaaaacgcatttgatataatgcagaaaaattctgtcaaggccatcacagttaaaactgaaactattcattatatggttgataagtgaaagaggcttaacacagtttaatgtatgaaagagttacattaggatagttggattgctgtgagtttcttgtgattttgtcttcctcttcttataataaatgtgcaaaaattatgggaaaaatatagaaaaattgcagataaataagaagtgaatttactaagtaacaacacttgaataaagagcttattggcacttattaattgatacttatttgaaatcactgctaatgcatatgaagttaaataagattttacttgtactgtctagtgcagtctgttataacaaaaacaatgaaaagagtttcctggtaatattaataatgtcttatttaacttgacatgctttaaagtctaaaacagtggcttaaacatggcaagttattgataaatacttactgattaaattttgagactataaaactttgacatccttgaaaaaaattagttcaattatttagtatgtaatatacatggatcaaaactgttacaataaagcacagtaaaataattctccttcccatcatcatctgctagcacttttcctatgtatacgaacacctatgtatattattttcctccttttcacaatgatagcatactatatgtaatttactatagattgatttattttcaattaacaatgtatcttggaaatctttccatatcagtacaaattgtacttccttattcccttttatgaccacatagggttccattacatagatacattatacttcttcctcattcaaaaacacctttcagttgtttcttagttgcattttttggtctgctaaaatacatcagatcaaaaagtgaagtttctcatattttgtaaagcttcctatcacacacaatattaatttgttaataaatcttaatgatttaccttagaaacagatggtctcactcataggtgggaattgaacaatgagaacacatggacacaggaaggggaacatcacactccggggtctgttgttgggtgggggaaggggggaggggtagcattaggagatatacctaatgttaaatgacgagttaatgggtgcagcataccaacatggcacatgtatacatatgtaacaaacctgcacattgtgcacatgtaccctaaaacttaaagtataataataataaaataaaaaaataaataaataaataaataaaataaattataaaaaaaaagaaagagatccagaatctaaccacttctcactgtttccattgagctatcattatctctcacctggattaatataattgcctcttaaatggtcctccacttttcaatgcttatctcctctacagtaaagcctcaaaacaacagatagtaggactttttaaaatgtatgataggaattgcagaattggctaagatagagtaattatgtcacactctcttccgctgaataaaattaaaaccctgggtataatacataaacatctagagactctgaaaaataaataataacaagtttgctgaggagagaaattaaaactcaaagaagaatcccatggggtgagttctctctgcactttattctcccatctcttctggcctgaatccaataaatgtgcagcagacacagtcaccaaaagctccaaggaaacttatctcattgtggtgcagactctaggaactgtgaccgctataggacagaaagaatgagaggaaattttcatgtcttgactttctctttttactctccaaggtctgtcccactcaagcactggtcatgaagctgcatttccatggtggagacagtgcaactggtagcaatgatggtggcatcagtggacttgctgataattaaaatactcagaaaataatccttctctctcattatagaaagtggaaaagatgcttttgttatctaaagtgaggaagcaatccctttccctctctctgcctctctctctctctttctcttctcttactgctttgccccaagttgaacagaattgtagatgtgcacgagcgtaatgaggcaaatactctggcctcatagctagagtaccaaatcaaggcctccggtatttagagagtacaaggtaatcaagaagaggatggaactggagaaaagctggagaaaatctgtacaaggagtatacggttcatcccaacctatgtatgtgtggaactgaaccaacacatgaaaagttcgaaaaaactttgatatgatgaatgtgaatttccaggtgacaaattagcacatggttggtggacatgctgggcagaccaaaatatcactgccaaggatttttttactatactgaaattgaaattatagtgaatagaagttgggtcatatcattcagtctgaacctcatctatttgcctgctaatacagacaaacaagtaagtgcaacaaaacaaacaaaaaaatctccagaagattttaacaggacccatagtattatacagtaatattttaaaactctaaattacaattatctatcaatctatatatagaagaactaggcatagctcaactactctcaaagagaaagccaattaagaaacaatgaccttaaaataacctatgttagaattattagtagactttaaagcagatattataaatgcgtctcgatgaaggcaaaagcccttgaaatgaatggaaggatagaagttctcaaaaagaaatagaagttataagaataaaccacagaaaattttaaatctaaaaattaaaatgctataaataaaaaattcactggaaatgaaatgacaaaggaaagaattagtgaacctgaaggtatattaatagaaattattcaatttggacaacagagagtagtttgaacttgaatgtaagtttgaatctctaaaaagtatgcaacaaacttgtggctcaaggctgcaaggtatcattatgtgtccggagttggttccttctggtgggtttgtggtctcactgacttcaagaatggagctgcagaccttcacggtgagtgttacagctcttaaagatggcaaagacccaaagagtgagcagcagcaaggtttactgtgaagagcaaaagaacaaagtttccacagcatggacgagaacccaaggggggtgccactgctggctgggggcggccagcttttattcccttatttgttctcgcccttgtcctactgattggtccatcttacagagtgctgattggtccattttagaaacgtctagctagctacagagtgctgattggtgcgtttttacagagcactgattggtgcattttacaaacctctagctagccacagagcactgattggtgcatttttacagagcattgattggcatattttacaaaactctagctagctacagaccactgattggtgcattttacaatcctacctacagaatgctgattggcacattttacaatcctcttctaagacagaaatgttctccaagtctccactcaacccaggaagtccagctggcttcacctctcaattggagtctcagaaggttagaaaaaagttagtcaaaaaataatatttgaagacagaatggctaaatactttctagatgtggtgaagaacacaaatttacagatttttataattccagaaaacaccaaataggataaactcaaataaaaccatgttcagatgcaccataatcaaactggagaaaaacaaagataaatgtaaaaccttttaggcaagtggagaaaagtaacatattgcataagactaaaagacaggacaacatgttgaaagtgttgaaagaaaacaaaaaaaattgaagacagatacacataatgaaaatatcctttaagaataaaggtggaataaaaacatttttaaagaaaaaaataagcagaatatttttgtcattacacctgcttttaaataaatagtaaaaaaatttttgaaactagataaatattaactgaaaaatccagaacattagggatgacaaaataaaaacaacagtaatgacaactgaacaattaaaataggctgtattttgcctctgtacgttccttaaacttaattttataactttgctgttataaaagttataaaattatttgagcagttttcaaagtatgtagatgaaatacatatgatagccactccacaaagagggggttgcataaataaagaaacccagatggtggtaagatatctagattatatttgaagtaataaaatattaacgctacatacagagtgaaaaattatatttatatattgtaattcctagagcaaccccaaccaaatataataaggtatgtagatgaaagtcaaaaaaatttaaatggattaatatattttgaaagaatccaagaaaaggcttaaaagtatcaatacagtaacaccaacaccaaaactgacaacactaccaacggcaacaaaaagagagggaacaaacaaaaatccaatcacaaaacagtaaatttaatctaaccgtatcaataattacattaaatgttaatacacacactaatttggatcaggttccaagatggccaaataggaagaactccagtctacagctctcagtgtgagcaatgcagaagatgggtgatttttgcatttccaactgaggtaccaggttcatctcactggggcttgttggacactgggtgcagcgcacggagcatgagacaaagcagggcagggcatcacttcacatgggaagcacaaggcgtctgggaattccctttcctagccaagggtagccgtgacagatggtacctggaaaatcggatcactccccaccctaatactgggcttttccaagggtcttagcaaatggcacaccaggagattatatcccgcgtctggctcagagggtcttacacccatggagactcgctcactgctagcactgcagtctgagatccaactgcaaggtggcagtgaggctgggggagaggggttggccattgctgaggattgagtagataaacaaagtggccaggaagctcgaactgggtggagcccactgaagctcaaggaggcctgcctgcctctgtagaatccacctctgggggcagggcatggctgaacaaaaggcagcagaaacttctgcagacttaaacctccctgtctgacagctctgaacagagtagtggttctcccaccacagagtttgagatctgagaatggatagactgcctcctcaagtgtgtccctgacccccaagtagcctaactgggaggcacctcccagtaggggccgactgacacctcatatggctgggtgcccctctttgaaaaagcttccagaggaaggaacaggcagcaatatttgctgtcctgcaatatttgctgttctgcagcctctgctggtgctacccaggcaaacaggatctggagtggacctccagcaaactccaacagaactgcagctgagggtcctgactattagaaggaaaactaacaaacagaaaggacatccacaccaaaaccccatctgtacgtcaccatcatcaaagaccaaaggtagataacaccacaaaacggggagaaactagagcagaaaagtggaaaattctaaaaatcagagcacctcttctcctccaatggaatgctgctcctcgtcagcaatggaacaaagctggatagagaatgactttgacaagttgagagaagaaggcttcagaccatcagtaataacaaacttctccgagctaaaggaggatgttcaaacccatcgcaaagaagctaaaaaccttgaaaaaagattagatgaatggctaactagaaggaacagtgtagagaagaacttaaatgacctgatggagctgaaaaccatggcacaagaactatgtgacacaggtacaagcttcagtagcctatttgatcaagtggaagaaagggtatcagtgattgaagatcaaatgaatgaaatgaagcaagaagagaagtttaaagaaaaaagagtaaaaagaatcgaacaaagcctgcaagaaacatgggactatgtgaaaagaccaaatctatgtctgattggtgtacctgaaagtgatggggagaatggaaccaagttggaaaatattcttcaggatattatccaggagaacttccccaacctagcaaggcaggccaacattcaaattcaggaaatacagagaacaccacagcgatactcctcgagaagaacaaccccaaaacacataattgtcagattcaccaaaattgaaatgaaggaaaaaatgttaagggcagccagagagaaaggtcaggttactgacaaagggaagcccatcagattaatagctgatctctcagcagaaactctccaagccagaagagagtgggggccaatatacaacattcttaaagaaaagaattttcaacccagaatttcatatccagccaaactaagcttcgtaagtgaaggagaaataaaatactttacagacaagtaaatattgagattttgtcaccaccaggcctgccttccaagaggtcctgaaggaagcactaaacatggaaaggaacaaccactaccagccactgcaaaaacatgccaaattgtaaagaccatcgaggctaggaagaaactgcatcaactaacaagcaaaataactggctaacatcataatgacaggatcaaattcacacataacaatattaaccttaaatgtaaatgggctaaatgctccatttaaaagtcacagactggcaaactggataaagagtcaagatccatcagtgtgccgtattcaggaggcccatctcatgtgcagagacacacataggctcaaaataaagggatggaggaagatctaccaaggaaatggaaaacaaaaaaaagcagggttgcaatcctagtctctgatgaaacagactttaaaccaacaaagaccaaaagagacaaagaaggccattgcataatggtaaagggatcaattcaacaagaagagctaactatcctaaatgtatatgcacccaatacaggagcacccagattcataaagcaagtccttagagacctacaaagagacttggactcccacacaataataataggacactttaacaccccactgtcaacattagacagatcaacaagacagaaagttaacaaggatatccaggaattgaactcagctctgcaccaggtagacctaatagacatctacagaactctccaccccaaatcaatagaatatacattcttctcagcagcacattacacttattccaaaattgaccacatagttggaaggaaaacactcctcagtaaatgtaaaagaacagaaatcacaacaaactgtctttcagaccacagtgcaatcgaactagaactcaggatcaagaaactcactcaaaaccgctcaactacatggaaactgaacaacctgctcctgaaggactactgggtacctaatgaaatgaaggcagatataaacatgttctttgaaaccaatgagaacaaagacacaacataccagaatctctgggacacatttaaagccgtgtgtagagggaaatttatagcactaaatgcccacaagagaaagaggaaagatctaaaattgacaccctaacatcacaattaaaagaactagagaagcaagagcaaacacattcaaaagctagcagaaggcaagaaataactaagattagagaagaactgaaggagatagagacataaaaaaaaaacccttcaaaaaatcaatgaatccatgagctggttttttgaaaagatcaacaaaatggatagactgctagcaagactaataaagaagaaaagagagaagaatcaaatagacgcaataaaaaatgataaaggggatatcaccaacaatcccacagaaatacaaactaccatcagagaatactataaacacgtctatgcaaataaactagaaaatctagaagaaatggaaaattcctggacacatacaccctcccaagactaaaccaggaagaagttgaatctctgaatagaccaataacaggctctgaaattgaggccataattaatcacctaccaaccaaaaaacgtccaggaccagatggattcacagccaaattctaccagaggtacaaagaggagctggtaccattccttctgaaactattccaattaatagataaagagggaatcctccctaactctttttatgaggccagcatcatcctgataccaaagctgggcagagacacaacaacaacaaaaaagagaattttagaccaatatccctgaagaacattgatgcaaaaatcctcaataaaatacgggcaaaccaaatccagcagcacatcaaaaagcttatccaccatgatcaagtcagcttcatccctgggatgcaaggctggttcaacatacacaaatcaataaatgtaatccatcataaaaacagaaccaaagacaaaaacaacatgattatctcaatagatgcagaaaaggcctttgacaaagttcaagagcacttcatgctaaaaactctcaataaactaagtattcatggggcgtacctcaaaacaataagagctatttatgacaaacccacagccaatatcatactgaatgggcaaaaactggaagcattccctttgaaaactggcacaagacagggatgccctctctcaccacttctattcaacatagtgttggaagatctggccaggacagtcaggcaggagaaagaaataaagggtattcaattaggaaaagaggaagtcaaattgtccctgtttgcagattacatgattgtatatttagaaaaccccatcgtctcagacccaaatctccttaagctgataagcaacttcagcaaagtctcaggacacaaaatcaatgtgcaaaaatcacaaacattcctatacaccaataacagacaaacagagagccaaatcatgagtaaactctcattcacaattgcttgaaagagaataaaatacctaggaatccaacttacaagggatgtgaaggacctcttcaaggagaacaacaaaccattgctcaacgaaataaaagaggatacaaacaaatggacgaacgttccatgctcatggataggaagaatcaatatcgtgaaaatggtcatactgcccaaggtaattgatagattcaatgccatccccatcaagctactgatgactttcttcacagaattggaaaaactactttaaaattcatatggaaccaaaatagagcctgcattgcaaggacaatcctaagccaaaagaacaaagctggaggcatcatgctacctgacttcaaactatactacaaggctatagcaaccaaaacagcatgatactggtaccaaaacagagatatagaccaatggaacagaacaaagccatcagaaataataccacacatctacaaccatctgttatttgacaaacctgacaaaaacaagaaatggggaaagggttccctatttaataaatggtgctgggaatactggctagccatacgtagaaagctgaaactggatcccttccttacaccttatacaaaaattaattcaagatggattaaagacttaaatgttagacctaaaaccataaaaactctagaagaaaacttaggcaataccattcaggacataggcatgggcaaggacttcatgactaaaacatcaaaagcaatggcaacaaaagccaaaattgacaaatgggatctaattaaactaaacagcttctgcacagcaaaagaaactaccatcagagtgaacaggcaacctacagaatgggagaaaatttttacaatctacccatctgacaaagggctaaatctagaatctacaaagaactcaaacaaatttacaagaaaaaatcatacaaccccatcaaaaagtgggcgaaggatattaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaaaatgtggagaaacaggaattcctttaccctgttggtgggactgtaaactagttcaaccattgtggaagacagtgtggcaattcctcaaggatctagaactagaaataccatttgatccagccatcccattactgggtatatacgcaaaggattataaaccatgctgctataaagacacatgcacacgtatatttattgtggcactattcacaatagcaaagacttggaaccaacccaaatgtccatcaatgatagactggattaagaaaatgtagcacatatacaccatggaatactatgcagccataaaaacggatgagtttcatgtcctttgtagggacatggatgaagctggaaaccatcattctcagcaaactatcgcaaggacggaaaaccaaacactgcatgttctcactcataggtgtgaattgaacaatgagaacacttggacacagggtggggaacatcgcccattggggcctggcatggggtgaggggaggagggagggatagcattaggagaaatacctaatgtaaatgatgagttaatgggtgcagcacaccaacatggcacatatatgtagatgtaacaaacctgcacattgtgcacatgtaccctagaacttaaggtataataaaaaaaataggcacaccaattcaaaagtcggatattgtcagactggattaaaacaagaataataaaaagatccagtcatatattttataagaaaaatactttaaatataattgtaccaagaagtcaaactggtaacagcaattaaaagaatgtgagggtgcgaggtcagatcgagaccatcctcgctaacacagtgaaaccctgtctctactaaaaatacaaaaaaaaaattagccgggcatggtggtgggcacctgtagtcccagctacctgggaggctgaggcaggagagtggcgtgaacctgggatgtggagtttgcagtgagccgagatcacgctgctgcactcccgcctgggtgacagagcgagactccatctcaaaaaaaaaaaaaaaaaagcatatgagggtgtatatagtaatattagctaaagtggatttcagcataaggaaaattaccaatgacaaaggcaaacaatataaagaccaaagggtcaattcattaagaagtaatagtaataccaaatttgcatggatctaacaacagaacttaaaattcttgaagaaaaacctaatataactgcaaagagaaataaccaaattcaaaactatacctatttatcttaattaataaaacaagtacacagaaaataagccagggtatataatatattatcaatattattaaacaacttaaaattatacccaacagttgcagaatacatattattttaaaatgtatgtagaacatttgtcaagataggtctcatctatgttaacataacagacttaaatttagaagaattgtaatcaataatagaaaattgtctataaagatcacaaagtatttggaaattaaacaacatacttgaaaataatttataagtcaaaaagaagtttcaggacaaattagcatctattttaaacttgattaatataaaaatgcaacataaaatgtgtaggatgcagctaattcagagttggggggaaaatttatagcattgaatgcttacattagaaaagaaaaaaattctcaaatcagtaacttaagctttcacattaataaactagaaactaagaagaaatgaaaaacaacacaaagagaaaaaaatgtgataataaagattaggctttaaaacaatgaaatttgaaggtagaaaataataaaattaatggaaccaaaagctacttctttgaaaagtttgataatttgataatattgaaaaacctttttccagatcaaccaaagaaaggaacagagggaaagccagaaagagagaaatagtgaacaaaaattaccaacatcagtaggaaagagggatattattacaaagcccatagctattcaatatataataaaatataagaggataagaagaaatattagggacaatttatgcctataagttcaacaacttatagtgaataaaccaatttattaagaaaaaaattaccaaatctctttctcactctctctctctctctctcacacacacacacacacacagagacacaaacacacacatacaaaatagatatcttcaatggtcctctatctgtaaaaccaattgagttggtagttaagtatcctccaagaaaattacaggcccaggtaattttgttggtcctgtaattctaagaataatttgtggaggaaattacagtaatcctacagaacctcttccagaaaattaaaaaaaagaagaaacatttgtcagtttattccctgaggccatcactgcttgaataccaaaatcagacaaagccactacaacaaataaaaagcacagaacaatatccctcatgaacatagatacaaatattttcaacaaaatataacatgttgttgcaattgcttctggggactaagcataatttatttgtcaataccaacaccaagaatgttatttcctaagttttcttccaggatttttagagtttgaggtcttacatttaaatctttaatcaatgttgagttaacttttgtatatggtgagatatagggatccattttaattcttctgcatatggctagccaattatcccagcaccatttattgaatagggaatcctctccctatcgggggaaattcagccagatattgggcaaaattcacccccgatatttcacgtaggttcttttctattttccctaagtgttggctggtctgagaaataaagggacagagtacaaaagagagaaattttaaagctgggtgtctgggggtgacatcacatgttggcaggttctgtgatgccccctgagccataaaaccagcaagtttttattagtgatttcaaaaggggagggggtgtatgaatagggtgtgggtcacagagatcatgtgcttcacaaggtaatagaatatcacaaaggcaaatggaggcagggtgagatcacaggaccacaggactggggcgaaattaaaattggtaatgaagtttcaggcatgcattgtcattgataacatcttatcaggagacagggcttgagagcagacaactggtctgaccaaaatttattaggtgggaatttcctcgtcctaatacgcctgggagcactacgggagactggggcttatttcatccctacagcttcgaccataaaagacggccgccccctgaagtggccatttcagaggtccaccctcagggatgcattctctttctcagggatgttccttgctgagaaaaagaattcagcaatatttttcccatttgcttttgaaagaagagaaatatggctctgttccgcccggctcaccggcggtcaaagtttaatgttatctctcttgttccctgaacattgctgttatcctgttcttttttcaaggtgcccagatttcatattgttcaaacacacatgctctacaaacaatttgtgcagttaatgcaatcatcacaggggcctgaggcaacatacatcctccccagcttacgaggatgacgggattaagagattaaagacaggcataggaaatcacaaggctattgattggggaagtgataagtgtccatgaaatcttcacattttatgttcagagattgcagtaaagacaagcataagaaattataaaagtattaatttggggaactaataaatgtccatgaaatcttcacaatccacattcttctgccttggcttcagctggtccctccgttcggggttcctgacttcccgcaacatttccccactgttttttttttttttttctctgaagatcaaatggttgtaggtgtgtggttttatttctgggtcctctattctgttctattggtcttgtttctgtttttgcaccagtaccacactgttttggttactgtcactggtaatgtgataccttgggctttgctgtttttgcttaggattgctttggctatttcagcactgttttagttccaaataaattttagaataggtttttctagttctgtggaaaatgccattggtattttgatagggataacattgaatctgtaaattgctttgggcagtatggccattttaacaatattgattcttccaatccatgagcatgaaatgtttttccatttatttttttcatctatgatttctttcagcagtgttttgtacttgtccttgtagagcagtttcacatccttgattagatgaattcccaggtatttcattttgtgtgcgtgtggctattgtaaatgggattgtgttcttgatttggctgtcagctagaatgttactggtgtatagaaatgttactgattttgtacattgattttgcatcctgaaactttactcaattagcttatcagttccaggagcagagtttttaaggtttctatgtatagaatcatatcatcattaaagagagaaattttgacttcgtcttttcctatttgtatgccttttatttctttcttttgcctgattgctttggctaggacttttggtactatgttgaaggaaatggttctgtaggtcactatcctaagcaaataaatgcaagaacaggaaaccaaaaacctatgttctcagttgtaagtgggagctaaacattgggtactcatggacataaagatggcaacaacagacactggggactactaggaggaggagagtggaagggggcaaggattgaaaaagtacttattgcatactatgctcactacccggatgacgaaatcatttatactccaaacctgagcatcacataatatacacacctaacaaatctgcacatgtagcctttaatgtataataaagttgaaatttttgtttaaaaattagcacattagatccagcaataatccagtaatgcaaagataattcactatttgaaaataatttaatgaaactttcctagtagcagactaaaggagaaacaacacattatcttaataatagatgcagataaagtatttgaaacaattaaaaatgtatttataaaaattaacttctcagcaatttaggaatataatgaaccactttaatatgataaatagcatctacaaaagtcctacagctggcatcatatttgaaagtgttaaaagtaacaccacaaaactacttcaaaaaataaagtgaaagtatatttttataaccttggttatagagtaactgacagagcaggagcactgtcatctcagacaaacaccaccactttaagttccagctccctttctagcctcatgcatttcaaggaaatcacttctgtcctaactacaagcagaaagggcagatagtaaaacacagataagatagcttgagcacaaaaggaagtgggggtaaagtttcttgggtaactgccaaacttcaccctcataaaatgggccccagaaaacagtgggcctcaatagcacattccttacccttcaggtccgctaagataggaaagctaaaagcagaatccagtgttggggagtatgccagcagctgcaggaagatgtttgggaacacacaactctccctcccagataagcacaacaaacagaaacagaagcagtccaagcctccgctgaatgcttcaaccctgaatccttaaaaactcttagtctggaccaggcatggtggctcacaccggtaatcccagcactttgggaggctgaggtgggtggatcacaaggtcaggagatggagaccatcctcactaacacggtgaaacctcgcctctactaaaaatacaaaaaattagctgggcgtggtggcaggtgcctgtagtcccagctcatcaggaggctgaggcaggagaatggcgtgaatcctggaggcagagcttgcagtgaagccaagattgcgccactgcactccagcctaggcgacagagcgagactccgtctcaaaaaaacaaacaaacaaacaaacaaacaaaaaacaacaacaacaaaaaaaacaactcttaaactcttagtctctaagagagtgggctccgacctaacatggccagaagcgcctctcaggtttgttttctctaaaataaacctatccttcactgtcgaaccacctttcacatttctttcccctttctttaattcttacagtatctttttaaatgataattattaactcaaattataacattaaaactacggaaatttgctaaaataaaaataaagttttgttttcttagttgtgttctttgtcttagaagacaaagttaatatggggtaaattaggaaaatacttaaaatatctggaattgtcaagaatatgatatctaaaatatgtgataatatgcatatcaacaatgaaaaggaaaacaaaaactaggcttactattaattgctattcacagaaagaaatgcctgtctagctagggagtgtaatttaaatgagaaattttagtcatgttaaatgtttgttgattttatctttcagcatactaactcagtttcagtaatttttttctattgattttcttttctctattttatttctgctttgatctttgttattttctcacttccgtcacctttaggcttgatttttttatttttgtgtttctttgtgctataattttagtttgtttatttgaggtcttttgtctttttttaatgtaggtgattatcactataaacttccatcttagcactgcttttgctacatctcataagattcagtgtgttgcatttttttgtttgtttctagacattttccagtttccattatgatttattttttgagccaatgattgttcaaaggcatgttatttgtgtgaatttgtaaattaaaaaattctttctcttcttattgatttctagtttcattccaccgtggtcaggaaatgtacttggaatgatttcaatattcttaaatttattaaaagttattttgtgacttagcatgtgatctatcctaaagaatattccatgtgctcttgaaaagaaaatagattctgctgctattgggtggaatttctatatatgctcatttcttctatagtgctgttcaagtctgctgtttccttattgattttctgcctgatatgtctattattgtaagtggggtattgaagtttcctactagtattgtattgtctatttattatttcagacgtcaatatttgctttatctattgagatactttgatgttggatgcatgcatatttagaatattatacatttcttttgaattgccatttttattattatgtaatatctttcaccaacattttttacttaatgtctactttgtctgatataagtttagccatgccttctctcatttaattttccattgcatggaatatccttttccatcctttccttttcagcctatatatttacttaaatctaatgtgagtctcttatagacagcatatagtgggatcttttaaaatatcatatctttaatttgttagtttatttacatttatggtaattatggaactgtaagaacttactattgccattttgttgtttttgtgtctttttgtaattttttcctctctttttcttttgctgtcttcttttgtgttttgataattttctgtagtgatattctttcatttttcttcctttatgtcatttttatatctgatataggtttttctagtgtggttaacatggggcttgtataaaattgcttatagttataacagtcttctcagctattaacaacttcaatcacatgcagtaattctgcacttttactttctccacatacactatgctattgaggtcagaatttatttttttaattgtgcagccattaatcatttttatggttattgttattatcctttttcaacagcattgacaaactacaaaatagaattacataatgcattgcttttttattgttgatttaaaaaggcaaaaatatctgcctttgaaattcaagtgccacctcttttaaatcttcaatagacaatttatatgtatagcattttatgctgtttaattcattttgtaaatgcagatttagtactattttctctgattccagctgactagattgtgattaggtattctggattttacttaatagcttcttccttttctatttttttagtcctaacttacatatttttagttcattattattttgttttccctattttgcatttagaaaataaaagaggcatataccatatataaataactattttatctgaaaggaggtgaattgggaaatcaacaagaaaattttctgcttattcaaaagcgattattgagccttagtaccaactttgtaacatttacctcactagaaatgaggtgcagctcatagttaaaagtgaaggactcataatatagtgtactaaatgttagagtaaatatacattatgaaatggaaaaatagagtattttattcagacaaggagtgaaagggaagtctcctaccaggaagtgatacttccactgaaactggaaagataaatagatatcttcagcatgagaaaacagcgtgtgcaaaatatcaagaagtgagtatatacgatgtatgagaaaaatacaagcatgttgatatagcactagtatggaaaaacttgcctggtgatgagactgaatgagctttcagatataagaagttaccagagcttaaatatcttttttattctactaaggaagttgaatatcctttggaaaacagtagaaaagtatagataggtgctaacaaaggaaataaccggaatagatttaccgatttaaaagattgttacgaaagcaaaactgaataatgaaggcaaaatgctatgaatgtttcttatcacacaataaagtagctctactgctcctgagtaacttgttttcctatttgcctttttttcttcccctatttaatccccaaaagttcaatatgtatgcataatttcccgaaagtaatttcaatagtattgactatgtcctatgacaagcattgaaatactaagctaagcactagaaatacacacataaataaggctgcatcacagcccttaaaaatttgctcctttagtgggatggcagaggggtgaggggtggccctttcaataccatatcaagatgattttataccattatgcataggttgctatatgtataggagcagagaggctgcaagtttagataagttgattgagaaaatatttctttcaggaaataaaattcatactgagtcttacaagattaataaaattgtaaaaggtgctcacatgccttgggttagtattatttattgctccagctaaagaggactaaatattcgaaaattcctcttcctttccttcttgcctttcattcccagcatcctatatcttattagtcaccaagactttctgtctattggtgtgcattgtgaagggagaaagctttaactcagtcatttctctcaaattctgctcttcatttccttcccactctttagttcctcaccatctctcacttaaacttttgtaattacttcaccctaggacaatcaatcttccatactgctgctaaagggatctttccaaaagataaatttgctcttatgattcccttgataaaaaaatgaaacaccaatgaaagtgttcagcaattttccactgccttcagggagaatctcaaaaccctaagccagtggtagaacacccctcactaggtaacagtgactggcctcatgtgttttcatgctgtcttttcctttaaatttttaaaaaatatgttcctgtttataaagcctccctccctatcccataggcagaagtagctaggaccctgacttagagcacttttctctttgaatgaaattacttttataatttctagactgtgtttcacttctagactgtgaacatctgaagttgggaaatgcattttatttatctttgattcctcaatacttggccaaattcctggttcagttcttattatattgaaagtatgaaatacattttaaagtaaattaaataaaaataaatcaactcagagttgagaaaaagacctggaagttaggtaatataataagtcatgaaataaacactttcctggaaataaaaaatgtgaagaattttcctggaggatacttctacatttaagtattcaacatttgcctttgggtacttcaaagttaatgaagatttttttttcaagtccataagatgaattttagaaaataaatttcaaaaaatatactatatcaaataaaattttatgtatagtaatcatattattaggcttttaaaagtgtcagtttaattcaaatcagagtattggatgtttgcatagctaaccatttatttgaattcagaatatagcagttcatgtgttttattatttttaatatgacatcaagacactccagggcacattttattattccatttattcatgcctagggtatattatgagctgcaaacctaaaggctaagtactttaaccacccgaatcatgtattagtggatcaataaaacacaccctggagtatcttaattctataatatgtctcctatttcttattaaaaaggaaaaaagcaattaatctagaacaaaactaatactttaaaatcacataattctattgttacatattttatacaaggtacaaaggaaaaacaatggcagttatttgttaggatattactagggaaatgatgaattatgcagttcatcttctgaaataataaaaagtatttctgctttaaaagcttttatggatatactgcccaagtctatgtgaagtattatatattcagaaccggtaattccttatggtagtggcaatctaaaaacaaaggaactagacaatgtaatgttgcatttaattaaatatatttggtaaactgcaacttgccatgtatttaatacaattttatattcaattgcaatagcttgcatcagctacaatttcttagtatagctttttcatttgttctgtgtttagtattttgtctaaacacttttgtcactagatttgtcacacccaaactatcaattgacacattgtagatgctcaacaagtatatagtttaaataaaagtataattatattgttaaaccacctcaaattccattttggaagtaattgaattgaatataataaataaaattaattataaataattacatatatgaataatcatttataaaattataacaaaaggcaaaagaaggcaacaattatttatataacttcagatattaatagtattttgatatattaactcatttaatttttataggagcactataaacaaaaccttactatactctcacaagtgagaagtctgaagctaagagatattaactgcgttcctcatcttggtaactgatagggttaagatttaaaaggaaacagatccagaatctgtttgattacaaatgctattttatttttactgtaacatttcaaaactaaatatgctcaaccctttaaactttgtttaacaaaactgatccatctttcatcattcagagatcagtcttgggactgaccctattgtaaacatttatcatgattgcacagtactgtagacaatgagagtatagcaaagtgaaactgtccagacagaatttatatcatccttacaatatgtacctcatattgtatttttcttgtctttatttttccccaaatacttacagcaaaaatcatttgtttaaacattagataagtagataaacagtatcccagagcagattaaagaagaaatgtttaataattctgtatatatttttccagtctaaatattgattatagggaaatgggaactgccatcacaaaagaaaatagttttttttttttttgatgtagcatagttctttgttactactgcattaacaaaccatagcagagcagatatgaatagctgcgaaacacagtgaaggggtcaataggcaaaagacttgaactaaggttgtttagtgggcaatatccattgaacaccaccaccaaaattgttgttttctcattctgcttccttctgccccacagtccattcatcttcttttaacatcttgctcttaatttattcagtgaaatgctcacattaacaaccactgctgtatacagctgtaactttcattcttacatttaccaaatatactttgaatgtgtactaagtttcaagcattgtgttaggtccttatgacacaggaagtcctgagccctacctgcagaacctatctcaaagtctagagaatcgagatgtttgtaggttatttagcctatctaatggcttctctgtggaaaatggtagaaaagtcatgagcaaaaacagacatgaaaaaaatgagagatgtgtttagctgtagtgcaagtatcatcagtgtgagctgagaatgaacaatatattgaagcaggattacagattatttaagtttcaagcaaaggatttcaacaaatgatactgaaacactgaaggaagttgatttctgaaaaagtatgttgaaagtgatagttagaaagaataactttgtgactgtacccaatgcaaaatatctagtactcaagtgacttttattttttgtacatctaatcggtgtcaggcacagtgctatgctacaaagacaacagagactttgcaatcactgaagaaactattatattctttgatgagttttcacggttataccaacaacaatttattaaatacttactatggcaatcaatatattaaatttggcagtgtaaggattatattccttataggcatcttacaagatgtttacaatttattccatttttaaaaatgagaaaattaggttcagttaagcaatttgccaagctgagatcagaaataaggcatttctggatccacagcttatgcttcaccatgcacttggccttcaagaagaaaatgaagcattccttcagattttgtggaggagtttctgcttaacagcatatttattgaaggcttactacaattactggaaacatcaattattaagtctactaaagacaaaactaatttcgtagtttaggcaagaaccagtaaggcctgctttgctggtgtagtaacatttctatttcagtctttcagaaagatacactagatcttatgaacaaataatctccaggacatgataactgaggaggaaatgatcatattttttcatgctaggaatggtaatccacttcttttgccaacactttcttatgtttagcactccctactgtcagaatattcccccttcagctaaagtaaattcgtttgttactctttgtcactcaattatgatttctcatgaataaaatttaaaaaaacagtgagtgttggcctatttaagagaaaaaaacccagtatttctaagcctcctttttcaagcagttttgcatcttgaaagagatatagaaataggaaatacaaaagaatagttcactcaaggttttgtatttaccactggaaataatagtagagaaagaatggagaaattacatggagattctatgcaaaaaattctctgttgtgttgttactgaactgtagggaaaatcattttcagatcatctcaaaaatataaaaatgtgaaaagaaaataaggtatggttagacatgctgtctactaatattaggtttattgtaattggtcttaatcatctaaggtttatttttttttctttatagttaacctaatcaatctgtttcttaaagttttggaatttttagagaaggaaaaagaggaatttgtataagcataaataaatatttgacaaattcttccaaactaggatacatcattttaggtactttacagaaccagattatttgtatacctgtatatagttatttatttttctactttcaaatattaatttttagaagttaaactaaatcataaaataagaagtttacaacaataaataaataagccctgaagcaaaaggaaactcaagattgtcattaacaatgagaacactaacaatgagaacaatgaatatcaaaatctttggaatgtgtttcactagtaaaataataaatatacctctagcaatgctacttaaaaatggagagactatacaacgcataatattttaaagtgggagagataaatatagattaatggaaaatatggaaagtcaatgatcataaccatctattataatgtttgcatttaaatcattgcaaatagattgaacgttaaggtaaattgtttggagagcactatataattgttttggaaataattatttgtctacattacactcaaatttgcaaatggatagttaaattgaaaaaatgaggctgtagggtggctcatgcctataatcccagcagtctgggaggccaaggagggcagatggcttgagtccaggagttcaagccagcctgagagacatggagataacacatgtcaaaaaaaaaaaaaaaaaaaaagagccgggtgttgtggtgcatgcctgtagtaccagcagctacccagcaggctcaaagcctggaggcaaaggttgcagtaagtgagctgagatccaaccaccgcactccagcctgggtgacagaatgagaccctgtctcaaaaaaccaaaaataaataaatttgaaaaatgaaacaaaaagattattgtgtatatacatatatatatgaaatacaattttttagtcagaatgtaaagacatttctgtacattgctatattttcctgtgcctagaacaatatattagaatcccaatgaatatttggtgaatgactaaatgggagaggctttattatttatggtaaatacaaacaaaaattaggtcacatgacaagacaaaaataggaggaataaacataaatttagaaccataagaaaacataagtatttaacaaaaatcatcattaactcaataggaaaaatataaataagcaggacttaaggggtaaagtgatgacactcccctccccatgtacgtacctacatcaaagagcaagaaagagagagagagacagagagagagagacagagagagagagacagagagagagagagagagagagagacagagagagagagagagagagagaggagaaaaagagaaagagagctgttgagattgagattgaaaggagagatacatctttaagttgttgacactagtggaattaatgtactttattcttctcttcaaccttcattttcatatttttctacatttcattatataattatttttgttaaaagaaacaaaaatattatttcctgtggttaggcatttgctttttttttttttttttgacatggagtttcgctcttgttgcccaggctagagtgcaatggcacgatctccgctcactgcaacctccacctcctaggtttaagcgattctcctgcctcagactctgagtagctgggattacaggcattcgccaccacgcctggctaattttgtatttttagtagagataggatttctctatcttggtcaggctggtctccaactcccgacctcaggttatccgcccacctcagcatcccaaagtgctgggattacaggcgtgagccactgcacccggctggcatttacattattaaccacaaaaatcttactgcttttttcctattattttaaaatgaaatggtaatcaacagtgatagcaagtagtctttaactcaaaaccaacatatttgtcagggcatttactattacacagaatagcagcatatatgttgtgttcaatgctttaatcccaacaatgaactattaaataatgacttgcgctcttaacgatgttttaattttaacagtgacacacttaagaatatacttagactttttcatccctttgattttttcaccaaagatcaataatgatttaatattttccttttctacatatttttaatgttgtacaatataaaaacataaaatttgccatcttaacagtttttaagtatgcaattcagtgatatgactacactcacattgttgtgcaagcatcatcactacccatcttgagaacttttctcagctttccaaactgaaatcctatactcatggaacagtaactctccattctccccttccctggccccaagtccctggcaaccaccattctacttgctgtctctatgaacttgattaatatagatactttatataagttgaatcatataatatttgcccctttgtgactggtttatttcacattgcataatctcatcaatattcaaccatgtggtattatgtgtcagaatttccttcctttttaaagttgaatgatattccactgtgtgtatataccacatttatccactcatctgttaatagatattttgcttgcttccacctttcagctattgtgaataatgttgctatgaaaatgggtgtacaaatggctcttcaagatcccattttcaatgatttggggtatatacccagagtgaaattgttggactatatggcaattctatttttaattttttttgaggaactactaaaggagtattaattattactgttatctggttatatgaatgaccacagtgtgttggtatttacatgggacttgaatttggagtcaaaaaataaggatgtgatttttcgtttttccttagctaattcataagaatctctagacatttgacttgtataataaggtggaacaatataagcaatatgacttaaagtttgtaaattcatatccgtgagttttagatttggtggaggaaagaaaaaaagagcaaacacgatgacttcattttaacattattttatccaagaatcatgagcttaaaggactggggataagcagttctcttaatgttaatgaggaagacacagaaataatgacctacagaaagtttgaattatagagatccgaattcaatatgatttatttacagggttttccctagaagaaaatgtgaagtataagattagcaagaagatgagtaaatcaatctcacgatactaatctagaaataatcttcaattacttggaacttgaagtcatgttggctgacgaagttgcaaggtaacagtcttaaaatgaagtcccaggaagtatctaaggatccagactagagaagtttacaaaagttacagtgaggccagaaggagttctgctatcttttgcctggtggctatatagatttagaaccaatattggagctcttagaatcaacctgcttgatttgaatctgaactctatcttttgccaaaaatgtatatctaaacatcatattgtattccataaatatatacaataattatttgtccattaaaaatacaattgaacaatatcttaggcaagtagtataaccttaaggttctcagcttatttatttttaaaatattggtaatactcatatttaccttataaatttgtggaaaagttacatgaataaatacatgtaaaatgtttagaacaatgcctagttgagagtgttgcataaatacaagctatcaccattacttgactaaaatatagtcatagttgtcctctctcccatgtggacgaaaatgcttctttattattttaatcatcgttttgctgctgttgaatatattggctaaaaattgaaattaggcattttatataatagagcctatgaatatttattccaacttctgccttgatagttgaacaggtttgtctctgaaaatagcatcatgcagtaaagtttatattatttgcactaaacactgttgccacctctttctggcaaaggttatttgggagcagggaatgtgtctgactgattcatgattatatatctactgcttagaacggtacatggcacacagcattagataaatatttgaccagtgaatgagcaaaggaaaaaaactgtttactcttagtattctaattacattctatataaaacaatactttttttagaaaaagtttaatatagataacaattaattaaaattatactttcagtcataatctaaggcttgctcgtttctattacaaatttcaataatcttatatctgctcttttatctttttcctattttgtcattcttcaatccaaaattttgttttatcctgagttagaataagtgttcttgttaaaggtattcatctaacatctcaaagtaaactcataatcaaataagtgattcacagcatagaaaaatttgtggggattcataagtgggtgttgtataggagaggctaataaagccaagcattattctaacctttcactctatgaattttaagtgtggcgatatcctaggtattattttctgggccaaagactagaaatgagtaggactagtacaattatttcttatatgagtcatttttttatgataacattgactaatgtgctgtaacactgaatacgtttaaattggttctgcttaataatacttgatctacatcacaatacacattctttctacagagtgaaaagaaatgctaagaatcagagccactacaaaaggcttcacactgacattaaaaataacattaaaaaattgaaaaaaattcaccaaatttctgaaaggctgttttatccagcttctctttcttttggttaaatagacttattctcttaataatccttaacagaaaaaactgaatttgccacttcgtggtgttaaatattgactgtgaccatgccatacattataacattgcttgtatgccagaaataaaaaaaaaattaatgctggaataaattaatgattatgatgacttcgtttggtagaaagtaaaccagacaaggacatagattgtttctgtcataatcagtgctgtctcttccatgcctaaaagaatgaatacgtgaaaaatcatgattagatcaaaattcaacattacacaacatacctactaagccctttgtgtgtatcatttcatttagtcttcatgagaacacaataaggaggaagccaatcacaatccagagagacataatccataaaacctacattttattcaaaaatatgcagtttttgaagatgctttaacaaggagattggctaacaatcccaagcccataatcccaaatgttgaaatcccaaaagatcaaaatgcctaacgtctaaaatcttgaaaatataattcaggaaaaaataattttaaatgttcttaaaagacatttatttcctcttttgaaagggaatttctttgagaagtatatgaaaatatgagaaaacacttcataggccaatttatacaataaaataggcaagaatagcatacatgtttttgcaagcataaacacccagacatagaaactgacagtttaacaggtacaacagttatgagcaggtgaacagtattcattaagagaaagctcaaaaagtgaaatataaaaaagcataccactatagttggaatcatgtgtacccagctttataatggtgttcatttgtcacgtggctgtcaacttgagatttttgacaggatagattaaaaaaaccaaaaggggttactgcagtatatgcagtcaccaaaagagctgggatctcaagatcacaaattcagatttagagaaaaaagacatatcttcatttattgtgaaagttccaatgttttcacatttagaatctgagaagctgatggtgtaactttcagtttgagtctgaaagccttacgacccggggaggtctctggtgcaagtcctagagtccaaaggcctgtgagcctggggttctgaagtccaaggaagcagaggaaaaatctatctcaactctcagaaacagaccaattcaccttctgtagagactgtgcctgccaacagtgagggcagatctttcccacctaataccttcagactcacacactagtctctggaaatatcttcacagacacacacacaaaaatgctttaccaagtttttaggtattcgttaatccaatcaaactgacacataaaattgttcataaatccattccttatcaattaggcatctgatatggtttggctgtgtccccacccaaatctcatcttgaattcccatgtgttgtgggagggacctggtgggaggtaattgagtcacgggggcaggtctttcctgtgctgttctcgtaatagtgaataagtctcatgagatctgataggtttaaaaatgggagtctccctgcacaagccattttctcttgtctaccaccatgtgagacatgcctttcaccttctgccatggttgtgaggcctccccagccatgtggaactgtaactccattaaatctccttcttttgtaaattgcccaatcttgggtatgtctttatcccgaaaatgtggaagcgactttggaactgggtaataggcagaggttggaacagtttggagggctcagaagaatacaagaaaatgtgggaacatttggaactcctgagagacttgttgaatggcattgaccaaaatgctgataaagatacagacaatgaaatccaggctgaagtggtctcagatggagatgaggaacttgttgggaactagagcaaaggtgattcctgttatattttagcaaagagactggtggcattgtgcccctgcactagagatttgtggaatgttgaactagagaaagatgatttagggtatctggcagaagaaatttctaagcagaaaagcattcaagaggtgacttgggtgctgttaaatgcattcagttttaaaagggaagcagagcataaaagttcaaaaaatttgcagcctgacaatgcaatagaaaagaaaatcagattttttgaggaaaaattcaagctgactgcagaaatttgcataagtaacgaggatgttaatcataaagacaatgggaaaatgtctccagggcatgtcagagacttcaatggcagcccctcccttcacaggcccaggggtttaggaggaaaaatatggtttcatgggccgggcccagggtccccgtgctgtgtgcagtctagggacttggtgccctgcatcctagctgctccagccagggctgaaaggggcagacatagagcttgggccatggcttcagaaggtataagccccaagccttagaagtttccatgggattttgagctgtgagtgtacagaagtcatgaattggggtttgggagcctttggcttgatttcagatttatggaaatgcctgaatggccaggcagaagtttgctgcaggggcaaagccctcatggagaatctctgccagggcagtgcaaaagagaaatgtggggtcagaacccccacacagagtgcctactggggcaccacctcctggagctgtgagaagaggaccaccatcctttagacctcagaatggtagatccactgacagcctgcattgggtttcttgaaaagctacagacattcaatgccagctcatgaagcagccaggagaggggttatactctgcaaagccatagaggtagagctgcccaaggcagtgggagcccatcccctgcatcagcgtgacctggacatgaggcatgaagtcaaaggagatcattttggagcttgaagatttgactgcccttggccaggcacagtggctcacgcctgtaatcccagcactttgggaggccaaggtgggcagatcacctgaggtcaagagatcgagaccatcctggccaacatggtgaaaccccatctctactaaaaatacaaaaattatctgggcgtggtggcatgcacctgtagtcctagctacttgggaggctgaggcaggagaatcgcttgaacctggggatggaggttgcagtgagccaagatcacgccgctgcactccagactggtgacagagcgacacttcgtctcaaaaaaaaaaaaaaaaaaaaaaaaaaacagaaagaaatatttgactgcccttgaattttggtttgcatgaggcctgtagcccctttattttggccaatttctcccatttggaacaactgtatttacccaatgcctgtatcctcattgtatccagaaagtaactaacttggttttgattttacaggctgataggcagaattgacttgccttgtctcagatgaaactttggaatgtagacttttaagttaatgctgaaatgagttaagacttttgggggattgttgggaaggcacgactggttttgaaatgtgaggacatgagatttgagaggggccaggggcagaatgatattgtttggctgtgccccactcagatcttatcttgaattcccatgtgttgtgggagggatctggtgggaggtaattaaatcatggggcaggtctttcccatgctgttctaatgatagtgaataagtctcatgagatctgatggttttaaaaacagaagtctccctcacaagctctcttctcttatctgctgccatgtgagacgtgtcttttaccttctgccattattgtgaggtcttcccagccacgtggaactgtaagtccatttaatctatttcttttgtaaattgcccagtctcaggtatgtttttatcagcagtgtgaaaactgactaatacagtactcacatgcatctcctaaaaccatacttaatttccatatgaagatgataacaaggtaatatttctacctaagatgagacaactatcctgtgattgtaatttgcaggattttagacattagggatttttgacagtggaaatatagactttagagattttcatctttagggacactgattgttcaggatttcaatatttgggataatggtgttcaggattgtgactttgggattatgatcccagccccagtaaggcagggcttatcattattaacgtaatgtgagacttaaagaagataaaatatcttgcccaaacgcattagtatttgatacagcaagaaaaacatctaaattgtgaaaatattcattcttccgttgggagaataacctttatttgttttcctttattcaatgtttgttaaaaaataacaaaatatttatgtattctcatttcctttttgtatcagaaacatcaaggtgtgagccacattaactgaatgatatagaactagctttctgtttaacgtccagtaatctgggcaggacagagtctcacactctgtgtaagttcgtatcttctactccctcttcagatggcctctttcttgccgttcatcaccagctactcctctgctcctttgccactatggatacttaagctgttaaccattttacttaggtagctgttctctttcagatggttaatttctactaatttctgacctacttaatttctcctaacccccatctttgcctagattcattcaaatagcagtttttcccctactaaaaagaatattttgaaagttaatgttaccatttaaaattcaactaaaaaaatgattgaactcagtgtagtttcctacagtattccccagcatgacagtattcctcacacagtaggtgctcaataaacacttgctgaaacaataaatctgactgagttacataattttttaattggcaactgacatgctctcacaaacaaattaaaacaagaataagataaaataatttataataataagaataatatatgcatatcatttcatctgggcctttttcatactagaatattttccatgaggataaatcctattcctcttagctcttaaattgtagctttcaaatctacgtatatactcttttattattaaatgtcatttatatcaggctctgttcatgtcatgccataaggagtgcaactcctcccctccaactagatgtcagagaaagaaaagaaaatattagcctgaaattttgttgcttaatgtctttcaatgcctcctcagctgtctgtaagataaaatcgaatggcctatgcatagcatgtatgaccttttgtggtccaagcctgtcttgtcagcctcatctcttgctacttaccacaaagtgcactacacttcagccacagaaaattacttaaaatgcaccatgggattgatgaagttgagcctgttcaactgttgctcttcctgccagtatgctgtgttgtctaccaacacctgtctcactggttcttttcattcatttcagtttcctccacactgctcaaattaaattcagataatacctcctcacggtaccctttctgtcttccagctgtgactaagatgtgtgtcttctgtgctccctctcaatcttatacaaatgttaccattattcttattcatcagtaattattttttattttttatttatttattttttttgagacggagtctcgctctgtcacccaggctggagtgcagtggcaagatctcggctcactgcaacctccgcctcccggattcacgccattctcctgcctcatcctcctgagtagctgggactacaggtgcccaccaccacgtctggctaattttttgtatttttagtagagacggggtttcactgtgttagccaggatggtcttgatctcctaacttcgtgatccacccgcctcggcctcccaaagtgctgggattacaggtgtgagccaggtaattatttttgagattcaactatgttcaaggcactgtgatagttccagggaatgcagatgatacagtgccaaacaaaacagatgcctacatcaccagtctttacagagaagagtagtgtgtttgcttacctcctcccactagacaatgaatacctaaaaaaatggggcctgcctctgatttctatgttcccaatcactggtacctcatagacaggaagtgctcactgatgaataagcttcccttgtcttatatggagaagtcttggaccgttaatattcaggacttcacaatcacagttgaaacatatcttattttgaaagattaccccagtggcacgttggaaaacagaattgtatacatagcttatttgccttcatttcaattacattatttctgcctatttcaatgcttgtttcacattgtgatcgaaagtaaaatgataagaaattgtttacattcaaacaagttaatattttggactactactttcaatagaaaaaaatattatggaataaggttgataataattaaaggatctcagtggactttagtggaatattactgaaagttgaatttcatttttatatatacaatatcttgatagaaattgtctcttcttctatttgacttgttaactacatggcacaaatatattcatgcaaagttcaatttagctattgtgtttgcatagctgactaataacacatatcactttaaataaattttctctcagaagtctaagctaccaattgaataaaatttgaagcaagttgcatagttggaatttgccatatgtattccttattttctataaattggcttaaatattgtcataattttatgaatattacatatctaatgtcaacatttcagacactgtaataagtctttcttctaacagactcctccaaatacaaagtgtacatagttgtctgaattaattcctttatgtcttcatgaatttcccagtgatcctgagcccacagcaatgaaaattttactgcatacttacttactagtcctaatctctcagagacaatgattatgccacttctaacttctagattcatgtataatatttgatattgtaaataacatcaatattcatcctctgttttctattattgctatataaatatatacatatatgtttatatgtgtgtatttcacagatgtgtaatatcagtgttattattatcaatctagaattgaaaacagaatttttacaaagcattcatttttctgtacaaaatattatggaaatatatatgcttggattatttatatgtttgcaatatttacttataataaattcataagctaaacatgaagaactgctgagggaggaagcatagtaaaagtgtatttaaacaatgttcaatggcattatttataaatgttgtcaatcggttattttatctagaatgtgcaataaaatgggaaaatattaagttaatggattcaataacaagcccattattactgaagctgtagtatgacttctgtagccctaaagattatagctgagcagcagaaggggaaaaaagtagatcatccattacattgagcagttaatgatattttattgcattatttatcaaatactgtggatgttatttgtagctgcaagcttgaccttagctaatcataatttgatgaatgtgtatatctgaaaggcactatgacaaaatactctattgttttatgaagcaggaacatgagctagtattatgaaattcagtaagtgtgtagtttcaagatattaatgctcagacacttatgcacaagacagaatagatgcttgtaattcagacatggctgctgaaatgtctttctcttttaataatataaatattcaagccatctatcttaactgattcctgcaaagccattttataaatgcagtaagaagactataatgataatatattattaatagaatagagttctcattctatcaggaagatgtgaagaaaattagaagcttttcgcagtgttatttaggagtttgtatttagttggatttcaaatatacatattttggagagaaaatataaaagtgataaacaagtaccaactgcataatttttaactttatcagtcttctaggaaaggaaatgcattataatttccaagatgagaacaatattttattttgtacaatttttttaaggttggaatgagaagttagctcattagaacttcttttcatatgtaaagaagcattgataacaatgaagaaatattttgaaccaataatataacttgtaaagcatttcttggatattgaatcatgcaacttaatttacacataggccaattaaatttatcacagaaggagataaataaaactaaataagaactgcctctaaactaagtaaactaagagatattcccactgaagcaaactgcctatcaatgacacttgatcaataaacacttcagcgttttttgttttttttttttttttttttttttagacagagtcttgctcttgttgcccaggctggagtgcagtggtatgatcttggctcactgcaacctctgactcctgggttcaagctattcttctgcctcagcttcctgagtagctgggattacaggcaccagccaccatgcctggctaatttttttgtatttttagtaaagacatggtttcaccatgttggccaggctggtcttgaagtcctgacctcaggtgatccgcttgcctcggcctcccaaagtgctgagattacaggcctgaaccaccactcctggccagtttcattcttgagcatagtttttttcttctagtatatgtaaagaacttgtaaattttattttattttttaacttttaagttcactggtgcaagtgcagatttgttagataggtaaacttgtcacaggggtttgttgtacagattatttcatcacccaggtattaagcctagtacccactagttatttttccatatcttctccgtcctcccattctgcaccctctggaaggccccattgtgtgttgttttcctctacgtgtccatgtgttgtcatcatttagctcacacttataagtgagaacatgcagtatttggttttctgttcctgtgctgtttgcaaaggaaaatggcctctagctccattcatgtccctggaaaggacatgatgtcattcttttttatggctgcatagtattccatggtctatatgtaccacattttctttattcattctaacattgatggggtatttaggttgattccatgtttttgctattgtgaattgtgctcagtgaacatatgtgtgcatgagtctttatgataaaatgatttatattcctttgggtatgtacccataatgggattgttgggtcaaatggtatttctgtctttaggtctttgaggaattgccaaactgtcttccacaataactgaactaatttaccctaacagtgtataaccagaacttgtaaattataaggtgaatctcactgaaactactgggtgtaagtatcaaattattatgttttacagtatgttatatctaatgctgaaggttcttttccaaatgtggatgtcaaaattttacattatttcaaaattattctatgtgataaactgaattattgtttcatgaatgttaaggatttcttttctctctcggggatacagcatatttcaccgtaacaatgcctttgcatgtggttatgatatttgttttgtctatatgatagaacagaaaagtatagaagtcttaaatgtatttgtataatttgattttggttatgtgctcctgggatcctttcttagagagcatgcactttttaacaacattacattcagccagtttccagagtgaaactcatgattcagctgaccttgattcaactgaggattccagaaacaagcccggttgacccacagcttataggggaaacactaagctgattccaaaagagctcagaagagacactgttgactcacagccctgtgagttttgttgtaagccacagactttgaggtggtttgtaatacaacactattgttgtataaatcataaatacacatatgagtttctggagtactattgttaagaaactctcttattttgttacgtaccatagttaagaaacaaattttatttattatcatattaaattcatatgtttccagtctaatattttgtatatcactgttggatagagacttagtaactgaaatctagtctgggaaaatatttatggaaaataaataagtcatagcagaaatactttatatgatatttaaaattcattcaacatttaaaagaaaataatataatcctgtgtacttatcaattcactttgcaaaagacaatacatttgagaagaaacttaaaatcatactattcagacatatgaatcacattgctggagaaagagcaaacattcagaatgccagtttcatcccaaaatttgaatcacaaacaaataaagacttttgaaaaaaatctggtgaccagtagtcgcaaccttttctttatcatatttataatttgatttaaaaaaatgaaccccattctacacctttcaaattttagttaccaggaacaataattagtaatagaacaaagaactagaacttcatataagaaactgaggctcaagattaatattaggccacaaaatagagaaatttacaaggtggaccaagagttgacctcaattcttctaattctacaacccgtatcctactcatgcattaatctcatggaaatatttcctatgaataaacatatctgatttccagaaaggacttaaagggttacagaatatggggctactgagtcacttaatttttttttctttctcattttgtgggaggaggcattcaaaatctgttttctccgtaaaatctcttgcaattttgcaactgtcagcaaaggtagtcttgagttttcaaatttttatttaagaagcttttggatgataggaaaggcagttaaagagtgtgaaataactacagtctaaaaacatacatgaattcacagaaatttcagtgtatgagagagtacatgtaagcactttgatttttagagtaaaggattttctacttacctgattggtactgagctcaaaacacaggacagttgtgccaaaggtttgttgctgttttaacagtatggggttaatcagaatgtgaaagggcagtgaattcacatgtaataataaacaaatatacatttaaatataccagcctaattagagaagaagaaatgccattgatttctagataaaatggaggtgtgtgtgcttgaactttgcggataaggtccagttgtaatatttactgagcaacttggtaactttattcaatcaaaaagttggcatttaggccaggtgcagtggctcacgcctgtaatcccactactttgggaggctgaggcgggcggataaccaggtcaggagatcgagaccatcctgactaacatggtgaaaccccgtctctactaaaaatacaaaaaaaattagctgggcatggtggcgggtgcctgtagtcccagctactcaggaggctgaggcaggagaatggtgtgaacccgggaggcggagcttgcagtgagctgagatcgcgacactgcactccagcctggggacagagtgagaatccgtctcaaaaaaagaaaaaaaaagttggcatttataagtcggctggctgggaagcaaagttaatttgagttccactctaagttctgttacattttagcagaataataatgagtcatttatttatctttttaaaattctagttttcttactgatgagatgaggataataataccctgccttataggattgtggtgatgattttatgtatctaaatggtaatttaattgttatgattactgggtaaactttacaatgtaacagttgcagtgtttggtactagagataccaagataaaagttatggtcttctagaagaagagcaagaattaggtaatgtcggccagatgcagtggctcagtcctgtaatcccagcactttgggagatcaaggcaggcggatcacctgaggtcaggagttcaagaccagcctggccaacatggttaaactccatctctactaaaaatacaaaagatagctgggtgtggtggcatgcacctgtaatcctagctacttgggaggctgaggcaaaagaatcactggaacccaggaggtggaggttgcagtgagctgatattgcaccactgcactccagcctgggctacaggaatgagactctgtcaaaaataacaacaacaacaacaacaacaaaccagaagaattaggtactgtcaatgagtaataagtgctccaaaagcctaagcagcacggggtgcaataaaaccaaaaagaaggatatttaatcaagacaaagtggtgagggatggcttttagagtaagtgatattttacctgagtttttaagggtgtacaggaattaaatctgcaaaacggtgttgggaaatcaaattcttcacaatctgacgtatgcattgcatattcaataaatatttgactgataaatacataattgcatagatgtgtaaatatatgtttgaatgaattagttacctgttgataaaatttcttttgcctatgataatggttggaagaaattcatcatcaatttgtacactataaacaatcatatgattattgatccaaatattaacagaatatgatacataaattattgaaatgtttacagttccactgttattgtgaagtattttaacctataataaactaagaaaacaatttgcatctttaaaagatgttaaagtgtacatacatacaaacatgtaaattaaaacaaagcttagaaggtcaattatttttccagggaaaataatattatctttccaggtttttgaaaaattactctaaaaatacttatttaactttggatttcttataattacaattatgtagagttttctaaatgtatttgatatacatgaataaatgaatgctattatttactcttcagagatctctttgcccaatatgctttggtgaaaaagtacagaaatacacacagaaaaacttttcctacagcatttgatttgtatcactttcttaattacagcatgtctaatccacatgatgtaaaaaaaagatgtaaaaaatgatttatacacctgaagcttttttatttctagcttggaaggaatacaagggatcatacaatccaatatcattattttagatataagaaaactgaagtttggagagacaaaattttttttccaataaaacacatttagaaaactgattgagattaaagcactttcttctatattatcttttaaagagtgaatatataagaaacataacaaaaattgataactcaattgtttttagagatgtggcagactctgctattcacctacccaaggcaaatcccatctgttccctgataagtaaaaattgaatttattctcttggcaaaatatccagccttggagggtatagtaatcactgattctcaatgggtggcagtgctgctcccctccatgatgtatggagaatgatgtctttcatggtgattagccataggcatttaatgcctaggaattatgagacagtcctgcactatagaaatcggcatcatccaaaatgtcaatgctgctagttggaaacactggcttcactcatcatgccaatcgtgtccctcaccttgtcaggatttagtggagggatgggaatgttaaccagttcaggccaatgacacataaaatgaagtctgtgatagactccaatgattttttcttcctagtataaagaacaatcacttttgctcctaaacacttcatatggtttgttccctcttctcccagaataataatagcagatgctgagcagccaccatgagacaatgaggccactagcataataaggtaaccaaaaggatggcagagaagagggaaggattactgaatcaacttggggaatgtatgccttcttaattctcaattaataaacaacatatagccatatgggctaaacgctgtccatcagactatccgttatttgcttttcaagacatactaatggatgaaatagataccttgggtaaaattggttgttgaaaataagttatgtgaatattttcaggctattattaagtcattctaaagttaatgcttgttctaaagaggctgtatgctccattgatattagtccactgaatattatcattgctctgaaatattattagaaatttggtttaattatatatatatacttttttatatatatactttatatatatattttttaaatatttatatatttatatattttatacatatatttatatatatttatatatttatatatatttatatatgtgtataaaatatttatatattttatatatatatactttatatatatatatatatatgtacttttttttttttgagacagagtctctgtctgttgcagtggtaagatctcagctcactgcaacctccgcctctcgggttaaagcaattctcctgcctcagcctcctgagtaactgggattacaggatcacacaccaccatgcccagctaatagttttagtagagatggactctcaccatgttggccaggctagtcctgaactcctgacctcaggtgatccacccacctcagcctcccaaagtgctgggaatacaggtgtgagacaccacacccggcttaattatgtttttttgaggaatattacatgtaacttgtatcactatttaaataatatttcagaagtacatttatgagtcccctttctcacttttgttcatatcttcttgttaagaaactatatgtctaagagctttaggaaaaaaagcataaaaaaaatggtcttgaatgataagtagggacattacataatttagtaaagtaatgtaaggttaaaaagatggaacataataaatgactttaaggaagcaggcgatctagctaattcaggtaacaaaaatttgagatctcagatctaatcagtttcttttgcatatattagacaatgttactgaattttagagctggaagagatcatcctttgcattatacagaggttctggcttattttgaaagaatatttttattactataatattattcatggtttacttatcttaccatattagagcattcacagggaaaaaagactgtaatagctaaaccaatatacattcaggacatttttaaattatgcttttaaaaaagcacagaaaatggaaaatacactaagcgcctcagaactgtgtatcatccaacaagtaagagaaaaatgaggtgagttattaaagcttggattacacatttcaaagttgtattcaaggaaaactcctccagtaaaaatctgttctttgttatgcacattcaaccaatgtaagtttttgatgtgtggtactgagcttttgtattttaaaagtgcagtggccttttgaatttacaattcagtgcacagtagctataatactgtaataagtccttgattttctttcccttgaaatctataacacagctttaaagtgagtgtcttctcaatacaacttcatctatttttttgtgtgtgcttgttggcagtgatacattgtatggatgtaggatgggctaacatatgcctcagagtttcacaaaaataattcaattagtaccaggagttaacaatacatgctgcagaataataatatgtggaaatataaccataattttacattttctaagctggatatttttatttagtataatttcctttatcctgatcttatgtccacgatttaaatgtgcagtaaatatcaatgagttgtgtttttttctcttttactatagaattttttctccaggtaataactatcattcaacaacaatactttggattctgtaaaaaatctaaaagtaaaattaagaagtttaaacttttatgttcaactgacggacctcaaacctagatgcattagcctcatttggagcatattttaaaatattgatacccaggctccagttcaaaaattctaagttattgtgagtttatttattctggagtgaagcatgtctcttaatactttttaaaagcattccaggtgattctcattgcccaatgtgagaaccttaaaaaatatatatttgtttataataaatacatgcttagaatcaaggaatttttttgcacaaaggcgtggagattatcgagctctacacatcttaaaagattactatgctcacacatctctaggcaaaaagacactgctgcatttgacccgcagcaggaaattaatgctcttggcaattatctggatgcccatccatcatttggctacttataattataatggaaaattttattcatgtttcaagtatattttctaaacaaacaaaatgaaacaaaaacacaaaggtgggggagaaggagtgagataggatgcagaaaagcaggaagtggcaggtaagatatggggcagggagtgacaaagatacaatgccattatgtattttacttttatataattatcactttagagtaaataaaattagaagtaattgactattgactcattcatgaaaaaagcacatctgtagctattatggtagccataactgttataataaaaatactttcagacactgtatccaggggattttccaacaatatctttgcctacctattttgtatcatttctgctagtcttccttcttcttttttcttaatacaaatgttcctcagcttttctacagaagcttttttcaatctacgatttgaagatcacttgtacccaaactaccaaaacctacacatttcatgacctcattcagacacagtaaatatgaattctcaaagatggaggcctgcattttattattatattgattattatgcccattagtatttggaacatttgcctttatagcacttgccatattctattgaaaatattcacatttcagcaaaagaattttatggagagcagaaaatgagtttttttccttatattccaagcaaccctcatagtatttagtactttgtacatattaatatatatgtatgaagtaaaagaatggctcagccaagcaaacatcatcatgctcatttagacagataactcaatgccttcaaaacctcccaaaccctcttttgaatcaacttgatttttttgcctccaaaaccccgttttaaaccaacttgatctttactggtttctctaggtaggcttttgcctcatatccacacctttcttagatttttcttttttcctttgggtgttggattattgactaaaaccttaaaaagcagcctatgaatcaagtcaagcagatccctatatctagtgtagatatcttatgtttattcaccctacttctactttattagctgtttatccctgctttgtgtatattagctcctcattaaatatttttaaaataatataatttggtttttattagaattatataataatcaggccaggcattttggctcacacctgtaatcccagcactttgggagggcaaggtgggagaagtgcttgaggccaggtatttgagactagcctgggcaaaataagagaaagccatctccacaagaaaaatttaaaaattagctgggtatggtggagcgtgcccgtagtcccagctatctgggaggctgaagtgagaggatggcatgagcccaggagtttgaagctgcagtgagctatgatcacaccactgcactgcagcctgagtgacagagatgccatttcttaatttttttaattgtgtaataatttgtaagtttttagcatcagaatatttggaagtttgtattccgagaaacaattagcattatttagttgggaacaacaacaaacagtattcggtgtgtattagtttcctgatgccactataacaaatgactgtgaacttggtgtttaaaaccgtataaatttattttctgacagtgctggaagccagaactttaaagtcagtatcaccaagccagaatgaatgttttagcagaggctgtagggaagaatcaattccatgcttcttccagcttcctctggctgttgctattccttgatatgtagccacatcacttcaatctctgcctccatggtcacactgcatatagaaccgacctggataatccaagataatctgtccatctcaacatgcttaatttaatcacaaaagtctgttgcaatttaatctgcaaagactgttccttcatctaaggtaacatttacaaattacagagataagaacttgatcatatactatcatagtatattaacatacatgtatacatatatggtatacatgtataccatatatataaatatggtatatatattcttgtccatggttcctgactcataagtcccatagcccttttaatagtcttttgttatgatgatgtttgggtgctttaggtctcataagcaggcctcaggaaacagaatctctctctctgatcttctcctgcccgtcttttacttgctcctttttcttcctgaggcaggccttagaaactaaaaatatattctaatcttccaccacctttctgtcttggagttggacataaaaaaattatctcacctactttgtttgattgtaggtcagagacttccattttaggagtcctgccccataccagagggaaggaatgtctcacagggaggtcaagaagaatctgaacaggcaggtctgggatttccgctgtccaggccaggtattagatgacaggctttttgtccaattacatttgtttttatttatttatttattttttgagacggagtctcactctgttgccaggctgaagtgcagtggcgccatcctgactcactgcaacctccacttcccggattcaagcgattctcctgcctcagcctcccgagtagctgggactacaggcacccaccaccgtgcccggctaattttttgtatttttagtagagacagggtttcaccatgttggccaggatagtctcgatctcttgacctcgtggtctgcctgccttggcctcccaaagtgccgggattacaggcgcgagccactgagcccatcctttgtccaattacatatttcttttcttttttttgagacagtcttgctctatcacccaggctggagtgagtggcgcaatctcggctcacagcaacctccgcctcctgggttcatgccattctcctgcctcagcctcccgagtagctgggactacaggcgcccgccaccacacccggctaattttttgtatttttagtagaaacggggtttcaccgtgttagccaggatggtctccatctcctgacctcgtgatctgcctgcctcgacctcccaaagtgctgggattacaggtgtgagccaccgtgcccgggcctgtccagttacatttctacacggttgtccttgcttcaatcatgtctatccaatgaagtctccatgaaaggctcaagaggagaaagtaaggtgagcttctggacagctgaactactgggagcttacaggaaggtgaacaggaactcatccacatgcagggagagtgttgcaccccaactccacagcaacaaaagtttctacacactcagaactcttccagaccttgccctatatataacttcacctggctgattatttgtgtcctttaaaatatgctttataattaacaggtaaacgtaagtgtttctttgtgttctgtgtcccatactagcagattaatcaaacccaagaatagggttgtgggatccctgatttatagctggtaggtcaaaagcacaggtaaagcaatggggtttgtgattggcattggaagttcaggggagacagtgttgtgtgactgagtcctcaatctgtgggaactgaggctaactccaggtagatagtgtcagaatgaactggaggacacccagctggtatctgctgcagaattgactgcatgcttagtaggtgagggcgaaactccccaacccttttggtcacagaagtcttctatatttgtggttgtggtgtgagaacagaggggaaacaatttgtcttttttcctctgtgggtattattcacactattacaatgtggcatgaatagccttccagttgtccccaataattacttttctttttatttcttagtattaggatttttactaaataaagactgtattacccaacttcccttattcacaggtaaaaacataacaaagctttgactaattttgatgtaggtaacttttggaccattctctttaaagaaagaggtagacgattttcttctcctattcttcctgcttattggttggaatgcagattagatggtaagccattttagaccaagcaaatcacacaagcctccaggaatagaaaaggaaaaacagagaagcatttgttcctggtgccatctttgaactgagctttcatataaacttgaatgtaaacatgagaaagtaacatcatgtttaaattacacttttttgtgttttctgtatattctcattaatgaatatttcaattaatatgaagatgttttcagatgtcacagggaattttgtaaagttagtgatggagccttttatggtcagcaggctaatatagaggtagtcataatgacaaaaacagtcaaagtaggatttttcttaaactgcatactgctgcatgacttgtgagtaatttagcttttctaggattcaggtatttatctacatctaaagagtggttaagtgagtatctagcatatgtgtcttggagcctatgtagaatgatctcacagaaaattttagtgtttcccttttccttcttgaataaattagaaggagagactttactaaagaaaaattgaatacccctatttataaagaaatggctgtttttaaaaaataattttgaatttatctcagtattttaaattaatttggttaataatagtgtttacataggtaacttaaatatttttgaactcatggatttttttttatttttgggtgtaaaattcagttcatataaactttcaaaggtcccatatttatgagatttattccatactaaagttgtagataacatatatatatgtgtgtgtgtgtgtgtgtgtatgtgggtgtgtgtgtgtgtgtatatatatatatatttctattatggctgctcacaaatatttataaagcccctattaagttaatggcagagtaaaaagccatagaataacaacagtacatataattttaacaataacaacaacaaaaatcactggatttttcaatgttaccatgtcacatagcttgaaagaaagtcaggtaaggcaaatggcaataattcattttaaattttacttatctcttcaaaattttgtcaaattagacaaaaaagataatctattcctaaaaccagcttatgtttattcactttttttcctataagttctaagagaagttttcagtttttggttctgattgatgagacaaaagtagaaagaagtcttcacttcacgtcttgtgacatatttctagcttccagcacattataacattagcaacatctcccagagaaataaagtttttggaagataaaatattattgcacttagttttactagtttcaaatatttgcaactaaaaaaaccattttgttatttaagtacatgaaacatgaaaaatagttaacagtcaaaaataaggctaaaaatgaacctacacttggaaaagtgacatggaagagttctaagaaacaatttgataatttaagacttgtacaagcgcttacaaacatgtttatgattgctgacttcttgaaaatatcatttttgtaaaactgcatgtcctgtattgatagttaatgccatattctatattattattaacatattattatattattattgtggaaaaatctttgccctttaagggtatactttaatttggtgtcgtctatttaaaacacaatgcaagcagaataatactcttttcagttgaaaaaataggccgggcacagtggctcacgcttgtaattccagcactttgggaggccgaggcaggcggatcccttgaggtcaggagttcaagaccactccgtctctactaaaaatacaaaaactagcaaggcgtggtggcatgtgcctgtaatcccagctactcgggaggttgaggcaggataattacttgaacccaggaggtggaggttgcagtgagccaagatggtgccactgcactccatccagcctgggcaaaagagcgagactccatttcaaaaaaaataataataataaaaataagaggttggggacaaattgttcctcctccatattctcaaacacactatttatatttgtagtagaaaaattatggggtttcattgtatacaatttggtattcttggaagatagataggtagataatagataaatagatatcagtagacagagatattctttttctttgttcttcttgacaataaacaatatctgttatttaccatgattttttctatatttccaatacttttcaacttatcctagactctaacatatagtaggcactggatttatatactgactttaaaaattaattttatctggttataaagacaaatctaaaagactatttcctcaagtattttgagaaattgcagcattactgatggaatttctttcttttaatgtgattttaaattgcaaactttactgaagtaagaaaaagtggaattattatttattgagcattttctcccagctgactctgaactaggaactacacatataatcttattttatagtctcacactaaacttctgggtttaggtaatattaactaacatgttttatgacaaagctgaagctctgacatgttaaataacttgtcttactttatattggccatgactatcaaatttgaattcaacatttcttgattcaatgcccattttatttctgctatatcactactgttatggcatctttatttaaaacagcaatatgttttactgagttatcagtagcactttcttacataaatggtaaagcttaccttccaccattgacattgattattattatttcccataacctgccctagggaaagttttcttacagggaatgatgctttaatatatttagacaatggtctgtaaccatgtaacgctgatggaagtctctggaaccattcctgtaacacattgtactaaggaaaaatatatgcaaataccctgttagcagcttctgtttccttatagaaagcaaataatctaatagaatttttgctagggcagaagtggtgtactcactaggattacagaaatgtcaaccacaaagaagacataattccatatgacagaacatctcattcattttagaaagtaagggtcccatctgatgttttttttctgaatttttacatttaaattatatgcctctattagaaattaggatcattttaagtttttgaaattttcgctcttttaagaagagaagtaatagcaacacatgtaatatgtatgcattttttaggtatagattttggaaggaagcagaggaagactaaaatctctcaagccatattttgccactgttttcctgaaatactttttattgtcctggaagaatgaagatagtttgactcccaatggggacacttttatgattggttgatctgaaagcatgcatatggcaaggacagaatcttaaataaaatgtattaaaaacattaagttaggcaggatagtttttgataataaaatactgaagcaatgaaattctgtaaaattgtatatactggaagaacttggattgtgtatatgtgatattgagataatcaaatattaccggaaataataatgaagactgtacattaaaacctttcactggtcatggtggtgttcaccagtagtcatagctactcgagaggctgacacaggaggattgcttgagcccagaagtttgagattgcggtgagctttgattgcaccactgcactccagcctgggcaacagagtgagatcctgtctcaaaaaaaattcataatcatatttaacggacttggtgcaagagcatttaatattatgtcaaaatgacaataaaaattacaagacactaaattaataaaggcaagtttgcagtatcaggctgaacagtgacttccaagtatatcatatcctagtcgtagacctggtacatgttacttgtatatgtcttataaggaaaaagggtctttgcatatgtgactaaggatcttgagatggggagattatcctggattatacaagaaaattctaaagatgattattttaagagccctaagtatattcttataagagggagggagagggagacttcacacacagaaaaagagtaagcaatgtgaccatggaggcagaaattagaatttcaaaggcataagagctctttataacctagtggtactaattttaaacttctgacctccagtactgtgatagaaggaatttatattgtttcacacactgaattggtggtaatttataacagcagacacagaaaacgaatacacccacattttaataaaaagaaaagaaaagtctgatgtaaaaaacaattattgttaggaagattacctaatgaatataaaagatgattgatcatctatgaaagacttatggactgcctttgaaagtaaaaatagatactttctcttagtatcatatgggaacatcaaatttaattcagttacaaatataatgtgtaactaaatgagataggaaagtaataatttattttatgtgatttgacttccttggatcttcctagtagaaagacagtaggtttaattttcctttaaaactagatattccatctctcaatctttaaaggggtgaaattacataaaagaaacaagaaaaaaagttttcagaaactatgaaagattccccagaatgctttttatcaataaaattgaagtattttaaatgttaatagtaacatttggactcctattccaaatggtgatggacgttcttgccagtacaataaggcaagaaattaagggagaaataaaactgttcctacttgaagatggcatgtttatctacgtaaaataatcccaaggaatctaaaaaatgttcctagaactaataagtgagtacagaacagtcaataaacagcagaagtcaattatatttttatatgccagcaatgaactagtggacaccaaaactaaaaataaaataccacttagaaacagtcataaaaaatacttaggagtacgtataagaaggcttgcaccagacttgtatgctgaaaactacacaatactgataaaagaaataactgaagatctaaaaaatgaaggagcacattgggtttatggatcaattgactaaacgtagtaaagatttcaactctctcaacttgaaatacagttgtaaagcaattcttatcacaatttctgaattgttttttatataaaattcatacagtgagacaaataaccaaatgagctaaaacaatcttgaaaaagaataaacaaataggtagaatcagtctaactgatttacagatataatatatagctgcagtaatcaaagtgtgtgttattgctgtagggatagaaaatagtttgatggaccagaatagagaccccagaaattaatttacacagatatatccagttgatttttaatagagttgcaaagcaattcagtgagggaaagactgcccttcaacaaatggtgctgaaacaactggacatacataggtaatatgtatgtatttatattatacatacatttataaatacatgtatgtatttatattatacatatatatatatatacacaaaaaatatatattatatataaatatatacaaatacatattatatacaattatatataattattatatatatacagtaatttttatatatatataaaactttgacttaagtttcacctagtaaacaaaaattaaccctaaatggatcatagaattaaatgtaaaatataaagcataagtaaaaatatttagcatctagagctagtcaaaaagtgcttagatgacaacaaaagtatgatacaaataaaaaattgataaaatggacttctgccaaattaaaaccttttgtcctgtgaatttccttattaagagggtgaaaagacaactttcaaagtggagaaaaatacttgtaaactgtatatgtaataaaaagctaatatctaaaatatatgaagaattctcaaaactcaacaaaggaagacaatctgataaaacacagctaaagataggaagagacatttcaccaaagattatatgcaaatcgcaagtaagcacatgaaaagttgttcaacatcattagcaatttggaaaatgcaaattaaatcactacatatctatatgtattttgttttttagccatttagtggaatggctaaaagaaacaaacaaaaaaacagtgacaatagcaaaagttggtgagaattcagaaaaacttgtccattcgtacattgttgctggtaatgtaaaatggtacaaccactctggaaatcagtttggcagtttctttaaaaaaaaaaactaaatgtgcaaatgctatataactcagcaactatactctgtaaaggatgagataaacttttttatctcttcacacactcaacacgcatacttctgtgaccaaatgtgtgaggatattttacacgtcaagtaattctccagcagaccccaactgggtatcttccagttcaattcaattctaatgctatctacctggagatatgtcagatccataggttgtgggctcagtcccatacgattgtcctcattttagatgccagttgcaagtagtaggttgtcacctatacttctgactgagtgattacaaactgggcttcccatgatttcccctatggattgaattaatttgccatgaagtctcgcagaactcagggacacatttattggcatgatataaaagattttataaagaatacagatgaacagccaggtgaaaaagtacatagggtgagatctgcaagggtccaaaatgcagaagtttttgtacccatggttaatatttatcatttttcaacattgtgctttaaaatatgtagtagaattgagtatccttatcaacactgttttcacagaatatataatcaagcatctttgctcagtattataatttctgacattatatattaaattataatggagaatgcaatagaagattatacacgttgttaacctgtaactgaagggtgtagtgagaaaatgattatattatatttaatcattcttattctaaaaacaatgttatgagaatattaggtatgcagacctcactatttatggggaaaaaaagaaagtttgggtgaagttcttatttgcttagaaatgcatactctattgtggttcagtgggattaatgtcattttgaagtggaggttactggagtagaatattacttttttttaagtttaatcagtttgctgtgtgattcaacaatcccctcaggtgcaatttgattcagtttcataaaactgtttattctgtatgaatttgtgaataaatcatactcctcgctactctgtaaggttcatttagtacatactcggtagaaagacaacgttttttcaagaagatgaagacatattgtagccttatgtcagccataaggtttaaactcaacacaggaatttatagctgctttttctttttagaagcacagtctagtcaagcattaaatgtatagttaacagatatccaatagtcacaagaaagttgacaacttaaattacttagttataatgaagataaatagcaatctaaacatgggtatatattgcaccctgcaatgcaattgactctaatgttgttgccaggcaacttccttggatagattaaacattcttcctgtaattgatggtatcaagacacacacacacacatacacgcacacacacacaactgcagaaatgaccaaatctcttgtgttttaaaaaatagtgtcttcataaaatgtgtttgaatgcacacatgggtgacatcgaaataaaattctattttgtagtatgcttcattttgtaagtctttaataaaaatatgacccatcatagattttcaatcactcacagtacatttaaggattgaaatcagctattttctgagatgaattgagtgttcttaagagatttatatatgtgtttgaggagattttgtgaagcaaaaattaattagaatgacgtaaaataaatttcttatcatttatataactggaataaattgttattacatagtaaactctctctctctctctctctctctctctctctatatatatatatatatatatatatatatatatattcttgcatattgggtactttttaacttttctaattttattttatattttttaaattttattttttgcttccccaactggtttcccatacctagagtctctgtctctgaaattcacatacacaaatactattgaaagatttataataatttttggtaggaagggacatatttaaaaattatgtaacatttgtgactcagaaaaacaagcttgctaacctatttatttttctctttgaatagattgatctcattatttaattgttatcaaaaaggagagatagaacttctgtctccatttttccagaatagtatgtccagctattcccttgttcatttttaatgtcttctaaatagtatataacctattatttaagttttagaaatggttcaagtctgtctacgttcagtcactcaatgactttttgtgaagatcagaaaaattttctagacattttctttctgatttattttcttatgatgcccccagagtgtgtgttggttgggctggggtagcgtagtaaggaaactaaatatctaaggcagcaagaaatttcgagaaagaaaattaatctactttattacacttctctgtgaagaactctaaattcaacagtactcattctatttagctactttatatctagaaattagttaatgaaaatactaatacaaagtaactacaggtttattcattgggccaaccaaattttatcaaataaatgatatgttttaggaatggtaataggtgctgaaaatagtaataataagaagaataatagtattccacaattaaagcactgaaagaattcaatgccaagagcgtaatgataatgcattggcatttatagaagctgtgaaagttttcagattcaaaatgtagtcactaatattaaaaacaaacaatcaaaaacctgtggcaattggagacacagaaggccatgaagtgtgcattttcatctttgtatgcttgttaacaaaaactattacaaaggactgcaaaaaaaaagtttgcacaaaagacatcacaaccttacagaaaaattacttctacaaggacttcagcccagcaactacctgttcaatgtcaaaatggaattaccctgattattgatctttgtagccaaggataattatttctggtatggtttagaattgtgcccccacccaaatctcatgtctgaattgtaatccccagtgttggaggaggggcctggtgacaggtgattggatcatggaggtggacttctcctttgctattctcatgatattgagttatcacacagcctggttatcaggagaaccagcccccaatttttcaatgtaggtatttcgattttccctaagtgttggccgatctgagaaataaagagaaagaatacaaagagaggaattttacagctgggcctccaggggtgacatctcatatcagtaggtctgtgatgtctgcctgagccgcaaaaccagcaggtttttattaaggactttaaaggcggagggggtgtacgaacagggagtaggtcacaaagatcacatgctttaaagggcaataaagatcacaaggcaaagggcaaagcaaagatcacaaggcaaagggcaaaattagaattactgatgagggactatgttcggctgtgcacgtattgtcttgataaacatcttaaacaactgaaaacagggtttgagagcagagaactggtctgaattcacatttaccagggcaggatcttttccctaccctaataagcctgagggtactgcaggagaccagggcataattcagttcttatctcaaccgcataagacagacactcccagagcggccatttatagaccaccccctaggaatgcattccttccgcagggtattaattattaatattccttgctgggaaaagaattaagcgatatctctcctaattgcacatccatttatagcctctctgcaataagaaaaaatatggctctattctgcccgaccacacaggcggtcagacctttggttgtcttcccttgttccctaaaatcgctgttattctgttcgttttcaaggtgcactgatttcatattgttcaaacacacatgttttacaatcaatttgtaaaatagtggtcctgaggtgacgtacattctcagcttacgaagataacaggactaagagattaaagtaaagacaggcataagaaattatgagagtattaattttgggaactgataaatgtccaggaaatcttcacaatttatgttcagacattgcagtaaagacaggcgtaagaaattataaaagtattaattttggaaactgataaatgtccatgaaatattcacaatttatgttcctctgctgtggctccagttggtccctccattcggggtccctgacttcccacaacacctggttgtttaaaagtgtgtagcacctcccactttgctctcctcctctgctctggccatgtaagatgtgtcagcatccactttaccttctgccataattgtaagtttcctgaggcttccccagccatgcttctgtgtagcctgtggaactgttagctaattaaacttcttttatttataaattacctagtatcaagtagttccttatattatgttggtgtaaaaatagcaatgtgagaatggactaatacaaaaaaaggtagtgggagtgaagttttgttataaagataccttaaaacgtgtaagcaactttggtactgggtaatggacagaggttggaacagtttggaggactaagaagaagacaagaaaatgagggaaagtttggaaattcctagatacttattaaataatcgtgaccaaaatgctgatagtgatatggatagtgaagcattctgaggtggtctcagttgaaaatgagaaacttattgaaaactggagtaaagacaactcttactacgattttgcaaagagcttggcagcattgtgcctctgaactaggggtttgtggaactttgaaatttagagagatgatttaggttatctggtgtaagaaatttctaagcaacaaaacattcaagatatatcctggctacttgtagtagcctatgcttatattttttagcaaagaaatgaattggacctagaaattatatttaaaagggaagcagactataaaagtgtggaaaaattgcagcctggccatgtagtagaaaagaaaaccccattttctggagaggaattaaaattggctgcagaaatctatataagtaaagaggagctaaatgttagtagccaaggcaatgggtaaagggcctcagaggtcttcacaccagaccctcccatcataggcccggaggactaggattgaagaatggtttttcaggccagactcagggcctcactactctgtacaaccttgggacaccgctccctgcatctcagctgctccaactctagccatggctaacaggggccccaaaatttctcaggccactgctccaaagagtgccagtcctaaggcctggtggcttccacatggtgttaagcctgcaggtgcacagaggacgagagttaaggcttaggagcctccacctagatgtcagaagatgtatctatgtatggaaacacctggatgtctagtcagaagcttgtagcagggttgtagccctcatggagaacctctaccagggcagtgcagagggaaaacgtggggttggaggccccccacagattccccactggggcacttcctaggggagctgtgagaagagggccacaatccttcagacaccagaatggtatttccaccagcagcttgcaccatgcacctggaaaagctgcaggcactcaatgttagcccttgagagcagccataggggctgagccatgtagaaccaaagagacagagatgcccaaagttttgggagcccaactcttggttcagtgtggcctggatgttagacatggagtcaaaggagattattttggagctttgagatttaataattgccctattgagttttggatttgcacagggcctgtagcccctttgttttggctgatttttcttttttggaatgggagtatttaaccaatgcctgtacccacattgtatcttggaagtaactaaattattttgattttacaagatcataggtggaagggacttgccttgtctcaggtacaactttggattgcagacttctgagttaatgctgaaagaaattaagactttaggggactgtttagaagggacaattgtattttgcaatttgagaagaacatgagatttgagagggaccatggaccaaattatacagtttgtatttgtgtccctacccaaatctcatgtatgaattttaatcctcagtgttagagaaggggcctggtggaaggtgattggatcatcagggtggacttcctccttgaggttctcacgatagtgagtgagttatcacaagttataagagtgagttatctggttgattaaaagtttgtagtacctcccccttcactctcttcctcctgctctggccatgtaaggctgtattttttaatatatattccaaggtatttgggttttgtgattgcaagtaaaccgtgatttttaacctcttttttccaattaaacaaaattttatgttaaattgtgtgtctgataaataaaaataaaattgacttttgtatactgaaaaacagtacttagaataagaatggagggaaaatggaccagctgtagacatttcacagatagaagaaaaattaatgtgggaagtactatcgagaaagagaagagggatagatgacttcgctcttctgggtttcagctaaaaatctaagtgaatagctaataggaggcaaagaagcttgttcagaggaaaatgaatgaaacaagatgttgagccttaaggtaagatgcctaataaactgaatatgggactttgaaactcaggagagtatacagagctagaatcataagtttgccaatgacaaattgatactcatgttactaaattaggtgagaagggacaagatctgttgctcaagatatatgaatggtagattggacctgtgtggaagttttcttctgagagattttgttgctgaaatagaaaaggaagaggcagctgagaatctgaagacatgggaagtgttggaaatttgcgcagagcagagatgttacaaagtcaaagatttgttagagtaatttttcggggggaataaagtagaatggtagtgttacactagggggtctgcctaaattattgcttatgagctgaacttaaaactggtcagcaagtgtgtgcggttttattttgccatctttagcttcccaagtattggcatacttaaaaccagggctggatttaaccgtgggagtttggacatgttagtgtaatgataaggggttggagggagagcagaagtagggatagggaaagagaagcaggaagagaagagagaattgttttgttcagtaactattttttaagtaaccagaattgtcagcacataacatatagttaaaaccaagttttgactgcctagaacaagaagcatttcaaggaagaaattgctccagaaaaatgcttacagcaagttttttttttctgcaagtacatgaaaagcaacttgaataaagagttgagaagaaagatataaaaaggtaaaattaaaattcatttgatagtttttattcatctaaattcatattaaggataaaaatcttgaactaaattgactattgtgggaaattaaacctgaagaaaaaaatacagaaacataaagattctaagaatggattttaattaatgttaaacaagttctcaaaccagaaagtcatcggcattagtcaatacagtgtaaagaaaaatacatttttgttttttaattattctcctcacggaaatagtgtttacaatattatgtgtgatcagcaaaatgtagcaagttaatcctattctcataagaacaatttcaagtccaagagcctcctttataaaatgcagggcacatattggttactttttattgatttagacaatatatgagttgtcagaaaaatcccatttttaaaatctacaacatgatttcctacctgtaggtgttttaaaacaatcgttagttacttttttagagccaaaataaattcacttcatgttgaagatctataatcttaatcattgtgtcttttcttgtttttctaactagtgtaccttaatggctgactgctcaaaaggagattagatattttgctacaagtgtacttgttacagggctgtttcattttgaaccgaatgggaagaactgcttattaattcaagccactttttttgaactgacatttccctaatttcatcagtagaagtagcagctattttatgctgctgcattccatgttattaatgatagttcattttatagaccaatgtcctttctccctgcaaaacaagtttaactcaatgtgtgactgagcactatttgtactacagcaataagcatctataacaatgatctatggaaagatgcatcttgagtttcaactggtgatactagacaaacctctcctttttaaactttccacccctattctagcagcagcagataatctatgggaaaattataggggtagaaaggaatgaatgagaggcaaggtgacaccgggacctcaagtctctcctggacttgtttattctgattgtctatcaaaagagaattacctctgtacatcagcaaacctgaattacagagaagagttaagtcaattacaggtgttctaattgtagcaaaattgcaataaggcctggaatgacatggatataagactttatttcctcaactctcatgcattctacatttattaataataatggtatgctagaccctatgttaataactaacatacaaagataattacaacatggtacctgtaagaggaggggataataattgagagaagagatagtcagtgggcatatgaatacacaggagtatcatggatatatgaaaaagtgatggaacaagagtttagtgtagtagatgcagtctgtattgttaggactttgaagtcaatctaagtttgaggatttattttttcctatgcacaatggattcatcataaataattaaatatttttaaagccagagaatgatatcccagtatttgaattttagaaagatcatcctggcatgattgtggagaggatcaatgaagatacaaaaccttgaaatagggaatctatcaaggagaattcagagaggacttcataggactctaagaaagaacatttggaaaggttaaaagaaaactaacaatatgtcagaataatgggtatgtccatacaacaaatacaaaacctattttaatttgtgttcaactgtagcaaatgttgatcattagcaatctttgacatggcaatttcaatggattactggaggaaaaactctaattacacaaaaaagatttcaggaaatataaccaggtgaggatgactctaaaaagaatggttagcctagaaagagaatgtcatgaaatgctatttagaggggaaaataggcttatataaaatacatttcgaacatttgtgtatagagggatatatgtacacatttgtatataatagaccaaaaatctaatagagacagagattgaaaatggatcaaaagaagaaatattagttaactaagtcaagatagctaagaaagagtagacaatatgccaaacctgttggaagtattttttattcaagtgaaggatcatgtcttctggctgagatggaaaaaatgtgataagcttttcaggataaattaactgtgggatggaaaaatttacattctgagataaaaatttttctttataaatcagtatttgatttaattatgaatcaggcttatattaaattggtaaaggacttttagagagaatgctggagatttttaaatgactgtcatacaaaacagaagactgaatagctgtgacattaagaaatattgaccagaggcactggttacccagttgaggattgacactacacctggatattggcagcaatcttattagtttcaaaaatgtttctagactaaatgctcacatttggccaggttaaggtgcaagagagtaactagattagaccctgcagaataacaggaacaaagaagtaggagtatcatgtaaatggcacttgatatagatctcatgggttttggatgagcacataaggaagtgtagccaggaagaagttgtgaaaaattaggaaaaggactaaacaagatacaacatgctcaatattatgagttgaatcatgtcactcagaagatatgttgacatcttaacctttggtatctacagctgtaacttcatttggcattagggtcttcattgcagatataatcaagttaagatgatatcattggactgggccttaaattaatatgaatccagaagtcagaaaaagcaaggaaagattatttcctacaggtttcaaaagaaacatggcccgccaccactttgatttcagactttttttgcctccagaaccatgagacaatacatttctatttttttaagccatctaatttatggtatgttgttacaacagcactaggaaactaatacatccaataaaaattatcaccaacagtctgcatcggtcaactggttgttagaatgcagagacaactaaatagttgaatatttttttttcaaaattggttggtttatgagatatatgataagaatatagataagtggattgaacaattgtttgcacattcctatcttaaaatattttaatgttttatattaaataacatgaccacaatgaccaatagaatgaccacagtgttcttcagtgttgaaagagcttaaattttcaataatctttaaggctaaagtataccttgttaaaataaagtaaaaacgtaagtaatcatgttatctgcttaaatgttgaaaaatctattgatggaagtttatttgcattttctaccccaaacaaagcatatacaactaataatcctatttatctgctttagtattagtaatttaattaaattagaatttatgtaaattgaacaaaatatattagaattaaacattcaccctgactgtgaatgtgggtacctgtatatatttttgacttataaatgcttgacataaatggttggcttaatatttaaatttttgcatgtttacattctttgaatgagatatatttataggcagtatttgcaatatgaaattttatttccaccatgcattatgtatatttcatggatgaaggagagatactttcttttaataagaatattaatggtgataatgatgataataataagacctaggatttaattagtgcttattttatcacatactttacatagactatctaatttaattatcaaaagccaaaaaacaagcaaaactacaaagtagctgtaattattatgctcatttgcaaatgaaaaaactgttgcttataaactgagtttcttgcccaacattatacaactaagaaatggtggagacaagactagagtcctatcacattccaaaacctttatggttaataagtatattatttgaataaattttgtaaatacgtattcaaagaatgtacattctttgcacaaactttttttagctattgaaaaataaaagccatttagaagggctattgataaaatattctacaatcttaattttctcatttcaaatgctgctcatgactaactgtaggtagattgaatgatcagagcatatgatttgtgaatcattcatataaacataagtctgggttatgctagagtggttgatggatggcctgagtttttaacacataagaggtaataggggctgggcacagtggctcatgcctataatcccaacactttgggaggccgagatgtgcaaatcccttgaggtcaggagtttgagaccagcctggctaacatggtgaaactccatctctaccaaaaatacaggcatggtggagcatgcctgtaatctcagctactcaggaggctggcgcaggagaatctcttcaaccgggaggcggagtttgcagtgagccaagatcgtgccactgcactctagcctgggcaacagagcaagactccatctcaataaataaataaataaataaataaataaataaataaatgtaatgaataagtattcatttttgttgaaaaagtgaataagtgaaagtataaatgcatatttagagaatattgcaaagaactgagctcatcagcaactgattacaaggagtaccaataaggagaaacaaagtttaaaaagagtaaagcatcatgtgtgtagaaggaagaaagagtattaaagaaattgcaaatataactagctagggaaggaaagaaaattgaaaaaagttgattggactctgccaagaaatcacttaggtcactgtaaaaataacagtagaaagttgaggtcaaatattctgctgaaattatttcctagaaaaaatgctcatatttttgtttcactcacaactttcagacctttctctaggttaaagagttattatggttattgcaaaagacgttacagaacagcaaaacaaaaccttttccaaaatttcatctatatagtgtgtttcaatcaaatgcattcatgagggaaaaaatataacattatttctccctccaacttttaaaatttcatgatctgttataaaattattactgaaatatgaggttattaatgtagaatttaataaaattttaggatttcttatacctaaattaagataatttcttcaatcttacagatctgttaaaaatttctgctcaaagtcctttatccaaaaccctaattccaaggacttgaaccagtcatattaaaaatgaacaaagaaactgagttttatttcagcctctttgagatatacatacatatatatgtacatatatccatacatacataaattttaaattatatataaatatatatcacatagataatttaaatttgaaaattatacaaattaacattaccagttttgcaactcagtgagttttccagcttcctagatcaaggaataaattaagaggcctattctgaattctgaaaggggaccagaagaataaaagcatgacactttagtcttacacaaatcttctgaagggagtaaaaaagaagtaaaaatagagcaatggatagtaatattttggtactcaagtggagatgaatggacaaggccatttcacttcatgaagttttcttgtagtggatggtaatgaaagaaaaatgagacctaaacactcaaggactcaatgtgtttgtgataatgtgaagggtgtgtttcatggtactggagaaggaaggctaatattgaccctatgtattaagagagttgtatcagggcatagaaaaaagcatgggtagaaattactttgtatgttatgtgttaagtgcagcagcaaaggtgaggaaaacagagataggaaaaaacactacttaaacttagcttaaatatgactgtctttcccatagtttaggaattgcaataaagaccataattttttttttaaaagttaaccattttaagtaggattctgaaactctgagttattcatgtagacttggaaaaaaatgcattttacaggcctggtgtggtggcttatactcataatcccagcactttgggagggtggggtgggggaattgcttgaccccaggagtttgagaccacccttggcaacatggtgaaaacttttgtctctaagaacgatttttaaaaattagcggagcatggtggcatgtgcccgcagtcccagttactctcgaggcgggagtgggaggatcacttgagcccagaggttaaaacctgcagtgaactatgattgtgccactacactgcagtctggactacaaagcaagatcctgtctcaaaaagaaaattaaaaaaaaattaaaactgcattttacaagtgtttactgtttaagctaatgcataggtagcaagactattcattggttctctaaattcgcaatatttacagtaccataaaataggctgggccacctcttagcagctcataatatgaagtcattgctgagatgaattgcaaatactaccagttcatctccataagaaataaaccgtagaaaaattcataatactttaagaaccacattttgctttgagatgtataacaacttgcattccaagattcctaatattatagtttgaaacaattttaatttagaaatatatccagttccatatagcctgctacttgaacagtttggccataaaaaatcaagaataaatatttacctgacatatatatatatatatatacacacacacatatatatgtgtgtgtgtgtatgtatacatacacacatatgtatatacatatatatgtgtatatatatacatacatgtatatgtgtatatatacatacgtgtatatgtgtatatatacatacatatacatgtgtatatatatactttttctggtaaaatctgaatcatagaagttatgctgcacatcctttcaaattggttcacatttcaaaactccttttatagtaataaaatatagtgagacattgtgaaccaaacaaaatttaatgtcagtaggaatttgagtatcttctctggaaagtagaatatacacctttaaacttgggtcttctttgtcctgacttttgctgacttttgaatgtctctacatggcagaagtaaaattgagcatttctatgtaacagcattaatgatcagataatcaattacacaaaaaaagtgtttaggctatacctatggttcggataattgttctaccccttgctggtaaagtgacatttagatttccagaagttaggcccatggtacattcatcaaattcattattctttacatattgattgattgaactgaagctcatacctttggttgtcaaaaatctctttttccagaaatatattttttcccaaataaccctatttaatgatttgccaagcagcctatgcttgttaaaagaccttggattggcctggcgccatggctcacgcctgtagtcccagcactttgggaggccgaggcagggggatcaattgaggtcagcagttcaagactagccttgccaactagcctagagaaaccccgtctctactaaaaatacaaaagtttgccaggcatggtggcaggcgcttattatccaagtcactcagggaggctgaggcaggagaatcgcttaaacccaggaggcggaaattgcagtgagccgagattgcgccactgcactccagcctgggcgacaagagagagactccatctcaaacaaacaaaaccttggattaaaaaccaaatgtaaaatataaagagaaaaatataagtcccacatatcatgcgtatgttatatctggtatatgatcaaggaaataaaaaagtacataaatttgaagtataagcagaaattgtaagtcttaatttgtaagtcattctgaagagttattctcaattacttaaatgtatgacaaaaccagtttaggcagagaaactaggttacttactagtggtttgttacaaaatatgttttccttgaattgaggcttagaaatggagttttatccaaagataagacagaatgatacagattgacagaatgatgaaaatcaagggggacccacaactctaaaaaaatggagatagcattaatatgaaatattcaaccatcccaaaacctttttactcaaatctgcccttcaaccattcctatccttctttactccttctctcaccctagcttaaacacaagattaactgaagtacaaaattctgtcagcagatatatagccgctgttcaaaaccttggaactataagaagtcctggattgttgccttaattattaaaaatataacttatgagaaaccaatttattttcaaaatttactcacagatcagttaaaagaacatcagtatcactgaaacagtcatgcatttggaaaaatatcatttttcaacccttgacatcttaaagcttgctacagcttataaaaacacaagcaaaccaaaatctctggttgtaagaatgtgctgtagactaaatcttatggccaacatgcaacttctgtgtcaaataaatgacattttaaaatcaattttcatgcctatgctaactctcaatttaaaaagaatcataaaatttctatttcctttttataacataacatgggtcaatattctggctaatgtgacacaattcaataaagatattgtggaataatttaaaattcaattgtactggcaattagtttccatttcaatatactcttctgaaattgttgtattttattttggaaaaaaaacatagagtatctgggttactgtgacaaacaagtttttttctgcactgcatccctccagcaagggcttaatatatctgatatgtcatagtcaacattcctgctaatctttcccaccagtgtcaagtgctgagagccatcacctattcattttgttgtatagtggaggaagaaagatgtagaatgggcagaaagtaatctgcacgaacatcagaataatatgggctttttgagcacagacacaaaagagatgcaagtagaattagaaaatcagctgttttctgagatttgttttgcaactctttctttgcctgtactgtttgcttgaatgtaaattattcttaattttattatattacttagttaatgaatgttttaagactaaaaaaagtttctatttgtatcaaaactttatggatttcacatatttcacatcatacagacagggtgcattaaataaaacactattaaatattaaatattttgacatctatgaagcaatattattattattgtcatttaacataaaattatggaagttggagttttaatattatgttagcatgtaagtgctccatttaaataaaaaaaattaacaagtctcagaaaacataaggtaatgatagtgttttcaattttaccaacagcaatggaattttctatgatagaacaactaaaaatttgactatccactatataatttcttctattgagtgtttgtgtgcaaatgtatgcatgtatagcacatgtacatgtataaatgtatgtgtgtgtatagggaatatagtgtaataattgaattatattttaatataattttaagtttaatgatactggaaatgactcatggtagaaagaattgaaaatgaaaaccagaaaagtccaaaacttgatgtgtaaaatatccattcataatgtattgaacattacattacattattatccattcataatgtcttgcctgtaatgaactattagcgtgattcctcacattagaattggcactgtcttgcctaataatgagaaagtaaaaatgaagttcttgttttaaaaatgtatctatttagagccatacccatacaagctaaatatttcaaaaaggagcctcaaaggggtaggacatagggaaaataagtgtgactatgctttcgagagatacaatcttccacttagaaatatctgcaaaactaagttgttagtataggttagcaaatcacacacaagaaaggcctggttatttgtgtaaggatgaaagaatgcaaattaaagagagatctctcttcatagcttaaacttcattaaccaacatatataataaaaactttgatagaaggaaataaaaattagaagcattgtgtttaaaattagaagaacctaggttccagaatcattgcagccacctattaacatctttaaacctccatttcatcacctgtaaaagaagaatcttaatagtgctgattgtagctgttaaaaggtttagcctttctctttagatttttgtccccactcttccaatcatcacaggaagtgcactatgcatcctccatttggtgagaacctctcttatgttttattcagtgttctttttttagcctgaaataaaatttcttacctttcttttgatgtgaaaaaatgttggctatatacttcttaaaaattatatttaactgttaggattcaagggtaccattccaccaattcactcaccaaactaatttcagagtcagatctgagcaacggctgactgttctaaataatacctccccagcttctgaagcaatgaaatccattgattcccaagtggggatggctgggcagcatgaatagcatctgcattataaatacttatatagagcttaatctcatatgccaagcactattctaagaacaaattgattaaatcaattaattcttataacaatctaataaaggaggtactactaaaaatatatatacatacatatttagacagaatctcactctgacgcacaggctggagtgcagtggtaggaccccggctcactgcaacctctgcctccagggttcaagcaattcttctgcctcagcctcccgagtagctgggactacaggtgcgtgctccaatgcctggctaattttttgtatttttagtagagacggggtttcaccgtgttagccaggatggtcttgatcttctgacctcatgatccacctgcctcagcctcccgaactgctgtgataacagccgtgagtcactgtgcccggccctacattttaaagctaagtctagacagtgagataaagtaccttattcaaattcccatactcattaagtgatagaatctgagttcaagcctaggcagcaatgtggtggctccagatttcttgctctgaacattatactatgcagtctttcatcataatttaagaagaatgagaaatacactgacaatattttcaaaactgtttagtaggtaatctccacgagttgagggagggacctggtgggaagtgattggatcatggggggtgtttacctcatgatgttctcatgatagtgagtgagttctcacgagatctgatggtttaaaagtgtagcacttcctcgctcttgctctcttgctctgtctctcctgccaacatgtaagatgcaccttgctactccttcactttctgccataattgtaagtttcctgaggcctctgcagccatgcagaactgtgagtcaattaaacttgttttattaataaattacgcagtctccagtagtatctttatagcaatgaaaaaacaaattactatactgttatacatattatacctgtatttgaccacttgcatcctagcactgttaagttgcagatggtattgaggacattctctaatgcctttgactccaaaatcttgcaccagccaaaatcttgcaccagccagcaaaggaaattacatgatgatcccttttcaatgagaagactgaagtattgcatgcatataactttatcaatatcttgggtatttccaagatgaatgaatgggtattaatttacatttgtataactaaagactcattctgattatttcttctaatttgcaaatgacttattttcttttaatatttaaactgttttaataaaattaatatgccaatattaataatcatatactccagtccagattatactcatgatatattttatctcaataaaataaaaattaaaaagttttcctctttttataatagaagcaaactatgttaatgcaataaacatatttaaatatctgagtgtatttcacttaataactgtattagaagtatacaacttattttgcagtcattcaaataggcagtatattatggcatctgccccttaacaagtctcctctgaatgtgtggtccatcagtcattgactcttcgggtaaaatctatttcagcaatgtccttagagtactggtgtgtatttttagctcaagaaaatggaaaaccttacgctgccattcgtttaccgattggctcacgagttttctgcattattactagatattgagaagagcagaaagtgaactataagagtaaaattataattatcattagtgatcatttataagtcacaagacactataataaacacatttatcttagttattttcacatatgaaaaataataatcatatgtataataaagtatcattcaccatatacaaataaggaaacaaaggcttagggatgtcaggcaacttgctcaggctaattcagctaacctgtggcagaaatgtttctggaatccaggtagactgatccaaagcctctgctccaaatgcatactccattcagtgctatataaagacatgactacaagttcaagataaaaagagaagggccgggcgtggtggctcacgcctgtaatcaaagcactttgggaggccgaggagggcggatcacgaggtcaggagatcgagaccatcctggctaacacggtgaaaccccgtctctactaaaaatacaaaaaattagccaggtgtggtggcgggcgcctgtagtcccagccactcgggaggctgaggcaggagaatggcgtgaacccgggaggcagagcttgcagtgagctgagatcatgccactgcactccagcctgggcaacagagcgagaatccatctcaaaaaaagaaaaagaagaagagagagagagagagaaatcacatctaagtatcctgctcagaccctcttacaccattgtcctattcaagtgtccatgccttattaatgtcagctaactggggaaggaggtattggggaaagaaaggccatcacagatttgggatactattgttatagctttgttctataagcttcttggagggaaaagtgtgtgtttccctaagaggggctgccttctacctttagcaggcagctttgatgcttccattctacatttacacataaatggacatgtatttcatattactgttgctctgactttgaccatccaattactggagaggtagagagtattatacataatattataatgccacattaatagagtttaaaatgtgctaacaattttaattaagataattatacatattataattatagtatatattttcttttactttttatcttttcaaaaggaaaagttaataatatcatggttctgtacttaatgaagcataattttgtttaaattatagaattatttcattctcccatccaccttacacacacacagacacactctagcacacacatgcacatgtgcacacaccctcttatccattcaggaagataagctttcacatccttagtagtcacattcttagttttcccaaaaaagaaactccattccatttatacttgtggaaatgaagtatataattgccatatgttctctaaaatgtcataaaaggtgaacattttcattcacatggaatatttaaaagctaatataggctggacgcggtggctcatgcctgttatcccagcactctgggaggctgaggagggtggatcacgaggtcaggggatcaagaccatcctggctaacacggtgaaaccccgtctctactaaaaatacacaaaattagctcagcttggtggcaggtgcctgtagttccagctactcgggaggctgaggcaggagaatcgcttgaacccgggaggcagaggttgctgtgagctgagatcgtgtccctgcactccagccagggagacagagcgagagtccatttcaaaaacaacagcaacaacaacaacaacaacaaaaccacaacaacaaaaaaacccgctaatatagtataaaatcattgtctcaaattaaaatatcaggttacaggaataaacaatgcagatgttacatacatttcaagatcgaattatttatttagattatttcatttaattatataaaataggtgttattatctccatgctaaagatgaggaaatgcagagtgtacagtttaggttaattgctcaagttcctaataactggcaggtaatataagtagggtttgaactaagcctctctgatcctcgtgtactcattcttaaccatgtatctacagagagcaggactgaggagcataatagaaaagaatctctgaaaagcagggctcagtagctgacactacaggcatgtgccaccatgccaggctaatttttgtattgcctgcctcggcctctaaaagtggtgggatcacagacatgagctaccactcccggcctctcctcttcgactttttgagagagtttgaggatttgtatctgttttctttaaatttttgatagaattcagctattagggcataaggtcctggtcttttcttgctgggagactttttcttacttattatattcccttgttaatagtttgttcagatgttctatttattaatgattcagtcctgttaggttgtatgtgtttaggaatttatccatttcttatacaatatccaattttttgacatacaattgtcaatagtattttcttatgatcctttttatttctgtggtatctgttgtaatgtctactttttcatttctgattttatttgagttttctctcttttttagttattctagctaaagtttgacaattttgtttcttttcaaaaaagagttactttttatctcttgtgttgcttttctagtctttatttcattttcttttctaattcgatatttattattttttcccatgtgctaactttgggcctagtttgttctttttctattaatagttccttaaggtgtaatattatgtggtttatttgagatctttttcttctttttttgttgtaggtacctattgcaagaactttgctattagaaccgctttttgctgtatcacctagatttgatgtgttgtgtttccatttgtgtttgtctcaagatttttaaaacattttcattttgattgcttcaatgaccttttggttgttcaggatcatgttgcttaatttccatatatttgtgaattttctaaaattgctactgttatgaattttgtttcaaacaattgtgtttagaaaatatacttgatataatttatattttttaaaatttgctgagacttgctttgtaccttagcatgtgatctattctgaataatgtttgtttgtgtgcttgagaagaatgtatacactgttgcggttggatgaaatattttgtttatctctgttaggaccattaaatctaaagtgttgttcaagtccaatgtttccttactgattttccatctgggtgaataaggtttttatggttgtcacgttttttgtttttgtttttttctttcagaactttgactacatctttccactctctcttgcttgaagactttctgttgagaaatactctgatagtaatattcaccctctttcatatatggtgtgtttcttatcacttgtcctcagaattttttcttgtccttgattttttattgttttgttattatatgacttgttgtgcttctctttgggttgaatttgattgaagaccttcatgctttctgtatctggttattggcatctatcccagacaagaaaagtttttaaccattatttctttaaatacgttttctggcctttattattatttgtctctttctggaagtcctattatgtgaaagtttaatctcttgatggtgtcccataattactgtaagctttattcctttatctttctgctccactgacaataatttcaaatgttctgtctttcaactcaagtagctagttttttcttctgctgttgaagttttctatggaatttttcattacagtcattgtattcttcatctctaagatttctgtctggttctttcctattgtttctatatctttgtctaacttcttgcaattttgtatattgtttttcaaattttactacattttatattcatattttctggtactccatgcaacatcttttttagtattattttgatttatctgctacagatttctagatctccatttctttagggttcattattgaagctttattagtttcttttggaggtgtcatgattccttgattcttcataatcctgtgtccttatgttgtctgcacatttgagggaatagtcccctcttggcctttacggtgttctctggcagggatacacatgcattatttaatctagcctctgattttggaaaagccagctggggacatccttggggaggcagagctttctgtgagatctctagttagtgggctattgactttgtttgggtgaggttgctctttgggctctgatggcctgtgggaacactggctttgtttggctataaagtggagttgctgggtgagtactgtgatggattttgaggtcagtcacaagatgtgtactctggtcagccaattatgttattggtgacctgaagttgggcagggctggaggctgggctccaaggttaggtggagtcattactctggacaggtggatccagaggctatggtccttagaaatacacaattaaggattttctccctgtcaatatggagccatgaagtggtttttttggctatgttgagaggatttgggactctttgggagggcttatgtgtggagtgaagatactacttgattttctaggttaagtaggtttagcccatttgcttctttaaaattcacagaagtgggaagttccttgcctgggcaaagtcactgggagtgtttctttgctgagtaaagctgctgcttgttaagttgccaagttaagctggtctagccccttcatttcttcaaaaagggaggagattggcatctccttgcctaggcagaattgttggggtgggtccctgaggcagggtgagttaaaagcatatagggactcaaactaggtgaaattttcaccatgctttcaaagacacctagctctgtactgcaggttggcaatgaggttgactggtatctgcaattgggcaccacagctagcaggaacacagtggtcccaccaagatccactcttgtcactgtggtctctgcctcctttctttggttctatttggacctgggtggtttagccataccattttgcctagagttccctgtgaggtaaggccagagtgggcttcctggaaagcatcttagaatgctagggacacatcaaaataaaaacatggtaaaacctaatcaaatattttccaggagagagggtgttttcattgcttgaccccaaatctcccttgacgagtatactgatggtcctccatttacaacggtgttattttccaataaacccattataagttaaatattatgtcaaaaatgcacttaacatactgaaccaactgaacattatagcttagcctcacctaccataaatgttctcagaatgcttgtgttagcttacagttgggcaaaattatctggcaacacagtatactgtagagtatcaattatttcccatcatgattgagtgactgactggagctgcagcttgctgctgcttccctgcaccttaagagggtatcatgccactttctattgaatacataacaccttcgcaccattgtacactcaaaagtttcatctgtatccatatagaatcaaggaatgcacccaactattgatacacgctatagggttgtgctgtaagattgctgatattttaagtaattatagaaataaagactatggagagaagaggaaagagcgagacagagagagagagagaggaagtattaggtcaactattgtgtcctgaggaactcttaaaagtgtactccactagaagaaaaagctaccaaagaaacaggaagagaaaagaaacaaaacaaagttaggagagtgttaaggaggtaaagggaatactatctcaaaaagaattgaatcattacctcttaaatactggtgggaaaccaagaaaactgagtggacttagcaacaagaaaataatgtaactacctcagaaaatttggaagaatcacaaggattgtgcaaatttagagaaaaatgaaggcaaagatatggaaatggtatctggaaaacaaacaaacaaacacaaaaaaacctttgagatgtttctgtgaagtagcagatacatggatggtatttagagagggatgtgtagtcccagccaaatattggtagagatgtgtagtaaatataaagaggtgtttaatgggaacaatttcatggagaaaatagagctaaatattaggaataaaaatatttatcaggcagaggcatatacctgagaagtcacaagtagaagagatggaaggtggggtcatgcaagttgggatacttcttcccattgtaaataaaggaaagaagtgcagtgtgagggcagattgggaggtaagctttgtagatttgtaggcaaaagaacacaggggaacccattaaataatctgtatcttctcagtgaaatgggatgcaattttatcagctataagaaaaagagaatgaataaagcaaagaaaatttgaaaagtaataaaaacttttctacaaaatatctctctaaaaagcagtttcctcaaaatatgtctaaagggaaagaaagtgtaacaaaactgtctcattgtatttataattagaaagcaatgaatttgcatcctgtttgtaaactttataatatttcctgttcaactttttttttcataaaattgaagttataagaaaattcccaaatggaagaaatcactttccctggagtgggtatgaggcttgataggaagatatcttcatataaagcagcctctagtctgagccacacagttcagttagaacctggacaagagacagtagaaaaaagcagtgttctcaagatgaacagcaaaagcaaaggcatgaaagtagaaaatggtaggatatcctgctgtgccaaactcatcaggggggcagagatgctatacttgcttctctttcctatcttctaaactaaagcatgtgtatgtatgttaacaattgtagctcctaaacgtgaagataacaatgaaaggaaaaaaacacacacacatatatttataactatatatataaaatgatatacatatatatgtatgtgtgtgcatacatacacacattcacacacacacgtgtatgtgtgtgtgtgcatatatatatacacagaaggattttctttctgtctgagattcgcttaaaagttggaaagatataaactgagggaattgatacttttttgttgttgtagcttgctgcatgtgcctattgcaacagtctttaagagtgcagaaaccacagaaatttaaagcaaatatatttttttttactacatggattcatggtaacatagttaatgactttttttcccctcagctcccctttaaactagaatctctttcagaggcaaggctgtctgtatttctttcagtgcaaggtacacaggtaaatatttcaaatgggttgaattgaatgcatgcataatttaaatgagggcagaacaaggggaaaacggcattgctaaagttttttaagctcgtgcattaaagcatagaattattttttacatctgaaaaattaagtctcattgtattcattgtcattactgactcctcctgactctgctatttgtccttagccagaccttcactatgaattcattatttttaagcatatatgttaaatcctcattaaatctatacagatgttaggttaaatttatttaagctacatatttcctctcctggaagcttttagcaatgtacctaatcaataaatacctattgaagttatcagataagcatgaatttttattggcaacttattagacagacatggcaagctacttataactttgaagcctggaaggctattctggtgtaaactcctgaaaatgattgtatttaaatctcatagatatatacattaaatcatggatgtaactgagcaacttaaaaagaataaaatctgaatcatacaagtttatttaaaaaataatttatcttcagatgtagctctttggttgtaaagtctttttgatatttatgttattgttttctgaactaaagtttaccaagaaaatgaaaaggaagggccatataaatgaaaattaaaagctataaatttccatagggattacattgctttaatatgtaaatgtgtaattatctaaaattaattttgctcatgtcaaatatttatatatacttacacatatgtacttatatacatgtgtatatgtatacacatgtatatgctctcaatatttattgtcattttagactgatatgaattcagatagagtttataataggtagagattctcatacaaatgttgaagcacattacaggctgaagaaattacatgaaaaacagaattttgtactttgtatatatgtgcacagttacagtctttagagctaaagtgagaaaaccatattcaaataaactcatccagaataatccccagcttttccaattttaaatataaaaagagaatagagtggtcaaaaatatctgcaagtgaatccaaaggccgaatttggtggtggtgagcttctgggaattaataacaccattggtcaggggaaaacttaaacacatagattcactctcagccatggtatcagaataccaatctttcttccctttgtcctgtccagaagatctacagtataaacataaaatgacttcacatttcactcaacagaagagtagtttaagacttccctatgtccaatacaaatttaacatgtgcaatatgactcagtgtttcagttttatcttgctataacataaaggcacaaagcatagtgaaaaaaatatttcaaagaaaaaacattttctgacttataaacatataacagagtctcctctccctgaccacattatggtttaaaaggatttcttatcaaactctcaccatagcaaagaaaaagaaagcttctcttaccagagtggataaagcttcaaccttgctatagcgttttctgcagctcttgtttgaaagacagatccacagcagctttgtgcatacaagtgatctggctgatctccagttcctgcacaaaaaaacagtataattggatctcaaaaaagtgttgtaaacattcatcatgatggcacttgcatgttgaatctagtgactgttattctggtagactttctccaaacaagcccattacatttctactttcaatacaagctgtttggtttctctgttcaatactgagattaatatctttaaagaaagcatgcatttgtgagtgtcagttctattaccatgtctgaaagtgtggtctaagattaaaaaaaatacacacaattataaatcaagatgatactgtctggtacgtaaatttacttagcacctatatgtctttatttttaaatttaacaatagtcaggccagtatttatgtactaatgagatatcagtattattaagtctctttcatttactatttgataaaactcaaatgaacattctatatctctgctttgcaaaaaacccacatcaataatgcttacaacacaccccagagtctgagaccagctctgctgcatttctaagtttcattaaatattccactgttcctttgcctaaaccttcaaagtggcccagacacaatcacatccttaaattttatgggagcaatgaagaggtcacaaagcattggcttttttgaaatttttaaacattcaatatttctggaagcattaactcattataactacaagtggcatattcttgttatcaaatgaatatgaacactagatcaaaaattaagtctcaataaaaatagtctcaatttgtgtcactctttataatgatctaagcaatacattgatcttacaactatatgattatataatctttgccttgcttcccatgggtttaaagcctggttaagcgttaccagcagtaccactacgaaaaatatgaattaactggatggagagattttttctttttgcatttttatatctggtatcttatttttcatctgtatacagattaagcaagtgcaacaaaacaattttgtgcaacaaaacaattttgtgcaacaaaacaattttgtgcaacaatttatgattgtagaaatctcaaaaaatgacaacttatgacaatataattcagaggattataggctgatatatgctagtcttttaagacaacagatttcattaatcttctaattatgttacttagggagtcagagtgtggggggagaagacctacatactgtttttttaatagtttgtatcagttaactattatcccttattattatgtaacaattgtctttataaaattttccactaacattttcatgtttaattattttattagaacagtgaagacagcattattattctccattatagttatatcatgatataactaagactcaaaggataaggacttgaaattcttaactagaggaacttctgatgttcagctacatccaaacaacgttttcttttaaaacaatgtatcgaatatttttctttaaaagaggtttgtgtgatttagcttggtgatttcaattggagaataggcatttagtgaattattgtaacatattcggagctgtgatacattgagaccttttcctatgcctaattattttggaaattatttgcaaatacagttcaaaaagacaattatatatgatgttatgttaaaaatgtttaaaatttaagaattacctattgattatttgctaagtgacaggttttttgttaagttctgaggttatgggagtgaataagctaaatatctccactttatgtaattttcgatgtagaaatgaaaataattagcccaagatataaatttgtttggaaaattttagtggcagtgagttaatttataaattcagtaatagacaaaaaaatccctaagatatcagaatttttatgtctttattacaaaaaattctaatcattattaaaaacagtattgctgaaaatattgagctaatcattttagaatgattctgaaattcttaatgcttatattttagaagaagattgtagacatttttactagttattttccaatgtacacaatttgtatttatatatacctatgtatatctacatatacaaatagtcatattaaggtcttgattagataatgaggtttggaacagttcaagtattacataatatggttgtaggagtaaatcaatttttccactaaaagttattgttgacgtccccctctctaaatgaatatattaaaaagaaaatgaggaaggcaaaataaaattatcataacatatcatattagttaaatgacttatagtatttatttgttctagttattctcagtctctttacaaatacaagaacacattgttttattgcaatttgctttattgtactttgtagatattgcagttttacaaattgaacatttgtggtaaccctgcattgaataaattatcagcaccatttttctaatacaaagtgctcactttgtgtctctttgtcacactttggtcattcacacaatatatcaagcttttccattattattgtatattttatctgtttcattatatctacgatcattgatattactcttgtaattgttatggggcaccacacaccacaaccatgtaagacagtgaaatgttgtgcatgttcagactaccgcactgaccagctgttactcatctttcttcttctactagagactccctgttccctgagacacaaaaatattgaaatttagctgatcgatagccctacaatggcttctaagtgttcaagtgaaaggaagagtcatggtctttcacttgaagtcaaatggtagaaatgattaactttagtgaggaaggcatgtcaaaagccaagataggctaaaagctaggcttcttatgctaaacagttaggcaagttgtgaatgcacaggaaaagttcttaaaagtgctagtccagtgaaaacatgaatgataagaaatcaaaacaactgtattacagatatggagacaggtttagtggtcaggataaaatatcaaaccagccacaatatccacttaagataaagcctaatccagagcaaggccctaattatctttaattctatgaaagctgagagagttgaggaagctgaagaagaaaagtttgaagccagcagaggttcgtttatgatatttaaggaatgatgccctctgtatgacttaaaagtgcaaagtgaaacagcaagggttgatgcagaagctgaagcaagttatccagaagatcagcctaagacaactgatgaaagtggctagagtaaacaacaaattttcgataatgaaacagccttctaatagaagatggcatccctataaaacaataaaacatgaagaaaacaaagtaactatgtaacaatcaatatgatgactggaacaatatgtcacatctcaatagtaacttttaatgtcaattatataaatgctccacttaaatgatacagactgtcagaattgatacagtaatcacaaaccaaataatgctgtcttcaagacacacacctaaccatgtaaggattcctatagactcaagctaaagggatagaaaaatatattccacacaaatggaaactgagggcaagcaggagtagctattctcatatcagatgaaacagaacttaaagcaacaaaagtaaaaaaaataaaaagacaaagaaggtcattatataatgataaaaggataatccaacaaaaagatgttataagcttaaatatatatatgcactgtagctcccagattcacaaaattattcctactaaacctatgaaaagaggcaaacaccaacacaatgatagaagcgatttcaacactccactgacagcattagacagatcgttgaggcagaaagtcaacaaagaaacactggacttaaactacactctacagcaaatgaacctaacagatatttatagcacattctacccaataactgcaaaatatacattattctcatcagcctacaaatcattctccaagatagaacacataacaaaccacaaagcaattctcaataaattttaaaaacttgaaacaatatcaagtatcttctcaaaccatagcagaatgaaattagaaattaattcccaaaggaatcctcaaaactatacaaatacatggaaattaaacaacctacttctgaactatgcttaggttaacaataaaatcaagatgaaaatctaaaaactattcaaaatgaatgataacagtgacacaagttatcaaaacctctgtgatactgcaaacgcaatgctaagaggaaagtctatagcactaaatacctacatcaaaaagtctgaaagatcacaaatagacaacctaacatcacaccacaagaaactacataaacaagaaaaaaacaaatccaaagctagcagaagataaacaacaacaacaaagatcagagcagaactaagtgaatttgaaatcaaaaatcaatacaaaaggtaaatgaagcaaaaagttttttctttgaaaagatgaacaaaattgatagaccactagccagattagccaagaagagagaaggttcaaataaactcaattagaaattaaaatagagacattacaactgacaccacagaaatagaaaagatccttcaagaccattataaacacctctatacatacaaactagaaagtccagaggaagtggataaattcctgaaaacatacaaccctcttagcttgaatcaggaagaaacagaaatcctgaacagaccaataacaagcagtgtgattgaatcagtgacaaaaaatttgtcagcaaacaaaagttcagggtcagatggcttcacagccaatttccaccaaacatttaaagaggaattgatgcctatcctacagaaacgatttcaaatgattgagaaagagggaatattcctaactcattctatgaagccagtatcattctaataacaaagacagggaataacataaaaacaacaacaaaaatactacagaccaacattcctgatgaacatagatgcaaaaatcctcaacaaaatattagcaaaccaaattcgacagcacttcaaaatgataattcactatgattatgtgggtttcattccagggatacagggatgattcaacacacacaaactgacaaatgtgattcaccacaaaaacagaattaaaaacaaaaaccatatgataatctcaatagacatagaaaagccattcaataaaacccagcatccctttatgataaaaactctcagtaacctaggcatagaaggaacatacctcaaaataataaaaaacatgtatgacaaacccacagccaactcatactgaatggggaaaagaagaaaacattccctataagaactggaagaatacagggatgcccattttcatcacttctattcaacatagcactgaaagtcctagccagagcaatcagggaaaagaaataaataaatacatccaaatcagaaaataggaagtcaacttatctgtttgcagatgatttgatcatatacctaggaaaccctaaagagtccttcagaagactcctagagttgataaataaatttagtaaagtcttgggttacaatatcaatatacacaaatcagctgcacttctatatgccaataacaaccaagctgaaaacaaatcaacaactcaatcccttttacaataactaaaaaaaatctaggaatatgcttaaacaaggaggtaaaagaactctacacctagaactgcaaaacactgctggaataaatcataggcaacacaaacacatggaaatacatccgatgctcatggactggaataattaatatcatgaaaatgatcatactgcccaaagcaatctacagattcaatacaatttataccaaaataccagcatcatttttcacataaatagaaaaaataattataaaatttctttggaaccaagaaagagcctaaatagcaaaaacaattctaagcaaaaagaacaaatctggaggcatggcattacctgacttcaaattatactacaaggatatagtaaccaaaatagtacggtactaatataaaagcagatgcatagaccaatgcaacaaaatagagaattcagagataaagccaaatcaaccaactgattttttttattattatttttattattattattattattatactttaagttctagggtacatgtgcacaacgtgcaggtttgttacatatgtatacatgtgccatgttggtgtgctgcacccattaactcatcattaacattgagtacacctcctaatgctttccctcccccctccccccaccccacaacaggcctcggtgtgtgatattccccttcctgtgttcaagtgttctcattgttcaattcacacctatgagtgagaacatgcagtgtttggttttttgttcttgcaacagtttgctgagaatgatggtttccagtttcatccatgtccctacaaaggacatgaactcatcttttttatggctgcatagtattccatggtgtatatgtgccacattttcttaatctaggcaatcattaatggacatttgggttggttccaagtcttcgctattgtgaatagtgctgcaataaacatacatgtgcatgtgcttttatagaagcatgatttataatcctttgggtatatacccaggaatgggatggctgggtcaaggatcctcaagttctagatccttgaggaattgccacactgtcttccacaatggttgaactacttcacgtcccactgacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatgggattgtttgattttttcttgtaaatttctgtgagttctttgtagattctggatattagccctttgtcagatgggtagattgcaacattttcctcccattctgtaggttgcctgttcactctgatgctagtttcttttgctgtgcagaagctctttagttgaattagatcccatttgtcaattttggcttgtgttgccatcgcttttggtgttttagacatgaagtccttgctcatgcctatgtcctgaatggtattgactaagtttttttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccatttcttgtttttctcaggtttgtcaaagatcagatagttgtaggtatgcagcgttatttctgagggctctgttctgttccattgatctatatctctgttttggtaccagtaccaactggtcagtgttgactggtcaacaaagagcaaaactctgtctcaaaaaaaaaaaaaaaggaatcagtcaatgtaaccaacttaattgttgttttattttcacaaattgccatggtcaccccaatcttcagcaaccaccaccttgatcagtcagcagccatcaacattgaggtaagaccctcctccagcagagagaattacaacttgttagaggctcagataatactcaagtttttagcgataaggtatttttaaattaagttgtgtacattgttctttagatataattctattccaaggttaatatattatggtatagcataaacataactataatatgcactgggaaacaacaattttatgggacttgcattactgcaatattcattttgcaggtgtctggaaccaaacttgcaatatgtatgaagtatatttatatttccactgacattatatatgtgtgtgtgtgtatatatatacacacacacacacacatatatacacatgtaaatttctgttgacacaataccgtaattatagtttcatgttattacacaggtttctcaaacataattatccattaatgtggatgttttctattaaagtgattaaactgaaatttcaacccctcattttgtcatagaagcatgctgaatagacctggagaaaaattcaaaatcctgacaattgttactactttaaattactgaccatgaataacaaatgaacactcactactgcaaaaatcttaattacaactgatggaatagccttaaacttcactgagaaaacaatagcccctgtgtaggagagcccaaatatcaacccatcccaactagctaccaaactgttttttttttgttgttgtttttgtttgtttgtttgagacggagtctcgctgtgtcacccaggctggagtgcagtggcacgatctcggctcactgcaagctcttcctcttgggttcacaccattctcccgcctcagcctcccgagtagctgggactacaggcgcctgccaccatgtcaggctaattttttgtattttttagtagagacagggtttcgccttgttagccaggatggtctcaatctcctgacctcgtgatgcgcccgcctcggcttcccaaagtgctgggattacaggcacatgccaccatgcccggcctgtctacaaaactcttttaacaaagttttaccaaactttctcatgctaattcttcttattcatataagttactccctctgcgttaattcatcctcatcggtgtttaatactgttttaatatttttatgctttcaaaaataaacccctctactacttcatttgtctctctagtaaccatatttctacattggaaaatatctcaaaatatttattttctcattttacaatatcttctcaactcgcttttatagaacatccatatcaccaaaggcactaaaatagtcctcattttacctgatgttctaacaattatgtgattccttcttgaatgattctcttctcgtctttagtggtactacattcttcttatttctttcataccatgcaaagcctttcaatcccaggctcatttgccggcttcttttcctctgaataatatgtttggagtatttcttgactgatcatggatctctttttcttctcaatctatactttccctgcagataatcttctccggttccatggctttacatataatctttcctgttgactaccaaatttaggtctgcaacctgacctttttccactgtgctttaaatatgattctccatctgcatactgatctcaattcctggctctctaacaaggattttaaaattcaaacacggcaaaatagaacaattgactctaccatatcgttgcaaatctgaccttactccagtcttccatatcttaacatggaattctttcagttaaaattctttgagttaaaatcaaagtattaaatttttatcttaatgttttattctaacaaaaatgcataacataaagtttaccatagtaactatttctgaggtacggttctgtagtattaagtatattcactttgttgcacaactaatctccagaacattttcatctttcagaactgaaactctatacctcttaaacaactccccaagaggaaagatttattgacatatgtaacaatacagatgaatttctaaattatactgagagaagctaaacaaaaaagtacatactatatgacttcatttatataagattctaaaaatgcaaacttatccatagtgacagaaagcagatcagctgttgcctgggaaccagaaaggtgggggtggaagaattggtgtgaggaattgcaaaggatcacaaaatttttgtgtgtaacagacgtgttcattattttgattgtcatgatggtttcagtagtatatacacgtgtctacacttatcaaatctcacactttaaatatgtgtagcctaatttatgccaattatactgcaaatatgacatttataataagttcacacataaaacctctaaaaattagaaagaaaataatccaatatgtaaaggcaaaaatatttgttcaaaatcttcacaaaataagatatccaaatgaccaataccatgtaagagaatattccatattatttctcatcaaaaatattcattcaccatatttagcaaaatttattaaaataatcatttcaagatttgagggaatgtgaaattcatatacaactgaaagaaccggaaattagcaaaagcagtttgagaaactggcaatacatactaatgctgaaaatgtactcatcttatgactcaagaattccactcctagtttcatattcaagaagtatatgcatatagcatcaaaagatacacattcgattgctcgacagctctctgcaacagacaaaaactggaaattatccaaatgtcctcccgcagtaaaactgatgaatatcttttaaaatatttacataatagaataaaatatatcaatgagaatgagcaaacttttgctatacgtgacaacatgagtgagtctcaaacctaatgttgagaaaagatgtaataaacaaatattatgtcttgtataattttatttatataggctgcaaaaatggttacattttattttggaaaaagtagtcaatctactgattatctttggggtagactgagtttaataactaggaagaggtacaaaataatctttcaaatattggtaatattttatttcctgttagagttatattaattatagacatgcattcactgtgcaaaggtactgggttgttcacttaagaatttgcaatttctgaatatgtgttatgcttcagtaaaactttatatgtatgtgtgtgtctgtatatatatatgcacacatatagctacacataaagtatatcacaaaaatatagaataaaatttattgtgatttatgttctttagaacatattattttttatgaaaatataacttgaaatattttgtgaacaattattgctaagacaaggacccattttttcctgataatgaaaacaaaacacgtgcataaggttaaaaagttccagtaaaaaaacaaagtcatttgaataattactcatcccaggaaagctgctccaattggcattggtaaagtatataatgcacttatttttctcaaaggaatacaccattatagcacagatatttatgtgtattcatttcacattatttatgaaacttcttgaggctctgacttagagaaagcaaccagctgtttttgtgatttgcaaaatgaatgtcttaaagaaaaaaaaggcaaaaagtagtattttatcatttatattgtcttattgcttttttactcactttcttaatatgaataccatgcattattttctacattgtgtactgttcatatacgatgaaaactgctatcaggacttaaaattacatcatgtaactcatatatatatatatatatatatatatatatatatatatatatatatggatgtgattagccatggtggaaagagtgtggatttcacaattgcaatgaaacagtttgaatatatgtaaatttgggcaagctgcatactattgccatggctctgtgtaatcatctatgagagggagatggtaatactaaccctacctgtatgcaaatgtaaacattatatgtaaatatataaaaattgatattctaaatgcttaccattactatgtcatgcactactaagaagttttactgggccatgcattactagtgttttacatcaaaagataagtttggaatagattgatttaaacattgattaaaagatgaacaatacgaaggctaagggattgtagaacagtgacccttcaacaggaacagtgtcctaaatgagtgtcctttttgctaaatgagcagcagcattctttttgtttgtttgtttgtttgttttgagatggaatttcactcttgttgcccaggctggagtgcaatggtgcaatctcggctcaccgcaacctttgcctcccaggttccagcaattctcctgcctcagcctcccgagtagctgggattacaggcatgtgccaccactcctggctaattttgtatttttagtagagacagggtttctccatgctggttaggctggtctcgaactactgacctcaggtgaaccacctgccttggcctcccaaagtatcattctgtttttgtaactgtaactgagcactttggcctcagtaaaaaagaatgactggaaacaacttggctatccaagtaacaacaattgtgtcaataaacttagtttagagatatttaccactaaataaaatctttacccttcatgagtaccagtttttttttaacttttttttactctctacatagacagtaaaataagttagagagtaaaataaataataagaatttatttagcttctcctatacagtaagatttgttctaacatttgtattggtgaatgagtattccaaaatgatatgtcagccatccaatatatagaccaaatacaagttgaacaatagtatagctatagatgcaaatatagatattgaggtaggtagaatgaaactattttttacaagcaatgtttgcctacttaggtgttttgtacttgctgatctctccaagtatactcctcctccatatactgtgtaacattccctcttaccacttccaggcttttacaagtgtcactatggctgagcttcccatgccctgcccattttccttcagcaattctgattcgcctatatgtttgagaccttttgctgcatgcgtctgagatgttgctttcattggccaatggtgcatgattgacatgcatacaggtcaggccagaaggtaaaaaatgttccccaaagcagccttcagttaattagagaagggaattagtagccaagtgcctcccatttccctcaatctttggatgataaaatatgagacatggttcacacagtctcccagaattccatagaaggatggagcctgggttgcctgtggcagcttcctgatcatttgtacactttttattggaatcctttccttctcagcacttgcctgtttcctgccatggttcttgggaatcaccacacacaacttacttgtacctaatttcttgcttcagagttagtttcctggaaatcttacctaagatagtcacattcttaaatgcaaaatttactttcaccaccctcattaaaagtgcaactccaacctaaaccaagcatagccttctccttaccctatcttaatatgcttcattgcattgttttgaaatgaaaaattatatcatttactctttacttactacctgaatccctcactggaaagtaaagctatgagagcaggaacttttgtttgtttgctgtatctctagtacctataattaaacctgctgaatggagggtgctcaatgaattatttttgaagaaataaattattaaaatgaatctcagcaaaaaactaagctaacatcaatattttcttctaagattgacaaagtagactttgaaattggcaaggagatagtgtttaactcaactttatgtgtgtttaactcaactttatgtttcttccccagacaaatcaaagaaatctgagtctaatataatgaatgttaaaacatacatttcattaaagctttgagtcttgcttaaatataattttaaattgtcaaggaaagccaagaattggaaccttctattttacaactcaaatagctaggcttcagatctttatcattgaggagtacatgattcaagcaattattaaatctacagatgttcagctataagcttttacaagatctcttgtcactgaaaagagagcagaggtatattgtagatgtagcaagaaaaagttagttgggctaagacaaaatgtaacttaatttctatcattgggggctacaaaacgtttaggtggtatgtaacaatgctgaataagtaaaataataattgagaacatacaatcaataattttcagttataatatttatggcaatgcctgttttcttatatactggagttttttaagaaagcatagtgagctttcaggtattactgtgaaaaaggaatagtatgacattatagtgtttaaagaagttttatttagatatgctttggttcaaattccaactctgcaatttactaaaggtatgctcctctatgatttcagatttacctaattttgtttttatttttagagaggtaaaacacataaggtaatgtgcacaactcttaattgtatagtttgatgtatcttcatgaagctaacacattcattgagacagccatttatcaaatcaaattatagaatatttcaaagatcgcaaaagcctgccttatgggccctaccaattatcactgtacccaacgactcggtggtaacgactcttctcacttctgtcaccataaaataactaagtctgtttttgaaatttttatagatgtaatagcacactatgttttatgtctaatttcatttggagaatattctatgtataagatttagtaccagtgttccatgtagtagccatttgagcattttcattttatgcactctcacattgcatgaccaccactaatggttttatgaccacatctaatttacccattccaaatttgatggaaatgtgagatatttttgttcattaataattattttgctttgactgtttaatgggtgcagagttttcttttgtggtaatgaaatgcttttgaactagatggaaatggtgattatacaacattaagaatgtgttggatatcactgaattgcaccctttaaaatagtcaattatatgtcatgtgattttgtcctgaagaaaaagtattgtgttgctttgaacattgtatctcatttttgccctatttatactgtgaagtattcatatgttcagcgttagtagaaattgccaacttttctcggcggcagtgtcagtttccacattcactgagagtaaatgagatttctagtcctccacaacattgtcaacaggatttgttttttcccatactcattggttttaatctgtatttcaccgatgatgaatgaggttgagcacctccacataatttgattatctatttagatagatttgttagtgaagtgcttagttttttattaggttgtcttttcttactaatctgtataaatgtatgtattctaaatcattttttctcagattaacacattccctgacaattattcaaattgtcaaaatattctctcattctgtggttttgagtttcacagttttaatctcctaagagtgaatagaagttcttatttttaccatagttcaattttccaatttttccctttatacttagtgcttcttgagttttgttaacatatatttaactatatcaaagtaacgactatatcttgttattttctggagttttcattgtattaccttttacatttgggcttaagatccttggaattaattaccttgtattatgtaacctggtgatcaagcttctttctttttctatttttccttccttttttccttcttacacacacacaacacacatttatctgtatgtatgaatatataaatatgtgactatacacgtaatacatatgctttcttacatacacgtttgtatacacatatgtatgtttttatccatatgtgtgcacatgtatacatttatgtattcatacttttatatatgagtagatatattgcaatagatatagtataaatcatctttcttctacattaagtgttattttgttatttttgtcatatatctggtaatttatgagtcagctatatcagtcttatttggttcctttgaaggtgatgtggtttggatgtatgtctcacacaaatctcatatagaaatgtaatcgccaatgttggaggtggggcctagtaggaggtgattagatcatggggtggatttctcacaaatggtttagcaccattcctgttggtactgtcatcatgatagtgagggggttcttgtgagatctggttgtataaaagtgtgtgtagcacctcccctcttgctgtctcactcctgcttttgccatgtaatatacaagctcctgcttcatctacctccatgattgaaacctggcagaggcctccccagaaggagaggctactgtgtttcctgtacacctgcagaatcatgtgccaactaaacatcttttcttataaagtagccagtctcaggtatttctttatagcaatgtgagaacaaactaatacacaaagcattatgcccttcctttaagctccttttgtagatttttttcctttgttttgattttcaacaggtttactataaaatggctagattttctttgtacttgggattcttgtagcttcttcaatttttggtactatgtcttttgtcagatttgaaaaattattcacaagtggctctttgattttgtgtttgcctattattttctctttccaaaacactgagtatatacaggtcccattttatggtctctgttcttcaagatggatagtctttgattaattcattcttttaaaataagattatacattaatgctctctttttcaaagccagtcttcttctacacccacttactgaattatttattatggttatcaaaaatttcagtgctagggttttcacactaaacacacacaattttaattatagttctctgttgaaactttcaatattctatttttcagcatgtattaatcataattgtttaaaagtctgaatttcatttcaatatctagtaaacctgagtgactattctattacttaatttttctcttggttttcaatcattcgacccctattttctagtagaatcaattatttttatttaattactggccagtagaaactcgtgggcaaatcacctgattcagttgaggctgacctgtttcttgtttgtttttctacaaggtagagctcttctggcatccccactgaaagtgtgcagtactaactagggccattcttttttttttcttttttttttatatacttttttattatactttgagttctagggtacatgtgcacaacgtgcaggtttgttccatctgtatacatgtgtcatgttggtgtgctgcacccattaactcgtcatttacattaggcatatctcttaatgctatcccaccctcccccaccccacaacaggcccctgtgtgtgatgttcccctttaactagggccattcttgcttattagtacatgaacttcaactcttgacttccttgtcttgtgtgactgccaggttctctgcttggtttgtagcagctattttcttcttaatttctatttatttagtctatgcatttgtgttttagggggtggaaaatgcctcaaagtaaattacacatgaaatactgggctcaattttctacattttatttttcttctagaatattggcttcctgaatatagggccaaattattgaaaaccaagagaaaaattaagtaatagcatagtcactcaggcttagtagatattgaaatgatcaaacacagacttttaaataattatgattaatacatgtaaaggtactgcttagtaactttgactccagtgtttgtctccctagtccagtggatttattgtcaactgtagactgtatttgtctattcagactttctgtccaagccatggattagcaaaaaccatacagaaggggatggaagagaatggaggtaaatgatgggcttgctacaatgcatattttctctctctgatcttgttcctccaatccttaattgcattgaaatcttcagtcacatgagttttgcatttaaaactcttattgttgctcttcatgagggaataagtcttatatctgttactatattatagacagaaatgaaagtctgagaaagttatttaaactctcctggtttttcttcctttaaatgagaatgaatatgccactcaaagtgtatatttaaatcatagttaaggaggtttcttatacagagtgcactgcagagtacattgtgattaataaaggatagaggttatgattgttagtttggttcattaataaataataactaccattacaatgtcagaaagtatacggtactcaaatataaaatatatgaaatcataataccaagaagagagttacagttttcagtagaaacacaaccatatttctataaatattgtttattaagttgttctattcctgaaacattctatttatgtaaatattctggactaataagggaaaacttcacctagtttaagcaatttggtgagaactcattcagctatgagtaaaagaaacttagaagtaggaagggggtaatttttttcatgcttcaatatatccagtagcaagtaagctagaccagcatggtgactcaaagatgacattgagaacttgactctctcaatcttgcagctccgctatttacactctttggcttttgtctggtcttcatgtttgcctcttgttgacaggagggacaagtctcctccagcatcatgtatgcaatataggcaagaatgggaatttggcagcaataataagataattattcttatgtcgggaaaacacatttccccagaaattatggggacttttgcttactagattcttgcaagaactttatctataactgtaaggactgtgggtatatgcagcttttaagctatgagtatcaactctccatatcaaatttgtcccacaaatatactcacacttgccatgcaccaggattagattcttattatctactttattatttctcaagttaccacgagccacaaaaagaagctggcatggccaaacacattagggcattacttacatgacttatatgatgatgttttcaaagagccaataaaaggctcagaaaactataaaggaaaaaaataaaaagttgttattttcctacaattttttccagaaaagaaactaagttttggtaaaatgcctacaattagagcacagagctactaatctttaggagaaaatcagacaattattgatatgtcataatttatatgcaattattacatcctttttttttaagacagggtctcaccctgttgtccaggctggaatgcagtggcatgatcaccactcactgcagccttgactttctgggttcaagcaattctcccacctcagcctttcaagtagctggaactacaggtgcaaactgctacacctgattaatttttgtattttttgtagagatgggttttgccatgttgcccaggctagtcttgaactcctgagatcaagaaatccacctgcctcagcctcccaaaatgctgagattacaagcatgagtcactgtggctggcctcatatatgtaactatataaaaacatgaagattgataggtagatagacagacagacacattgctacacaaaagccagaaagattgtatttgcacatcagttcaaacatagattttatatatcagcaatgaaattaataaaatatttattgaatacctactggtttgggcactggagtagtaagcaaagagcaaattcaatgatatggggaaaaatttaataacagcgatagcagtttggttttccaaaatcacaaattcagaaaaatataaactttctgaagtttgaagacattcatatgaaatctgtgtaaattcaaggtccaaaattgagatatttaatccaacaaattttatgttgtttctttctcttaacattattttgtctattccctcttttctcctaatacattttttcttacatattactagatgaattaataatgcaaagaggctggtgctgcttttaagttgatcactaagtcattttattatcttaattttagaacattttcaagttacctgcttgcattgattgtgaatccttttatttattatttaatttaggatgcccttgtatcattttaaaacctctatgagtttaggaaaaaatgtgggtagtggtgttagtaaatgtgtttgaatgaaaagaaattagtttctgttctattccagtatcaaataattcagcaatatatgcaggatttccttcaaaggtatgttccaagtattcagcacaattctctgtctttccaaaaggcaatgggtgtatatactaataaattaattaaatcactccttatgtggggaacatctatttgaggaaagtttttgctcctctagatgaggttgaccctagttcagtttctattgccaaatatatgtccttgttaaaacaggaagttttaattctttcattttatgttatagaaaagtggtgctttttaaacttctatttctgaaaatacagaaattaaaaataatttaaaaaggaaactctttcttcacagagccaatgaagcctttctaagcataattctctgcaactaaaacttgaagaaaagaacttggtgataagcaaaaacacagaagtcccacatttacatcttaatggactctcttaatatgtgttcaaataaagttacagaaacaataatgttaaattagacaatatgcaagtaaagtcaaatattaattttgtaggcaaaaatgtgggataactttgcaaattattttataagtggtatttttcaatgtttagattattaatatctagtttctaaacagccaggtgtgttcctaccattattcgcaaggtctggtgtggttctttcattcagtaccctgtcaaaaaagacaattttcaagacaagatttataacaaacgcttctaatgttcagaaaaaaatagagtattacttgaactgataaatcttcttaaatattaaagaatatgatacatctactattaagcactaggagaatttaatgtaagaaaaatatgcttaaaaattacgattagcatgagaaagtgttttaatatatccttcctattcctcattcttctcattaaggtaattacaaataaacgtttgttttatttaatttattgaggatatatttcactaggctggaagacaaatgctgaagccaaattaaccaagctgccagaatgttagcaaggcaatatctattgtttttaacatcgtcgtcatcatcatcatcatcatgatgttacagagaaataaggataaaatctgataaaaaaaatttgggcagcggaagagccacataatcaacgttagttatcgcataatctttattaaaatgagtaacagagaacttaaataaactacagtcatgtggatagtaaatggcagcctggcattcagatctatgtgtttcaaaaaccatccttgtaaacatgatcatattactgcctggagctaaatgattcagtttatctaaaggaggacttaccaaaatctagcatctagagttggagagatctccctttggcattgagttctgatattttaagagttttttcattatagaatataatctgataaagtaagagatcataaactagaggcagattttaatctattttttaaattttggctcaggatatgtcgactttagctacttctctttaacccttttagcaaagaaagcctgaaaagggggcaaatttatctatataatcaggagatactggtaggaaacttgagaaaattaggttgtcccagctaaaaatgtacattttaaaagatgcatgacataaaacttatagaaatcttgcattatgagctctctatcttacatcctgtcaggaagggctatcagaaacttcaccactacctggtagaataatgttttccaaaatgaatctaatgatatgcactcaactagctttgaaagacacccccagggagcattttcaaaagccggactcctggatcttcttcctgaataattgagctgaaatctcagatggtccaggacgtccctatttcaagcagcttaagtgattatgacagttatccagttgagaatccactgttcttgaatacataaatactttttctagtatattgtacattcagacaagatttattttattttttcctttgtgtcattgaatttaatatatcatcctttttattataatagaattaatttaataactagtcaactacttaacctgctatagtgctttcttactccattcaggcatattatttttcattatttaactttcattacttgcttttccaaagcacataacatacagaattagtgggaggcagaatgcaaattaatacccaatcctatttacctagtaaaaaatacatataaatgaggattaaaacaatattttaaaaataatagactttttaattgtctcagtgtaaatgcttgattttatttatgaatagatttattcagcttagccataccataatctaggtggaaagacaatgttatttctggtttactgttgtctctttgctttcaggtcatgataaaaagaatatatatgctggagactttttcatgtgggaagttattttcaatatagtttagctgaaatgtcatcttagttttaaagggaaagaaaatagcatgttaatttattgagcaagagagacttctagtcacagactttagactctagaggctgtggcttgtaatgaagctgtcagcagttgctactatgcctacccactaaataaatgatggcatttctaggaaaatcaaaacatattgctttagtagaaccttgttaagaaaaacaaaataataataaataaaatcacaagttttttttctttcacctctctctaacttcatgtgcttcagtatggaataatccatgtaaataaatgggaatttttatttttataaaatacttttaaagacaattttttaatttgataatttttaagaactcaagattaaaagtcagagaatcataaattaaaacttttttgtcaatacaaaacaaaaagtaaaactaaaagacaaatcactaccaacagcaaataatacaaaataactcataaatctctgaatcaactattacctttaaaggtgacaatatgtcattagcacctaaagtattttagcagctaccttaaatttattttagaagaaaataaaaaaatacttaaaatcattacagacaataaaactaagccatgcctgatttttaaaaatttttatgttgttctacatctccatcaagttgtctagccttcactggctcagatgcctaagttgtctgtataaggatttccacaccttctctaaagttctcaaaagtgcaatcagccttttctttggtaatgtcagattcctacctggtttctcagttctcagtatggtattatcctgaatctacctcagctatgttcctttgggctgtatttgcatttaatatttattcacagggacagtcataattctccatttggaagaatggaacaagaatgtagaaaacaattatatgctgggtgcactatgtgtgctagccactatattacatgttttcacatgaactcagtttactcctcacaattctgaaagaccgtattaagagaatgaagaagaaacataagcagttataacctatgcacatggaatgaatatcacagtttgcttttaaattgagtaaattatttttaaacgagtaaatgataattatctcacaaaattactaatttcagcaaggcatttttttctgtttttgcaaaagatatttatatgaacatttattataatgtatactatacttttaggattatgaacaccaatgccaggttaatcacatttgactccagttttagagatagtaatgcaagaaagggtgaggtaagtttttggatgccatttccagtgactttattttttttttacttttgtaaaagtaatttttcatcatttccataggctcatcactacactcgcttcctagagaagaagtctaatgagaaggcattttgagaatttatgccaattctcttatgtgtatatgcttatgaatcatgtaggtataactgtagtaatagaacatgtatattataatacatatacaaaatataagttttcaaaagacgagataaagtttaatgtaaaaaacattaataaacatagctttatgctatctttattagcataacatgtttctaaaatgggctccaaaattcctgctcctggtgtgacacactgtataactctcttatcttgagtgtgggcagaatctgtgaatagaatggcaatatcactcccatgataaggttcaaatcagttgacttggacttaaccaagagggagcctatattgggtgggtgtcagggagactccctctggtctaaagcaggcatttgcagtttacaaccatgttgtaaactgcctatgggccacataggaagggtctgcaggtggccactagtagctgagaatcgttactcaccaatagctagcaagaaaatgagaacctcactcatgcggtcataaggaaatgaaatcttccaacaaccagttatcttagaagagaaccctaagtttcagatgagaattataaattatttatgatcctggtaatacgctgagaaaagaagcccccccaaccttccccgcccccactcacccacagctttacccgccccgccccccacccacccacatgcgcatacatgaaagctacagggttcctggatctgagcaacttgagttaaggggaagtatccacaatcttacctacagaaacaaacccctttcttcttgtcctctttgctctactctcaccctaggacagcaaggaagttgatgcctaaagggattaataatttcatctgaatatgaactaaattgacactaactcttaatttgaataacaacctattattcaatgacttccaatgttaacatttttatttcttatattttatagtattcagacatctttagtaaagtattgatgctgtactaactttgtagatttgtaacgcaagttcttcaaacctaagaacattttgaggcgttggtgtgatggtgcccacccacgcagacacttaaaaggctgaggtgggaggattgcttgagcccatgagtttgaatacagcctgagcaacatactgagaccccatctctaatgaaaacctcaaaaagtacaaaaaaagttgtgagtggtaaaacagctgagtttgtgtgaaatacacctgggctccaaatacttcatcctcctggggagaagtcacagcagatgattaggcaaactctgtgctatgttaggattaggtaaactccttcctatgttaagagtatactgcctaattcaatatctcaacattttgtggttatgattatgaaacctaggaaaatgaagctagacccacatgtagtagttaggcaaattgttgtaagtaaaacataaataaaagatagtactttatgaatatcacattaaaacttattattaataaatggtatttcttctggttgaatttgtatggcctttttctgaaagacttcatattgttttaaagtatttgtgtcaaattgcaggatagcatgtgtgtgtctgtatgcatgtgtgtgtctttgtgtgtgtctcccttacctttaataataaataatagcatcttaaagatgatatatatatatatagctgactcaagagtaagaatatactgttagtttttttcttccctgagaaatgttggtcataaatagagtttgagagccactagtctaattcacgacagttaaatttaaatttattttccatgccatttaaaaaaattaatactaaatgtcaatagtaaacaaggttatgacagaaatagcccactttttaaattacactcctatggcaattatgtcttattttattcaggaggtgagggaaacatgttaccttaacacaatgcaagagttttaaagtcttgtcattttttaaatgtcaattcttgtttcctatactccttaaaatataaatatttattatgcttcatggccttttcatgttataactctctgaaaaattataggtctcaaagccattcaagtgtttatcatgggaataggtatagatttgacaaacagcataaaatacctactttatatatttttaattatttttgcaataaattccaatgtagggaagccaaataaagcaaatttttaacaaaatttacacatcttcttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggttaattttttgtatttttagtagagacggggtttcaccttgttagccaggatggtctcgatctcctgacctcatgatccaccctcctcggcctcccaaagtgctgggattacaggcgtgagccactgcgcccggccacatcttcttactaatagttatatacatactataattggtctcagtgaacaattcttttggtgggcttctacatttcaatagaaagaaaatccacagcagtattaataaaggctcataaagtgcactaagaattctaatagagacaaaaatgttcattatttgagaactttacagaatgtaataaatttcttaaaaaattaaaatataatcattaacagtttaacaaaatgggggtggtcagaattttagtttataaatgaaatttatactgagaaagtcagttttgtgctgtggtgaatatttgaccttccactgtccctagaataaggtcatatagcatgaaactctatgtcagagattagcaggctttctcctttatttctttttgtaacataagggagccctgtaccagctgcatgcagcattacttcatgagtgtataactgtatttaaatcatttatatattacattttacaaatgtaatagggaaatgtgttcttttgcattcatggttaagagttggaacagatggcgaaaagctcagcttaaactaatatgggcattaaaataactgatattgcatgcattccttgatataacagaagtttagttcactataaaatgggcttgtaactttctagaatatattaaacataatgtttctttagcaacaattttttccacattaggaaatttcctgttaggatgtatccagaagagtttttcaaagttaaagaatgtagtaattcctttaacaaatatttactgagcacttattattttcaggcactgtgcttaatattgagctgcttaaaaagatgaataagacacagttcctgccttcaagataagaatatcatcagatggaggagatggagacattacaaaacattgacaacacatggaacgtttgaaacacctttgtattagtcatggttctctagaaggacagaactaataggatagatgtatatataaaggggagtttattaaggagtattgactcacacaatcacaaggtgaagtcccacaataggatgtctgcaagttgaggagcttggaaaccagactgggtcccaaaacctcaaaagtagggaagccaacagtgcagccttcagtctatagctgaaggcccgagaggccctggcaagccactagtgtaagtccaagaatccaaaagctgaagaacttagagtctgatgtttgagtgcaagaagcagccattataggagaaagatgagaccggaagactcagcatgtatgcgctttccatcttctgcctgctttattccagctgcgctggaagctgattacacggtgtccacccatgttgacagtgggtctgtctctcccagtccattgactcaaatgtgaatctcctttttggtgacactctcacggacacaaccaagaacaatactttccatccttcaatcaagttgacactcaatattaaccatcacaacctccatttgtagtgactgggtctgtggtatttccataccacccagaatctgagccttcaattctggcaattacaaattgtcaatggagcctacatctggagcccagccgggacaccctgtccttttgtgtagggatggatagctgagaataaattaatttataactcatacatttgctatatcctttccatcaaataacagaagagttaaagaatttctttaaaaaatcaccattgagcaatcatttgaaaatataaaaagaccttttcacataatgaactactctaccagctatagtcttttgcttgggatcttatcttgcatgtaatcatgccccaagaagactattttagtcatatctttgaacaaattcttgcaaggcccaaattctattaaattttctatagttcttatatgcatctcaaatttcccattcctctaggcttttctaatgtgttattgccctggccaaggacacctgcaaaggatcattcctaatatcttttcgtgtcctttatctttgtaaactcctattcatgcatcagaacttgacttaaagatcactttttcagggtatatcttccctgacatacaaattaggttagattcacctgaaatatctttatttaaaattcttcattttaagaacattcatttttatttgttttaattccttgcttaacacccattatgtgcagcaagaaaacaaacacaataattagtacataatgaatacagtagagataactctaatataatcttcctcttatattaataaaacactttcttactttgctatgttttccttatatccatttctactggggatattgtctaaaatagtgataggtgaaaaagaacgcaaaacttaagatttaaaatgtatactaaaaattctttatttaaatgaatacattatagtctttcttgtgattcactagttatatttacttccttttgctatttcagaggtgttgctgttacttaagaaagcagcaccacagagttaatgtgtttttaatttagccagctttctttctgagtgctttttaagtttggttgataaaccaatctagtttcttcacaggtactgccatactgtaagatagtacttcgtgaggagtagctttacattatttttttccttgatgcctcactgatgattccaaataaagtttactgggtaatttggagaatatggggcagtttaaccacacagaatgtcatacaggctgctgctgagtcttttgctaatctaagcaagctctctaaagttagaggcaaactgtttacttaaaacattaaagaatcattttgcagtatttaagtaaaaaggagtaagcagtgggaatagagaaaattgtatccgcagttcttaaaataattttatatcaaaatcactggatatggaagtcatgatcattaaaacgtgcacacctgcttatatttgattgtaaccttatatttgattataaccatctatattctccacatacacctaattcacctgcactaaagttttgctttgatgactgtacattcaaatttctgcagatgttcttagagcatatatttatgaaaataacatcctaaacaatcatttaaaatttacttgagtgcaataactgtatgtaggcaaatatattcatttctttacaaataagcatttattttgtttattcaattagatcttttacaaagggagtctagtctataaaatgttaacactgacttaatattcacaaaaagtatattaatatttctatattaactatgaaagataaattacattatgtattgaatactaatatcatttcacttatttttgacaaacaagcgtatgacttctatgtaagagttcattattcatatatgaataatgcattatatttatatgatatactataagattctttgatattcacactattttgttgggttgttctagaaatactgaacattagtagaagtgctactagccctatatggcaagtaaggaatccgaggctcagatcagttagataatttatcagaagtcaagtagctagtaaacaattaggtcatagattaactctgggctttctgttttagtggcctgtactctctctccactgaaaaatatttttattcaataaatgatgctaaaacaaatggacattacattcaaaaaaatgacttgagacataagccatatacccttcacaaaattaataaaaaatggataacagacctaaatataaagtgcaaaactataaaactcctagaatataacataggtaaaaacttaaatgaccttgggtatggtgatgactttttagatacaataccaaagggaataatctatgaaagaaagaatagagatgttggacttcactaaaattaaaactcctgctctgcaaataattctgccaagaaaatgaaatgacgaaccacagactgacagaaaatatttgcaaaagccatatataataaaaggccattatccaaaatgttcaatgaagtcttaaacctcaacaataaaaagcaaaaaacctgagttaaaaaaaaaatagtatttggcctgaacacacacctcatcaaaaaggatacacagatgacaaagagcatatgaaaagatgctccacaatatatgtcttttggaaactgcaaaattaaaacaacaatcagataccctgcaagcctattagatggtcaaaaattcacaacactgacaacactaaatgctggcaaggatgtggagcaatgggagctctctttcattggtggtgggaatgcaaaattgtacagcattttggaagagagtttggcaatttttggtaaaactaaacattctcttaccatataatccaataatcatgctccttgatatatacctaaggagttgaaaatacgtcccatcaaaaacctaaatgtaggccgggagtggtggctcatgcttgtaatcccagctctttgggaggccaaggtgggcagattgcctaaggtcagaagttcgagaccagcctgtccagcatgatgaaatcccgtctctactaaaaatataaaaatcagccaggcgtggtggcaggcgtctgtaaccccagctactcgggaagctgaggcaggagaatcgcttgaacccaggaggtggaggttgcagtgagcagagatagcgccattgcactccagcctgggggcaagagatcaagactccgtcaaaaaaaaacaaaaacaaaaacccaaatgtggatttttatagcagttttattggtaattgccaaaatttgaaaacaactaagatgaccttcagtaggtttatggatagctatactgtggtacatccagtcaatggaatattgttcagcactaaaaataaatgagctatcaagttatgaaaagatttggaggaaacttaaatgcatattattaagtgagagtgaatctgaaaaggctacatagttactgtatgagtcctaccatttgacattctgataaaggaaaatctatggtgacagtaaaaagtcaggtgattgccagagtgttgtgtgggagagggatgaataggcagaacacagaggagttttaaggtagtgaaattgttcagtagaatactataatggttgacagatgtcatcaaatatttgtctaaacccagaatatgcaacacaaagtcagaactctaatgtaaactatggagtttgagttactatgatgcattaacgtaggcttgtcagttttaacaaatgaaacactggggatgcagataattgaggagtctatgcatgattggggcagggaatatatgggaaatttccatactttccctttaattttgctgttaatctaaaacattttcttaaaaattacttttatttctacatgatgcttaatatttggaaaatcacataatttctataaatttctaagttgtataatttttactaatctgctggtatttatgtgaatctgctacataaaatatgacattgattattttgttttattctcatataaagaaaatgaggttttgctatagttaatgcatctcaagatggcatataatatagaagactagtagttttctctaaaataattgatgcagctatagactatattacttatagtccttgaagctccatatgaccaaagactagcttaaggccagggaaacatgaatagaagcaacatgttctacttcctggccatgttcttaaaagaaaagaaccttattctttctctctcctctgcaaattattagtatgtacatgtttgtgagagtcagaaaagcattctggacccagagaaagaaatatttcttagaggatggcaaaacgacaacaaattaaacaaaaaataaaaagccaaagttaaagaggcacagaccaagacaccatggagtaggtccacgttagcatttgagaatacctttgcactgtaatatgaaagagaaaattctatcatttataaccaatgttataattgggcctttgtaatagcatccagagactatattctaattatatacacacacatacacagaataacaaagggttaaactaattcaggagttgctttttttatgtgttataaacattattgtaaatacagatataatttagatatatatttattgcaaaaataaatgcagattttcagatggacaatttaatgaattgataacagctttgattgagaaatgtttatcctttttactctgtttaaatgagctttctctgaaaacagctttctcttcaattaagaaatgtttatcttttttactctctttagataatgtttccaggattcttgagataaagggtaatggtttctgttgattccaagaaatctaaatctaccatgcctctcaagccaaaaccagttacatggtagattgacaaatatcaaattaatttgaattaaatgaaaaaattaagggttatttaatttgaattagctgctatctttttccacatcattaataatgttggaataatcaatgcttctatcctctacctcttctattctctacttacacttacttctattttctagctatacagtagcatgtctcaaatgaatatccacagccaaaaattatttctttaactcaaaattcatatgccctactgtcttcttggcttttccactaaatatatctaaaataaaactcctcattctttccacctaaaaataaaggctactacaaacacaaccatccccatgttcattgacaataactccatccttctagtttttctgtccaataaccttgcaggccaaaccttttcaaatcatttttttttcctttccttttcaccttactacacatccaggctaccataaaatctttttgatcctagtttaaaggttttccagaacacagcctgttcttcatatcttcattgctagcacagtgccccctatgtcattttatcttcccagagatttttccatagcttttcaactgatctttctctccaccccatatccacacataatatatctaaatgcagaagtctgagttgttttttttcttaaatataagttggattatataaatcccctattcaaaatgctgttattgcctatccctttacctaaaataaaagtctaaagcttttaaatagcctataaagccttacatgaacataacccttgttatttctccaactttctcttctacaacatttccccttcctcggttctaaccacactgagattctggctgtttcagacatagcaagcatattcccattttattacctttaccccatctttttctctgcctagtgtgcttttcttctagattcctatttcactaactgcttcaggtcccttaagtctttgcttgaatcttatattcccaatgaacactgttgtaaattacatttttaacaccacaacttatccccagcttaccatctgctctttggattctgtcaattccctctagtcttttttgcttatctttgttttcataacataaatcacctcttcacatattatccaatttaattattttgtttgtcattcattgtctcttacctttcccctcacataaccagaggattaatggggcttgttctttgatgtatcctatggcctaaaacacacgatacttaccaaaaagtatttgttgaaatatacacacctgctgtatttagtcatactactgtatatttttaaatatattatatcagttaatcctgtgttaggcaacttctagagggtttcaatgatccctgctttctgatatttaccctgttgtgtaaggcttcttgttgagtgtgagctgtacctagagaattgcttttaatgaacagaatatggcaaaagtgataggttatcacttctatgattgagttatgaaagactgcgacttctgtcttgctagtctcatgtcttttgccagcactctctcttgtctgattcctttctctcataaatcaagctgtcatgttgtactctctggataggcacacacagcaaggaactgaagaagtcttctggcccacaggtcatcagcaactgaggcctcagtacagccagcaaggaagtgaatcttgttaacagtcatgtgaatcaggtaagagactgttagattggtaccaaagtaattgcggtttttttttcccctgaaagtaatggcaaaaatggcaattaacttttgcaccaacctaattttttccaattgagacttgagatgactgtggccttgtaagagcccaggtacccagggaattagtacttagattcttaacccatagaaactgtgagataactgttatggttttcagccatgaatcttttggattctttgctatgcaccagcagatgaccaaaatgatgatcaatatgaaaccacatatttgcatgaagaccaaatcctcctatagaaactgtgggaactaagagtgtttttgtttagtttagtttagttttttctcagtatttttatttcacttagcataatatcctttatggtcatccatgttgttgcaaaaggtaggatttccttttaaaagcctaaatagtattccgctgtatgtatacaccacattttatttatttatttatctgttgttggaatttgagttttttaatattttggctattgcaaaatatctaaattatctaagttaaggtttagatactgcttgcttacaagcagaactctaattttattttctccaaaaagtaatgttgctacttaaagaactctaatttacagtcttgcttacttctagaggtgaagaaaagaagtcttccaggaaagatacttatgtacagctaagtcatatggaaatagtaccctttggttctctctcttccctttttttacttatctgaaatgaaaatatgaggactgaacttcgactctatcttgggtgacaagaagaactgaagtaggaaggaatcctatgctaaggatgagagagaaataagacagcccacactccactcccttcccccaacaccaaatgtgagcctatcattcaacccacagaagactttttataaatgagagagaaatgaatctctaatgtgttcttgcagcttatttgcttttttattttaggaattgaatcttattctaaactgatacagtgtctctatttactttgctttggtgtcctaagtagaaactataaatactatttagacttattgcaataggcaaagggcatattttaaatcatattatggatatctgcaactgtgtatcttttagttttacagcatgtattgtcatagttattattgtaatcataatgcactgaaactttacatcattttcaaccatatactaatagcgaaataacataaatatgttattttctctttctctgctcctctccgtatctatgtatttacttcctttatattattcttaacttcttaggtgaggaacaatgctttaaatgaccatggacttcttatcagacatttatgacagccagaagaccatggaacagcatctcaaaagtactaaaggagagccacaaaaccagaattctatatctagcaaaaatatatttcagaaatgaagacaaaataagaaaattatcaggtgaaggtaaaccagaaatatttactgttgacatatctaaaagaaatgttaaaagaagttttttaggctagagggaaataactaacaccagggggaaatatgaaccttcaggaataaagaaagaacaacataaatggtaaatatctagataaacataaaagataatttttctacttttagtttttaaaaaatatgtataactcttgaaagaaaacattcttatctggtggagttttcaatgtacatgaatgtaatatatatgacaactataacatagaagccactaggggatagtaaaatgatgtatgggactataagtattttacatcttacttgaaatattaagttattaactcaagaaagtgtgataatttaggcacatatattgcaatccctaggaaaaaatacaaaaatataaaaaggttacagataggaagcccacaaattaaacagtatactaaatacttacaaaaaaaggagaaaatgagaagtagaggcacaaagtaagaatatgcactatatagaatatactatttgaagtactagcccataagttctagcccataaaattaagtccgtgatgtgagaaaattttggcttaagagaaaatggagtaagccacagagtagaagattcagtgcagatgagtgaacccttaaaatgatgtagaagagagaagctgaattgggtagacagtaaattacaatgaacaaatagaatactgcctttgtttactatcattcaaagtattatatgttacatagtattacttgaaaatgctatgaaccatggaagtggatttttccaaatcatagaattcactaatctaacaattatggcatttataaatactattgataatattagtaaacatttttaatacagtttttatcatataaacattttggtacatgttatttcttttaagtgccaatagtttttgtattttaactgcatatggcaaagtattttcctaaaatattagaacatttatcaatggtgcatactttacctcttcgtaaagttaagttaatgctctaatttttaaaaatgttcccattagggcaccaattgtaggatggagtggaataaaatgataatctcagaaacttttgcctctatactttgtctccttcctatgtgtctgcctccagcgactgtaggccatttgaagattactattgctgctattctggttacctagaaaatgagacagattataaggcctatgaaaagacttaactttgtttatgtagaattttcattaaatttgctaaagggaagtgcctaaggaggtttcctgtctttagcaaatatatttattggtgaccagatccttttttgccttaccttcacagttatttctctaacatctgaggttttggtagtctgatttttagctaagtatgatatttaattcaattaaaagtctatattcattaaagaaggcttacattaagaagaatgaagttctaatttattttcatccatctatatatattattgttgtgttatataactaaaatcttactattatagattttttttcttctagcttaaaagttccaagtgttctatcttagtaatatgatttattctggaggagagggatgttgtaacaaatactttccagtacaaactaagatatttgcattttcaagttttgtattagaagcagttttgagtcttagtagtcttataaaattatgattaagtgaccaacaagtataaattttgagtcacagatatttaattacagtcgagttaaaagaagaaagaaaatgaaataattggaaaaagatctttcacaggaagaatgtcttattgttagtacggaagagaaataaaatgagaaagagaggaagggaggaagaagctagatatttatttatttacgtatttatttatttagagatggagtctcgctctgttacccaggatggagtgcaatggtgcaatctcagctcactgcatcctccgcctcccaggttgaagcaattctcctgcctcagcttcccaaatacctgggattacaagcatacgcctccacgtccggctaattttttgtgtttttagaagaggcagggtttcatcatgttggccaggctagtcacgaactcctgacctcaagtgatctgcctgcctcagcctcccaaagtgctgggcttacaggcatgagccactgcaccgggcctgatttcttttttgtgtgtgtgaaagtaggaatggagagcaatcaccaagaaatccgaaatgacatccagacagcaagtaatgccaactctgacaaaccactgctgtgatcagagtttgcacctctttaagatttcagatgttgattctttcttcatgcatattcccattagaacatttatcactgatacatatttcctaatagctaaaagtttactcattaccagagattgatggagaaaacaatgttacaattaagaaaagatcttggacctgtcataagaaaagagacaccatttggaataagaagaccaagaatatgccatttactgccttcaagagccttgagaaactgcataaagcagtcttaggaggatgaattcaaataatggcaatattgcataataatgttatttttaaaagattaaaagaaattctgcctactgcatcatttattattaaactgtatattaagactttctaaatttgcttccctaagatagagtgatattcaatcatttttgctttaatgaataaagtccatctttaataagtaattgcaagtgggagagaatcgggcctttttaggtcaaatatacttgagacatgagggttcacaaaatctgactatggagaatttgcatgatagggttcactgtgcaacagaaagcagaagtttctatcaatggataaaatgaaaagcaagattgtgtcacagattttttgtttctttgctgctatataatgccatactcccctctgaccctcttccaaagtatccccagggtagactatactaacgagatcctttttcagcaaaagaaagtcaggcactattcacaatagcaaagacttggaaccaacacaaatgtccaaaaatgatagactggattaagaaaatgtggcacatatacaccatggaatactatgcagccataaaaaatgatgagttcatgtcctttgtagggacatggatgaagctggaaactatcattctcagcaaattatcgcaaggacaaaaaaccaaacaccgcattttctcactcataggtgagaattgaacaatgagaacacatggacacaggaaggggaacatcacacaccgggcctgctgtggggtggggggaggggggagggatagcattaggagatataactaatgctaaatgatgagttaatgggtgcagcacaccagcatggcacatgtatacatatgtaacaaacctgcacattgtgcacatgtatcctaaaacttagagtataataataataataaaagaaaggaacagaaatgtttaaacctcccccttgactagaagtaattaagtaactaaattacaaatacacacacttacatctggggaggttaaactgattttatgaattgtataaatgacaaggattcatactctggcttttcaggttttcttttttttttataagaaagcccatcatttaacagtaaatagaggttttctagtgtgtcaaatggggatatggtcagattaatggcgaattcaatgctatgcatgtttttaccctatctctttttatttttgcaagatgtggacaccttttaaatgcattagtttcttcctgcattgtacaaagcaaataaataggttctttaaattccaaccagtcaataattgaaatatatgcacaaaaagtatatgtataaaaacacatgtaaactgatcaagtgtcctaaaaacacatttaaaataaaaatacaaagttagaagtttagcacttaactgaatatatgttaatatgcattataaaaatagtaaactcatataacagagatagtatagcttgaaaattaaggactaaagtcagaatgctctttttcagctccccaatactcctatttatttgcaatgtaacttttgataaacttctcaaactctttaaaacttaggttcctcaactgcaaaatggaaggaaactaatcactaactcaaacatttgttttagtgattaaataaaatatagtaaaaagtttttagtagaatactcaggatataaaattctataaataattaccaaatagaatttggttgcgaaatggtcacaaagataattgcagagaatactggaaaaataattgacaaaaatttatatattatttaaaagattgaagtttacaatgcatgcagaaaaatgcataaagtcattataaaattgaggtgttaatgtgatttttactacacaagttggaataactgcataatttcaaatataataaattgttagtcatcaatttgaaaagattttatgaaaaaagccatgattttatgacacagaatctatatgttgtatagaaagcatgaattatatttcattttagttatggtctctcttttcttgatataattaacatttaaaatatgttttcaagggtatattgttcaatgtcactataaataatttatgttaatagaaaagcagaaattaaaaatgtgatagccaatattttgggtacagcaactttcatgacaatcatttcttttgaatatatctgctataaatacaaattgatacaaagtaagcatgataaactgtcatgaattttaaactatttaattatcatcattataattgccatgaattattgtacactcaccatttaccgagaatttctgtgttattttttactttgtgtgttttttattgtgtatatttaaggtgtacaacatgatgttttgatatgcaagtagataatgaaatgattactataggtaaacacattcacacatccatcaccttccatagtaatgtctcattgtacatgtgtgcacgtgtgtctgtgtgttaacagtacctaaaatctacattttatcaaattttcagtataaaatacaatatgatgcaatattctttatacattacgtaaaaatgtagaccaagggtagattcacaaattatgcatctgacaaaggtttaatatctagaatctataaggagcttaaacaattgaacaagcaaaatacaaataaccccattaaaaatgggcacttctcaaaagacacttctgaaaagaagacatacaagtggccaagaaacatatgaaacaatgctccacatcactaatcatcagagaaatgcaaatcaaaaccacaatgaaataccatcccattttctgttactattagaaaataaaaaataacagatgctggtgaggctttggataaaagggaaagcttatatactgttgttgggaatataaattagttcagtccctgtggaaggcagtttggagatttctcaaagaacttaaaacagaactaccatttcacccagccatcccactcctgggtttatatacccaaaggaaaaaaaaaatttatcaaaaagacacatgtatttgtatgttaattgcagagctattcacaataataaagacatggaatcaaccaaggtgcccatcaatggtggattggataaagaaaatatggtacatatataccatggaataatacacagccataaaaaggaaaaaaattatgtcatttgcagcaacatggatggaactggaggacactgtcctaagcaaattaatgcaggaacaagaaagaaatatagcatgttctcacatgtaagtgggagttaagccttggggactgatgaatataaagatgttagcagtatagactgggggatactacacagggaaatgatgaagcggggcatggactgaaaaactacctattgggtactatgctgaccatctgggtgatggaaccatccatatcacaaacctcagcatcatgcaatatactcatgcagcaaccctgaaaatttaacccctgaatccaaaatgaaaaataaatatatatatatttgtacttattataagtgaaaatatacttaatattttcagatcatttattggttgtatttataagtaaaattgacttttgtacattgaaaaaaaagaaaatgtggtctatatacaacatggtatactatgcagccattaaaaaaaccttgttatttgcagtgacatgaatgaaattagaggccattatcataagataattaaagcacaaatagaaaaccaaataccacatattctcacttataagtgggagctaaatattgagttctcatgggcataaagaggaccatagtagaaactggggactactagaggaggaagagagaaagggggaacaagtgttgaaaagctacctactgggtgataagatcattggtacccaagcctcagcatcatgcaatacacccaggtaacaaacgtgcacatgtacccgctgaagctgaaataaaagttgaaagaaaaacgcagataaaaaaatgtcctttttctctttatatatatatatttttattatactttgagttctagggtacatgtgcacaacgtgcaggtttgttacatatgtatacatgtgccatgtcggtgtgctgcacccattaactcgtcatttacattaggtatatctcctaatgctatccttcccctctccccacaccccacaacaggccccggtgtgtgatgttccccttcctgcgtccaagtgttatcattgttcaattcccacctatgagtcagaacatgcggtgtttggttttttgtccttgcaatagtttgctgaggatgatggtttccagcttcatccatgtcccttaaagcagattaatgtataaaacagtcttcgaactaacttggacttacaaatttgcacattttcttttaagagcatttcatattttctactttacttccgaattttcaagctgagaaattttgtttataattttattttctgtggattttataaggcactacaagatcactgtagattaaaaattaaatagtaaacagtccctaacttcaagttgttcataatttatcacaggcactgaggtggatgcctaaatggcatactcatatacaggagagaggtcagaggccagtctagcaactgaattttgtggatttgtcagtaagaattagaaaagtagttgtgatgttcatgacaatagggtgaaagaaagatgtaaaagatgtcatgtgaagactgaaaagtattttcctttttgagttagacacaatagtatgtagtctttttcagtctgttttaaagcccttaggcatgaacagtaatgtattcaggatctgtggaacaggtaacatagtgaactgccagagcgaggagaaccaagaagtggaaaagagcagtgaactaagtaaatccttagatctatgtcatctcaaattggcaaatttgctgatattgtgattgacttaagtatcaataatatcaacaaaaatattggtagttcatctaaattttaaaattcaggtttttctgttgttttctttaaatatctaagtcagttccccacttactgcccatggcaattcaaattccctgattaacactggagctttttgcaagatttgaaaatctttctcaagatcatagtttattcaacctttgttttgaatttttcaagtaattcaaacctcacaaccatattatgctattattaataaccattttaaagaaactgaggaagggatattgaaatagcttctcagatctatccaactattaatattaagtaatgtgaaaaagaataaaacccagaatgtctaaattatttaatatctatttttaaaataaagtcctgagttattccagaataaattatttaacctagtcctaagattaaaatttttgttttgaaatctcacatatttgaaggacacgtgacttttttacaccacattgtctgaattaattagcaaaggtattgcaagcaaaccaacagcataatagtgaacacttcctcatatcttaaaaaatcaaattctatagactttctaaactatgaaaaatttacatttgtcattcaacaaacttattctgtgtcagtacctgtttcatccatttagatgcaacagtgtatgaaaacagacaaagatttctgttcttaaaagtttacaaagaggagagcctgccaatataaaaatgaatatataaattttgaagtatgcaagaaattaatcaatactataaagaaatagtagagcaaggaaagcatttttaatactatctagaattttcaaatcttcttatggtttaaagtatagtcatgatactctcttgggtaaagtgagtagggctggtaggtgcctgcatgtatgcatgtgtgtgtgtgaataactgtgtattgctatttagaagagttagggtggtcaaactctaaaaagattcacattgaaatagtcatcttctaaaaggtcacatgatatgttaccttagctattttttttatacttgaaataccttgggcagtaacaactcttcccaaatttgatttaaatgataaaaagaaagatcagtgaatgactatagttataaaaaatgtctataacaactgtcagcaatctccagcaatttatggtactctttgtaagcgaaatgactttattatagagcaagagtggagccttttcactttcaaagttacctacatctagctgcaattgttggtaggattaagcctcatcaaaaataaaattgggagtaaggaaaaatcctagaaatcaaagttgcaaaaaagactagaatagaaaactgatcacactttggaagttactctgactaaacactgaaaaacaaaatgcctttttaatacttattattatcattaactttggaaagagaaaggatcctaagttaatttaaccgttagtcaattttacatgaatacataataccctaaataaatatcttgttcattaggtaagcatatagttttatgataaaatttaaaatctatgcttctattatgattcaaatttacacaaatttatttggaagacacagtcatattatttttattttctataaaagttttggaaaaaaatacactaaagaaatactgcattgtaaaaaccactcttgccattagagaacatgtaagtgttctttcatgtataagtaataaagaatcaacatttgctgcttttggaaacaaaatgaaacaagagaggaaatatgtctagcttttagggcaatttggtaatatttgagaaacacagcctgacaactcaaagggtattttttaatgtttatgtaaatgtatacatatgcatacatgtgtacatataagtatatatatccaacatataaacatgtatgtatgtatacatatatagatatgtacacatatacatatgtatgtatacatatatagatatgtacacatatacgtatgtatacatatatagatatgtacacaaatacatatgtatgtatacatatatagatatgtacacatatacatatgtatgtatacatatatagatatgtacacatatacatatgtatgtataagtagttaatgatgtataaacatatgtacgtatgtgtgtatatatgtatatacaaatttgatagttacatgctacttatagtttttataaaaacacatattgctgtaactctttatttctccaactttgctgcaattaacacaaaataggtgctaaatgatttttattcctgttgatgctctcttcccttctctacaataaaacaaccttttgtattgtttttgtttctttttttttcttcttgctgaatttgaatataggttctcttcttccttaatcacatcaggacattttccacactctgaaatacccagtcactttgaagtaaaactacccatatattattgtgaaaatgttagaatgtgagaaatacaatctttcaacgtaaaacaaaacattccaaaataaaacatgcctataatcccagcagtgatcataacaaacatcaaagagacaatgagggatatctaaatgtcttaataaaagttaaacctaataagcatctattggtttataatgctataaattctaatgttttgtataggaaacatgtatatttcattttctttttaaaattttcttggtaaaaaatgtacagctttcttttatagctcagtctagagggttataaagaagcctgaaataattgtcttctagacttaacaccaaggacaaatggaattggcaaagatttttttaaagttacaaaacttagtgtgagggaaatgattgctctcatatgcttttgttagcagtgtgcattgacacaaccttctggagtttagtctaacaacacagattaagagacataaatgtgtgtattaccctctgatgtagcatttccatttccagaatttatattttttaaaatgtcaaagagatacacaatatttagaggcaagaatcttcatagcagtattatttgcatacacatacatatacataaagaattagaagcatctacatgtccagcaatatggatatgattatcattatacacacacatgcagacacgcacacacacataatagaattctagttaactatccaaaatgatttgaaagaaaataaatcatattgaaaaatatttaaagtttcttttcaactaaaatggtaacaacatggtacgtataaataatatatttttatttatttttcactttttttaaagagatggggtcttgctatgtttcacaggctggtcttgaatttctggcctcaagcaattctcccatctcagcaattccaaactgctggaattataggcatgagccaccacctgtatttaacaatatgttctaaatacaataatgtatttttaaaaacatatatattatttattagggcagcatatattaaaatatccctgatagtgacaatttctaggttgtaaaacagtcctcttttttcttatttgtattttctaaacatgtcactacacacacacacacacacacacacacacacacacaagcaagtcttctttttcaaagaacagaataaattgatataagttgtattttcataccaaagtattcttagaccattttcaaatttgataagggtatttccacttctacaaacaaacattagaacaacactacactatttttacacaatttttaatcagctaaattaaaaaactgtgtaaatatgcttgagcaacaaaatttatagatatcacattttagtaaagttactcttgagaatccaaatactgctatcaattctgtcttcaattctcagcagattgacatagttataatgttttctataattatcaacttgaaaaagttgacacatttttatttttaattatatatatactcgggataaggataatctctttaaaaaatgaaaaattcaaaggattgaagtttacatgagtatgatcttagtaatttacattttctaccttctaaatgtatatgttgttgaacagaattccaaccttatttattctcgagaaagtattacaaatatactgttttcaaatatcttttagaatttttagaagtgttttcgtatttaaaagttttcagcttgttagaacaaattttctctaacgtataaagtctattttcctgggtgaagttgcaaagattgtcagagattaattaagatgtccaatgaaattatagtcatatatgatacaacgcataattttctttaggtcacagaatttacaatttcatatttatttagcagagcaaatgtaaattttgtaatttgttttatttgaccagttctacttgtttataaatttcaaaggagaataactgggtttaatgctaatatttctttcttgtatttatttacaaatgtatcgtgattcttacataaaagttcaaggcattagtttgtcttagttacttctggctgctataacaaaatatcatagactgggtgattgtaaactacagaaatttatttctcacagttttgacgtctgagaagttcaatatcgaggatggttagatccttcttcttgttgtgtcctcacatggcagaaggggtgaaggagctatctgggtttcttttatgaaaacaccagtcctgttcatgagggtagtaccctcataaactagctaccacccaaaaagtcccagttccagatatcatcacattgtacattaggtgtcaacaaatgaattttagggagacataaacattcagtctacagcactgttttctatgagtgagcaggaacaaaaacaagagatataattcctctttatagaggctattatttaataaataacattttaccccccaaaattcttagtttgaagtattttataaacatataattagatgagtgtgtattgtttctattctaaatagaaaagtccacatttcttgaaggaaaatcaaaaggttttgtggagtgcaaattattggaagtacagtttacttagaaaagtatgttaggtgcataaaatgaaagttttgagtgtaaaggcagtgacaatatatttatattttagacaaaaggggctcatttgcattatggagagtgattctattattttctgaatcagttcactccaacatattcatatggcacttatttatttgcagaactttagacttcagtagagcctgtaagtctcctacttggcttcatttctgcctcactcatccatgcctttccagccattctccctggtgtcattagagtgatcttgatgttaagacaagatggcctactagatgcagccaggaagtgccacttgcacagagagagaccaaaatatcaagtacaccaacatattttaaacaaatatttagagagaaaacaacaagagttattaaagacgcaaggtaaacactgtggctaaagagcaaaaaagcatgaaatcttgtgcagggttgctgaatgccagggctaatttccagtccagatcagcttctagagaaggtgtgagtaaagggatggtgaggtggaccactctcacagcagatctctgggatcccagctacaagagatgccatgacaccaaagacatttgaactgacaggagaatcagcccagagagtagacagagacagagacccatgctgcagagccgaggagcttctgtgttctgaggtagctgcagtggaacaccaccataggcacccttctctagaggctttctgtctttctctgaaaagctttaactaaccccagctggccaccaggccaagagagagcagaaccaactttcctgcaggactgggtacatctgttctgcatgttcccctgcctgctagcctggcttaaggcccctccctggctactctcacagacgtatgtgcacagtacagcctctgctgcccaacctggtgctttgcctgcagtcccacctgagtactttcccagtaggctgagagtagttaggatcccccaacacagccagtgtctgatctcgaggggcaaaaggatgtagctgagtgttgatcccaatccctcagggctgcagcatgcagcatgggaggatcccccacactcagaacactgagaggggtgagaaatgtgggtttgtggaccggcgtgggagtgggctgtggctccaatcacagggctggtccaggaagagtgagacctgtcagtcagcccgacagcctttcctgagagagcccaaatgcccagaacacctgccaaaggaaatgtggacatggcaccagtgatcagaggaggctcccccaaggcccaagagcaggcttggtgagtggggtcaggtctttccccagcccaccaaaaagcaccactgtgaattcaatgaaatacaatatagccacacagctgatttagaggctatcttctggccattactcttaagcaccatctactagattacagttcaaattacaacatcaaaaatattctgccagtatgtactacctgtgacacccagggcaagaatccagccacaaataaaaatcctgtataaaggcttttccttctaaaggactcagaaacaaagcttacagactatactaaactcaaagaacaatagcttctgatgagaaagaatcggcataagaatgatcccaattcaaaaagtcagagtgtcctcttacttccaaatgagtatgctagttctccagcaatgtttcttaaccagactgaaatgacagacagataattcagaatctggatgacaaataagcttatcaaggttcaggaacaagttgaaacccaatccaagaaatccaaggaatcccataaaatgatctaagagctgaggaaaaaagagccattctaagaaagaagcaaaccagacttctggaattgaaaaaatcactacaagaatttcataatatagcctgtagcataaatagcagaatagaccaaaaattaggaatgtcagaaattgaacattagttcttcaagtcaactcactcagaaattaataataaagaaaagaaatttaatgaacaaaatcttcaagaaatatgggactatgtaaagaaatacaacattttactccctggcattcttgagaaaggagagggtaagcaacttggaaaatatattggaggatacaatccatgaaaatgcccccaatctttctagagaagttgacacgcaaatttgagaaatacagagaacccctgtgaggtactatataagacaacaacctccaagacacataatcatcatattcaccaagatcagtgaaggaaaataaatcttaacagcagctagagagaagggttgggttacttacaaagagaatcacatcaggatagcagtgaaaatctcagcagaaactttacaagccagaagacatcggggcctatttttagcatctctaaagagaagaaattccaaccataaattttatatcccaccaaactaagcctcataaaggaaagagaaataacatccttctcagacaagcaaacattaagggaatccattatcgctagacaagccttataaaaggtccttaaacatggaagcaaaagaacaatacccagtaccacaaaaacacaaataagcacatagctcttctattaagtaattatgtaatcaagtctacaaaacaactgccaaacaacatgatgacaggattgaaatctcacatatcaatactaccctggaacgtaaatggtctaattgccccacttaaagaggatagagtagaaaggtctatgaaaagacaagacccgactgtctgctcttttcaagagcaccatgtcacatctaatgacatgtacaggttcaacataaaagaacagagaaagatctatcatgcacacacacacacacacacacacacacacacacacacacacacaaaagagcatgagttactattcttacaagagagaaaacagacttgagaccaccaacaatcaagaaggaaaaaaaagggataaaggttcaatttaataagaagacttaactatcctaaatatatatgcacccagcattggtgtacccagattcataaaatcagttcttcttgacctatgaaaagttttagacacccacacaataatcgtgggacactttaataattcactgatggcattagaaagattattgaggcaaacaactaacaaaaaaattctggacttaagctgaacactcacaaaagtggacctaacagacatctagagaatactccacacaacaatcacagtttatatattcttctcatgtgcccacaaaacattcttattttttaagtttaaaagacagagtgttttaacgtcagtctgttgatagttaaacccagtgagtaaacattgggagtctttgcctagagatctggattctgcaaattaatcaatcgtcaaattttcaggctcagcaaagcagttttatctgagtgcttaaaatggatataccaatcaggggaaagactgatatcaattgaatgcttgcaagagactggtgtataaactgaagttccaatcgttttaatttataacaataactgtgacagaagaatcagaataattatgctatcatggtcacgtctttctctctctgtaaaacaagcaaatgatgatttcttgaatagcaatggagtcatttggtaccagtgtttaaagggatcattctctgtgaaagagatctattaatacaagagccagaacattcctactcctaactagtgtacatttagatactgatatataatgccttagagctagttttccaactttccactttgatacatgtattctttccttgaatgtatccagttaggactaagccctggaaattgttttgctccaaaaggtgactttgcagatcagacttaattatctgcattgcttgaactcctggaaggtggtctttatttcttattcgtaagttttggagtggctattgactttagttgtcataaacttaccaatttagaaaacaagtatttccgaattttgatgtttataattgtgctcttttaggggttcttgattttcttagagctgaagaagttagtatgtgtttgacaaatgtctgaagattttctatttctaactaccaatggttaagtttaaatatatttacataatatgtcattttaaggtaatttgacttttatgccatttgaaatttcaaatacaatcacaaataaagcaatgaagaaaattaagcttccaattttattctaaatactattctttcctgaaagtttcccaggagacttactttagttgttaaatttctgtaattttactagcttgacataaatgttaaaagtttgtttttacataaataaacattgcgtctaaaataaaccttactttcttaacatcataagtttatatcaaaataaaaacaaataaattttgaatgtggaatgttatttgtaagctaatgaaatcatttaggaataaaaccaggattgaaactataagagcgttttaattcataactcacaagatatagattaagaaaggtagcattagctgcctgaaatcagtggtaacataagagtaataaaaacacagtatgcaaaatattggctgggcatagtggctcatgcttgttatctcaacacctttgggaggctgaagtgagaggatagtgtggacctacaacatagtgaattctcagtatgttgcccaggagtttgagatcagcctgggcaacacagtggaaccttgttttctacaaaaaaaaaaaaaaaatagaaaaattagctgggcatggtggcacatgcctatagttccagctactccaggaggctgaggcaagagtatcgcttcagccagggagattgaggctgcagtgagtggtgaccatggcatcgtactccagcctgggtgacagggtgagaccctgtctcaaaaaaaaaaaacaaaaaacccaaaatgaaacaaaacatcattcactaatttatctaaggcagatacctacaatgtcctagattttgttttctctcttgaactatccagtgagtaagcaaattagatttattctgtcctttatatatttcacttccaataaatggcttgaagagtttcagtggtcttcagttctctgatttttctcccaataagaacctcaattctaaaatctatgaggaaccgtattatttctcagttggagattattcttcacaacattgcacccaagaactttcaagcataacagtccttcttaacattaagatatatcagagcacattatatcatatgattgaagttctattagctgctataaatggtagaataaaattaataatactttaaaataaatttctatttcaacagcaaaaaaaatgtggttattttaaaaagagtggtaacaataggagacagagaaattctgggcagacagaggtgggtccctggcaaaaccccaccttcaagccaaaaaacttgaaatctgtggcccaaagtgggagcttctatccctgtgtgcccactctaacccagctggtgctctctgaataacatctttttgccagtcgaatgttgccttttccaaaactacctacagcctgccctgtgcctatcttgtgcctataaagaccccagactcagccagcagaggacagaagcagctggatatcagggagaagcgacttaacttcagagacagtggctggttgaggcaacttaacttcagaagagagaggtagagaggtggcttgacttcaggcaagagcaacttacacttcgtgtcccctttccagctcccctccccactgagagctgctttcatcacccagtaaaattctctacattcatcacctttcagttcatctgtgtgacctctggacatgcgacctctgagagacctctgggcactgcacaagaatttgggacacaccaagtgtgggtaccctaaaaggctgtcacactagccctttcctcttgctgccagagggcagctgccccaaactacaaggcaaagggcctattgagctgataacacactgctatctgtggacagcagacctaaaagagcattgtaacatgccctctggggcattgggatcacaggcaccctgacctggatgctactgtgggacatgcatgaagtttaactcctgctggcactgaagctgctggccagttgccacacttgtttgctcatacactccctcctccgaggggttgaaccatgtgggctgagtaaatgaggcacccttgtcaggagtcctgcaaaggagttaagaaattatcctgcatcaaagcctcaggagccgatgcgatcaactggaagaaagggtatcagtgatggaagatgaaatgaatgaaatgaagcgagaagggaagtttagagaaaaaagaataaaaagaaatgaacaaagcatccaagaaatatgggactatgtgaaaagaccaaatctacgtctaattggtgtacctgaaagtgacggggagaatggaaccaagttggaaaacactctgcaggatatcatccaggagaacttccccaatctagcaaggcaggccaacactcagattcaggaaatatagagaacgccacaaagatactcctcgagaagagcaactccaaaacacataattgtcagattcaccaaagttgaaatgaaggaaaaaatgttaagggcagccagagagaaaggtcgggttacccacaaagggaagcccgtcagactaacagcggatctctcggcagaaaccctacaagccagaagagagtgggggccaatattcaacattcttaaagaaaagaattttcaacccagaatttcatatccaggcaaactaagcttcataagtgaaggagaaataaaatactttatagacaagcaaatgctgagagattttgccaccaccaggactgccctaaaagagctcctgaaggaagcactaaatgtggaaaggaacaaccggtaccagccactgcaaaatcatgccaaattgtaaagaccatcgagactaggaagaaactgcatcaattaatgagcaaaataaccagctaacatcataatgacaggatcaaattcacacataacaatattaactttaaatgtaaatggactaaatgctccaattaaaagacacagactggcaaattggataaagagtcaaaacccatcagtgtgctgtattcaggaaagcagagacacacataggctcaaaataaaaggatggaggaagatctaccaagaaaatggaaaacaaaaaaaaggcagggtttgcaatcctagtctctgataaaacagactttaaaccaacaaagatcaaaagagacaaagaaggccattacataatggtaaaggaatcaattcaacaagaagagctaactatcctaaatatatatgcactcaatacaggagcacccagattcataaagcaagtcctgagtgacctacaaagagacttagactcccacacaataataatgggagaccttaacaccccactgtcaacattagacagatcaacgagacagaaagttaacaaggatacccaggaattgaactcagctctgcaccaagcggacctcataggcatctacagaactctctaaaccaggaagaagttgaatctctgaatagaccaataacaggctctgaaattgtggcaataatcaatagcttaccaaccaaaaagagtccaggaccagatggattcacagccgaatgctaccagaggtaaaaggaggaaatggtaccattccttctgaaactattccaatcaatagaaaaagagggaatcatccctaactcattttatgaggccagcatcatcttgatactaaagctgggcagagacacaaccaaaaaaaagaattttagaccaatatccttgatgaacattgatgcaaaaatccttaataaaatactggcaaactgaatccagcagcacatcaaaaagcttatccaccaagatcaagtgggcttcatccctgggatgcaaggctggttcaatatacgcaaatcaataaacgtaatccagcatataaacagaaccaaagacaaaaaccacatgattatctcaatagatgcagaacaggcctttgacaaaattcaacaacgcttcatgctaaaaactctcaataaattaggtattgatgggatgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaatcaggaaaagaggaagtcaaattgtccctgtttgcagacgacatgactgtatatctagaaaaccccactgtctcagcccaaaatctccttaagctgataagcaacttcagcaaagtctcaggatacaaaatcaatgtacaaaaatcacaagcattcttatacaccaataacagacaaacagagagccaaatcacgagtgaactcccattcacaattgcttcaaagagaataaaatacctaggaatccaacttgcaagggatgtgaaggacctcttcaaggagaactacaaaccactgctcaatgaaataaaagactatacaaacaaatggaagaacattccatgctcctgggtaggaagaatcaatattgtgaaaatggccatattgcccaaggtaagttatagattcaatgtcatccccatcaagctaccaatgactttcttcacagaattggaaaaaactacttttaagttcatatggaaccaaaaacgagcccgcattgccaagtcaatcctaagccaaaagaacaaagctggaggcatcacactacctgacttcaaactatactacaatgtacagtaaccaaaacagcatggtactggtaccaaaacagagatacagatcaatggaacagaacagagccctcagaaataacaccgcgtatctacagctatctgatctttgacaaacctgagaaaaacaagcaatggggaaaggattccctatttaataaaatggtgctgggaaaactggctagccatatgtagaaagctgaaactggatctcttccttacatcttatacaaaaattaattcaagatggattaaagacttaaacgttagacctaaaaccataaaaaccctagaagaaaacctaggcattaccattcaggacataggcatgggcaaggacttcatgtttaaaacaccaaaagcaatggcaacaaaaccgaaaattgataaatgggatctaattaaattaaggagcttctgcacagcaaaagaaactaccatcagagtgaacaggcaacctacagaatgggagaaaattttgcaacctactcatctgacaaagggctaatatccagaacctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatgagagaaatgcaaatcaaaaccacaatgagataccatctcacacaagttagaatggcgatcattaaaaagtcaggaaacaacaggtgctgtagaggatgtggagaaataggaacacttttacactgttggtgggactgtaaactagtttaaccattgtggaagtcagtgtggcgattcctcagggatctagaactagaaataccatttgacccagctatcccattactgggtatatacccaaaggactataaatcatgctgctataaagacacatgaacacgtatgtttattgcggcactattcacaatagcaaagacttggaaccaacccaaatgtccaacaatgatagactggattaagaaaatgtggcacatatacaccatggaataccatgcagccataaaaaatgatgagttcatgccctttgttggcacatggatgaaactggaaatcatcattctcagtaaactatcgcaaggacaaaaaaccaaacactgcattttctcactcataggtgggaattgaacaatgagaacacatggacacaggaaggggaacatcacactctggggactgtcgtggggtggggggacgggggagggatagcattaggagatatacctaatgctatatgacgagttaatggatgcagcacaccagcatggcacatgtatacatatgtaactaatttgcacattgtgcacatgtaccctaaaacttgaagtataataataataaaataaaataaaataaaataaattatcctgcatcaatggcagcacctgtgcttatagaaaaccgtatgtttagggtacagatgtttgtgcatatgctgagaatgtgtattcttgcaacatctctgaaaatgttgcgatttttttctctctctttttttaagtactactttattgagttacatgggacatacaataaaatatcctattataactatacaattgaaacattttggtaattttgtatagccatgtaatcaccataacaatcaagatgtaaaacctttcattcaccttaaaaagttcatttgtgcccctttatggtcattcacatccccttttctgagtatagttttacaatatattctttcagaaagcttgcaattttccattcttgaatatgtctttgaaagatcaaaagttgtaattttgatgaagtgaagtttatccaactttttatttattgttactgtttatatcacattattaaaaaaaaccttgcctagccctctaaaattgttcaaattttatttgataaaagtatttgataaaattcaaatacttagtatagaaaaaataaacttttagattttgtttcaattttattttttagccccatgtctttctctctctgacatatagacaactcctatttttatcaaactaaacatattatacaaacaataaatcaaaataataaaatagtgataattttaaaacttagactattaaagaaatatattttatttagttatgtgatttcatgatagaaagcattgtataaatgatgcaagaaaccccacaaaccatagcaatcatttaaaaaaaaaacgtgctttaaaatcttctacaggaagaaattaaaaacaaatgtagagatagggaaaaatattttaacataaaattttagtttcagaaaatacaaagcattctgacatttgacttacaaaaagacaactcaaatagagaaatagaggaaataataaaaataggcaactagttcatcaaagaaaaagggattgaattataagtaaaacataaagtgttcttagctttctgataactagggaaatttaaacagaaatagtaataagatatgtttgaataaccatcagatgataatcgacaatgagaaagaatgaagttgggaatataatgtatttctaataaaaccgaaaataaacacatctaaaaatctagtgattctacttctaagaatatgcagaatatgcacatcttatgatctagcaattccacttctaagaatatacactaaagttactcttaaccactgctcactctaaacattagaaatacccaaatatctttataaactatttatttgcatatcaataggtatagaacgcagaaatattctcttgagaggataaataggcagcagaccacacacaacatttaaacagtatatagtaaaattatggaaattacttttgaaggcccccgtcatctgcatacgaatgcttattcgaggaaaaggaggaaagaaataggacctaaaggaagaacaaagagagtttgacattgtctgtaatatttgcttttatataaatataggaattatacctatcagaaattgtatgtaataaacaaccacaacagctcagtggcaaatgaaaataataatttattttccacatctatagtgcataggatggccctgccattcacatctgcattatgcctgtatttgaagactggctggtgttctgtgtgtccaggctgggctcagctaggcaccaccacttcaagctgcagatctgcttgattcaattgtactgtaagtgtttttaatctggatcccagatggaaagagtagcagatacctacaggaagttcttgtggggatggtgaaaccggcctaattatcccatagaactgatgcttacagttgtttgaataaagagaaattgaccctccatgtcttaaaacttgaaacttacttttgtattatgagttccttcctcagtaactcataatagtttcttcctcaaacaagaaactaaaactcaccagatgactacatccagacaataagacgccagacccctcacccatcatgattttctaacccctccctaattactttttaccaattcctcttcctaacccttccctaattcctgttttcctacatgtagctacattcctgccccgctatataaacctctgagtgtagttggttggggatagggagatggatttgagacttaactcctacctccttcactacagcacccaaacagtgacttctgccctagcaatacttactgtctcggtgattgtctttctatgctgtcagcagcaggacctagataattgttccctcctctagtggatgcatttgatgatgggacctatagagtgataaagacaaaaacccaggacagagcctgggttttgagtggctctcttgcggacaaccacatgagcaataaaagaattttgattggtttcctcctcagatatttaagcctatttgttatgctatttactctaactaatagttgtaccctagtacttatcttgcagaagccatttccaatgtgaatgagcgtaataattattagaatgatttcagacatgttagctcaaagaaaaaaataagctctcacaggaaaatactgagattcactttctcaatctttttagagaaggtacattatacagagtcatgaatgtcaatacctaaaattatgtggtaataaatttaataatgtttcagaaatgcttaaaatatctgtaaaaatgagataaatgtgtttgattgttctttcaaaatgtgttgttttcaagaaagagaagctatatatttgaaaaattgttaacaaatctgattgcatggaagatcatacaataaatatttatatatacataatgttctattaaaaggtaaacactgactatgaaaaacacttctataattggctcagtgtaattgagctcaccattcagccttttataaaacgttcatcactaaatgcttttaaataatgtatgagtcatgtaattgctctgagtatttttataatgactgtagttcatactagaaaatgtacctactacctatatgggtctcccataaaaccatattgaaccctaatagatatgaatttgaaagcagatatcagtagatttattctaagaaggaaaatataattaaactttatcacctctatttacagtttcaaattaaaggtaaaaagacattaaaaatttaaacacataatacatagctttttcaactttagatattacaaaaatgcaaatattttcaataaaatccagatggctacaattgctaagaacttagttaattaaaattatttttaattcaaaatgtgtacttccttgtaattgattttaaattacttaattcctttctgcatgatttatgtcattaacaaaaccaagttgccactaagaaaataatccaaagaattaaccagtgataaattaggctctttggagtatatacctgtgagccatgtcatttcaaagttaaagcagcgtttttgatgctttgacaaggagaagaaattgaatatagaaattgcctttatcaatattttacagcatagtacttgaataataatgttaaaaacaaggaaattgttacttttattgtgctcattgataaattgatttagtgctaatgtgttcagacctaatcaaattcctctttaccagaaatggattttgacccccttttcccaaccatattgaatgccttcatttctagacagtaaagctagaagctataaaatatatgacagtgtcagggcactctcagagtatgctggacccattctcataataccagataactttatggcgtttccaggatgcataggactcaggttacatttccaacatgaaagtacatgttcctttaacaaattaccttttcatgaagtttgactgtattgtgccccattatttccaattagcatggtgatgcttattttgcttatttttcaccttcaattgctatagctctatgcaaattctttttctcaaaaaactggccttttcacctttaccagattgctaattttctcatgaaattcctaaatatatatatatatatatatatacgcacacacacatataatattatatataatatataaaatatatattataaatatatattatatatataatctttatatattatattatataatcttttttggtttttgaataatctttattctaacctgtgcttatgaacattttatgtgccattactgtagtagatttttgtttgtattttggtcgtaagcacatattcctctttctgagtgcaatatcaccaatactttctttggggcatttgtttttccctacttttctcatttgtatattctatttgagacttattttaaaaagtccctgattatggcaattgtctcaagtatatgcagccaacctaatcagatatatacagttgacccttgaacaacagaggtttgaactatgtaggttcacttatatgtatatttttttccaataaacacattggaaaattttgtgaagatttgcaacagtttaaaaaaaccacaggtgaactgtgtagcctacaaatatcagaaaaattcagaaaaagcaaggcatgcatgaaaacataaaatatatgtaagattagtctattttatcatttagtaccatcaaatatacacaatatctattacaaaagtaaaatttatcaaaacttacacaaacatttacagaccatacctggctgccatttgcaatcaagagcaatgtaatcaagtgtacagatgcagtaataaataataactgcataaaattaattgtagcatactgtacttatagccagctcctattgctattgtggtgagctcaagtgtagcaggtatccacttaaaatgcctggtgatgctaattatctccacatgaccactttacctcttcagtaagttgcactattacaggaaaaagtgatctctcatgattcttgtgtattttttattgtgcttagcgcaaaactgtaaacatcgaataacatcatgggacgtataagaaatcactagtgatactggaagtactgccaagaagagagaagtcaagacattacaaaaaaaaggtgaattgcttgatatgcactatagattgaagactgcagttgcagctgctcaccatttccaaaagagaatccattttgtaaataaacagtggaagtactgtaaatgtattttttcttccttataattttattagaaatgttgtcttttttattttactttgtgttaagaatacagtatgtaacatataaaaatgctttaatcaactgtttatgttattaataagccttcattgacagtgggcaattagtagttgtgttacggtggggttaaaagttacaggtggattttggactgtacagaagttggggatgttaaaggctcaactatatttatgtgtgtgtgtgtatgtatatatatatttggttatttatatctgattatatatacaatatatatacatactctataatacacacatgcttgcacacacatatacacctatatatatatttcaacacagaggttactgaaggtaaaactgctatagccatattgtctctatgatgggagaacctgtttcaaactgggtctaagtgagaaaacaaaacaaaacaaaaaacctctctttggcttaaggcaaaaacaattggaatcactctcaatcgtctctttttttttaacacctaaaaaattctgccagacctatatgaaaagatatccccaaaccaactatttgtcacctttctgcttaaattgctagttaatggtacctcaatatttttgcctggactggtacaatcactttctaataattctcatttttccattctagttatcacaattcattgtcatctgtcagtcagaaattagaatttctgaatttgactgtgacacagtagtttagattaaaatatcatacactcttgaacaactagagaagagaaataaaaatacttcttcaaaaatgtttgattgtatcagagagtatatacagccaaaaatgaagtttccaggatcatggagagaagacaaacatatggaaggaagtggggctttttcttctttttgcccatcaagagttaccaatttctatgaaaggtgggtctagagacaaagtagaaagcagcagcatatgcattctttcaacatatcaaaacatgcagagagcagccaaagcttagaggcaatgttacagccttcaatgcatcggaaatgaaaaaaaaattgctgaattcattacacatatatctatgtatgtatgtgtatatatacatgtatgtgtgtatgtatggtgaatatctatattcatatatatgtatacatatatgtgtatttatacacacacacatatcatatattaaaaacttagaacacacacagcaaattagatccaaaaaagtagaataaagtaaataatactaagatcagatttatttatgtaaatgataaaatccaacaaggtgttcccaaagagaaagagagagaggagagagcaaacatgagagcatacactatcaaaattcagaataaagacagtatataagtaaatatcctatggctgaatagattaaacgttattaaaaattatgccaataatttaaattttatattaaatgaaaaatttcttttgaaaggcaaaatataagtgacatagtaaaatagagaagatagaaataatcctttatttattaaatacattaatatataaatgcaaatcattctgcaaagtaaacttcaagtttaggttgctttacagagaaccttctcaaacatgtaaggaagaaacaatccaccaatttatgcaaactctttgtgacaaaagaaaataggatgtactgtttactttatccaatgatgtttatataactttgtttcataactggatacagacattacaggaaatcaaaattacaggtcagaattttgcattaatataaacacaaaaatctgaaataaatatttgcaagttgaattcaggaaaatataaaaatatcacaatcgaatttgatttattgcttgaatgtaatcttagtttatcatgtgaaaagcagcttaagtaatttatcaaattgaaaaatgaaatagataatagtataattgctatacataagaagtcttttgataaaatttaactccttgcatactgccttgatgggagttctggaacaggcatatacattctccagatttatgagcaagcttccacacagaaagaagatggtctccttaataataaaacttgtttaattgtatagccacattggaaaaagaataaattctgaactctacattaccctatacacaaaaatacattctgagttgatagtatgggaaaaaatatattaaaaagagaagaagagaaatgtttctagaagataacaaaggaaattatcttcattacattggaattttaaaaattatttttatttgtttttcccccttagcacatgtattgttatttattttattttattttaagttctaaagtgcatgtgcaagaagtgcaggtttgttacacagttaaacgcgtaccatggtggttgctgtacctatcaacctatcacctaggtattaagctcagcatgcattacctctttttcctaatgctcttcccccgcccaccctccctcaacaggccccagtgtgtgttcttcccctccctatgtcatgtccatgtgttctcactgttcatatcccacttataagtgagaacatgcagtgcttggttttctgttcctgcattagtttgctgagcataatggctctcaggttcatccatgtccctgcaaaggacatgatcttgttcctttttatggctgcatagtattccatggtgtatatatgccaaattttctttttccagtgtatcattgatgggggtttgggttgattccatgtctttgctattgtgaatagtgctgcaatgaacatacatgtgcatgtatcgttataacagaatgatttatattccatgggtatacacccagtaattgctgggtcaaatgatatttctatttctaaatcttcgaggaattgccacactgtctaccataatggctgaactaatttacattcccaccaacagtgtaaaagtgtcataattaggaaaaaacacataattacatcagaaaagattgacaaattggaaacctttaaaattaggactcatgatagacaccattaaaataatgaaacataattcaacaagatgtccttcaaaaggtaaatgaatgaacagtctgtgtatcatttgatggatatggaatgttattgggaaggaattattattgaaaaattaaaccctataagtcaagtcacaaaaagacttgggaaaaccttaaatacctattcataagtgagagaagcaaatcctaaaatgatacatattatatgatcccaactctgtgacattttggaaagggcaaaactatggagacggaaaagggatcaatggttgccagggggttggggtgaaggaagaaaatatcattaggtagaacccaggggatctttagggcactgaaactattctgtatgttgctataatggcagatacataacattatacagttgtcaaaatccatagagctgcacaatacacagagcaaactgcaaagttaactgtggactttggtcaataatagcatattagtattgattcatccattgtaacaagcatatgacatattactagttgttggcacggggaaagcagtgtttggagggtgaagttatatatatatgtatatatatatatgatttctgctcatatatatacatgatttctgctcatatatatacacgagttctgctcatatatatacacgagatctgctcatatatatatacacgagttctgctcatatataaatacacgagttctgctcatatatatgtatacacgagttctgctcatatatatgtatacacgagttctgctcatatatatgtatacacgagttctgctcatatatatatatgagttctgctcatatatatatatatatgagttctgctcatatatatatatatatgagttctgctcatatatatatatatatgagttctgctcatatatatatatatgagttctgctcatatatatatatgagttctgctcatatatatatatatgagttctgctcatatatatatatgagttctgctcatatatatatatatgagttctgctcatatatatatatatatgagttctgctcatatatatatatatgagttctgctcatatatatatatatatgagttctgctcatatatatatatatatgagttctgctcatatatatatatatatgagttctgctcatatatatatatatgagttctgctcatatatatatatatatgagttctgctcatatatatatatatatgagttctgctcatatatatatatatgagttctgctcatatatatatatatgagttctgctcatatatatatatgagttctgctcatatatatatatgagttctgctcatatatatatatgagttctgctcatatatatatatatgagttctgctcatatatatatacatatgagttctgctcatatatatatatatgagttctgctcatatatatatatgagttctgctcatatatatatatatatgagttctgctcatatatatatatatatgagttctgctcatatatatatatatatgagttctgctcatatatatatatatatatgagttctgctcatatatatatatatgagttctgctcatatatatatatatatatgagttctgctcatatatatatatatgagttctgctcatatatatatatatgagttctgctcatatatatatatatgagttctgctcatatatatatatatgagttctgctcatatatatatatatagagttctgctcatatatatatatatatatatatatatgagttctgctcaattttctgctaaattttgctacaaacttaaagcttccctaaaaaaataaatttcattataaaaatccacagttggaaaagacttttgaaatttatatattcaacaaacaacttacgtttaaaaccttcctacaaaataagaaaaataaagacaattgatgatataaaagaagtgtgaaaaggcacttaaaatgtgaaaaggcatttaaaatgtaggctaccaaatggccaacaaacctaagaaaaaatgctcaaattcgatagtcatcaaattaatggacactaccttcatgaagagatgccactgtaaatcttcagaatggcaaaaattaaaaacttggcaatacctagtgaggatgtagaacaattttcagtttcatatattattggtatatttgaaccctgtcattatctgctggagctgaaaatgcactatcctatgactcagaaattccacacctgggcatataaccaaaaaatttggtacatatgtgtgtgtaaagacatgtgctagaatattcatagaagcaattatccatagtaatgaaaaactagaatcatcccaaatgtccatctacagtagaatgtatacatttgagtattaacaagtgatagaatatagagtaaaaataaacaagctactgcatgtatacatacacttcataaaatgtttacttaaaaacaaaactaattcagattagattgttcctctgctcaaaacctttaaatgaaactccaagccaatataaaagtccagtcaatctaaattcagaatccaatctcttaatcactgggatacattgcccttctttccagcaaggtatgttagttaataggaggacaacatatacataggaaaacaatctttttttttatttttgagacagcatctcacactgtcgcctaggctagagtgcagtggcatgatctcagttcactgcaacctccgcctcccgggttcaagcaattctcctgcctcagcctcctgagtagctgagactacaggtgctcatgttggtgctcaatgttggccacgatggtctcgatctcttaacctagtgatctgcccgcctcggcttcacaaagtgctgggattacaggcatgagacaccggcgcccagccaatctattttttattaattagttaaaggatacaatatcttagtcatacatacataattgcacagaagacctagcaagtgtcacacactcatttcaatgtgtggtttccttagcatcactgtggttcctcactatgggtcaagtatctgccagtgataacgcctggttaaaaatgggatttaaagtataattcctagagaatctaattctgaacctttctcagaggacattaatggcttcatgactactctcaattgtttgaaaaaaaaaatcctggctagatatttgctttctggcctaatgcaagcagatacaagccataataaactatgtaagatagaattcagatactagtcttccatatccatttcctttctcaatgcaggagatgatgaataaggctccagcacatgatcaagaaaattccgtagatcaggtttaatttaacatccaatttccaaatgtaattaggatatgccagtttaggtgaggccagaagtcaggcccacctaaaattctatacatacataaaccagagtcagcacaaatgtcatctttcaaagttcagcacttccctcttcctaaataaattctttctcatctgtttatttttccatgtggaatatctataacagcagagtataatggaagatgtgaaatggttaagcataccttgtaagttttgtagctaaggaagttatttaacacatttaataattttaaagaaaatgagtaaaggtctttgtctttactatgacttaggttcatttgtatgtactggagataaccttggattatgcaagatagaaatgtatttctctagcatactaaaatttacatacatgtaatttagtcctggtcagatatctccaacacctttacagactctttacaactttctctttcatcattcttagggagaaacaaatggcccaaaatagggccctttaaataaatctagattttaaacagaagaaggcaggaaaaggaaaggcaacaggtcataccatgtcctaataatgacacatccaagatgtttgacaaatcatttactcctagatacaagccagtaattggtcaaactgccacatcaaactttaaggatatctggtagatgcaatctttaagccagtggatcatgtatccagtgaaaggttaggagttttgtcagaaagagatgagaaaactgtttctgtgggaaatctcacagcctctgtcacagttgctacgatgtgattaaacgaaaattcatgttcaagtcctactccaaatagaaccactcttcctgtctataggagtctactgtcaagtgctatccccagctgatacaaatagaaagataaccattcaaaataataggtaaatgaaagttttgttttgccttgtctgtaaataaataaacaaatatattttttaaagacttggaaatcaaagaaaaccagaaattattggcagagattgggaatttctgaaagagaatctgactgaagtaaagaatgtcctgggacccacagaccaaaagcagtagacattgaatgatttaaaatttacagcatttcacaaaatttatttaggaaagagaaagtagatatttctacaaaatcccttacactgttattcattgaagataattagacattaatgatgaaaaacctgtttttaatttgtggtttattacatataaatacattaggccacaataataaaaagcccaacttccaatagcttaaccacatagatatatctgatttttgtggatcaagaaatgcagaattagtctagtagttccatgatatcatcaaaatccagagtccttttattttagcttcaagcatctttggtaggcagctttcaactttagcgttcaaagatggctgtatgacatttaagttagatgaaggcagaaagaaggggtaaggctaaggaaaaaggttaaaatcttcttcgtaagtttcctttaaaagttgtttcaagctggaagctttacttagagattttagccaaaatgttattgaccaggattgtgaaatgtggccatcttaaaagaatgcttgggagactgagaattagaagacaaagaaaaatgaggctatcttgacgtcaggtggtcgacatacaatgtctgttagaagtactatttttaaagttattatggcaaacaacatatttgcactaatttttaacacaacttttagaaaatactgagataaaaatgtctctctgagtttttgtaagaaaactatctgacccagtgaacctcatctagaaaatacagaaaagattttacttccgagagtggatatagtctactattattcatctaatatccacttcttagcctcataatacacagatacgtgcacctgcatgggaagagtatgttttccattccactaatattgagctttgttatgtaacctttatttggcttcatgtaaggaaaatgggcatgtgctttgacttgaggtttgaatatctgacttgctttgcccagtgggatatttatgaataagaggtgacctaagactttaaataagatgagtgtttgggtttgttctctagttttttgtcattaaccctgtgaagaatatgctttccttgccacttgtccaaagcagattagagacacaggaagtaaaatgcatttaacccctcatgtggagccaagcccagctgaagaaagcattggtgagcaagaaatcagctcactttcaaatgagtaagcaagatataaatgtttttgaaagtcatataaattttggggtttccctcttatgcaatattattgtggcaatagtttactgaatctttgagcaaaacagctaaatcagtacttctttaaaattgagttttaattattctagttttaaaatatatttggaaatcaggaagtgtgatgactcagccttatttttcttttttaagattgttttggctacttagggttctttgtggttccatacaaattttaggattgatttttctatttctgtagaaaatgtcattgacattgtgatagagattacaatggatttgtagactgtttttgttagtatggacattttaaaaatattaaaatgtctttccatttatgtgtgtctttaatatttttttatttattattattatactttaagttttagggtacatgtgcacaatgtgcaggttagttacatatgtatacatgtgccatgctggtgcgctgcacccactaactcgtcatctagcattaggtatatctcctaatgctatccctccccccttcccccaccatacgacagtccccagagcgtgacgttccccttcctgtgtccaagtgttctcattgttcaattcccacctatgagtgagaacatgcggtgtttggttttttgttcttgtgatagtttactgagaatgatgatttccaatttcatccatgtccctacaaaggacatgaactcaacattttttatggttgcatagtattccacggtgtatatgtgccacattttcttaatccagtctatcattgttggacatttgggttggttccaagtctttgctattgtgaataatgccgcaataaacatacgtgtgcatgtgtctttatagcagcatgatttatactcctttgggtatatacccagtaatgggatggctgggtcaaatggtatttctagttctagatccctgaggaatcgccacaccgaccttcacaatggttgaactagtttacagtcccaccaacagtggaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagttaggttgcgaaaattttctcccattttgtaggttgtctgttcactctgatggtagtttcttttgctgtgcagaagctctttagtttaattagatcccatttgtcaattttgtcttttgttgccattgcttttggtgttttagacatgaagtccttgaccatgcctatgtcctgaatagtaatgcctcggttttcttctagggtttttatggtttgaggtctaacgtttaagtctttaatccatcttgaattgatttttgtataaggtgtgaggaaggcatccagtttcagctttctacatatggctagccagttttcccagcaccatttatttaatagggaatcctttccccattgcttgtttttctcaggtttgtcaaagatcagatagttgtagatatgcagcattatttctgagagctctgttctgttccattgatctatatctctgttttggtaccagtaccatgctgttttacttactgtaaccttgtagtatagtttgaagtcaggtagcgtgatgcctccagctttgttcttttggcttaggattgacttggcgatgggggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatgaaatgttcttccatttgtttgtatcctcttttatttcattgagcagtggtttgtagttctccttgaagaggtccttcacatcccttgtaagttggattcctaggtattttattctctttgtagcaattgtgaatgggagttcattcatgatttagctctctgtttgtctgctattggtgtataagaatgcttgtgatttttgtacattgattttgtatcctgagactttgctgaagttgcttatcagcttaaggagattttgggctgagacagtggggttttctagatatacagtcatgtcgtctgcaaacagggacaatttgacttcctcttttcctgattgaataccctttatttccttctcctgcctaattgccctggccagaacttccaacactatgttgaataggagtggtgagagaggacatccctgtcttgtgccagttttcaaagggaatgcttccagtttttgcccattcagtatgatactggctgtgggtttgtcatagatagctcttattattttgagatccgtcccatcaatacctaatttattgagagtttttagcatgaagggttgtcaagcaaatgctgagagattttgtcaccaacaggcctgctctaaaagagctcctgaaggaagcactaaacatggaaaggaaaaaccggtactagccactgcaaaaaaatgccaaattgtaaagaccatcgaggctaggaagaaactgcatcaactaacaggcaaactaaccagctaacatcataatgacaggatcaaattcacacataacaatattaaccttaaatgtaaatgggctaaatgctccaattaaaagacacagactggcaaattggatgaagagtcaagacccatctgggtgctgtattcaggaaacccatctcacatgcagagacaaacataggctcaaaataaagggatggaggaagatctaccaagcaaatggaaaacaaaaaaaggcaggggttgcaatcctagtctctgataaaacagactttaaatcaacaaagatcaaaagagacaaagaaggccattatataatggtaaagggatcaattcaacaagaagagctaactagcctaaatatatatgcacccaatacaggagcacccagattcataaagcaagtcctgggtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccacctcaaatcgacagaatatacatttttttcagcaccacaccacacctattccacaattgaccacatagttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataatgaaatgaagcagaaataaagatgttctttgaaaccaacgagaacaaagacacaacataccagaatctctgggacgcatttaatatttctttcatcaatgtttcaccgttttcagtgcataagtctctcagctcattagtttgatttattcctaagtattttattattttgatgctattataaatcgaactgttttcttaattttcttccagattgtccagtgttcgtatataaaaatgtaactgacatgttttaaatctacagtaattcaaacagcattgtactaatataaagacagacatttataccaatggaacagaatagagatcccagaaataaatccacaaatatacagtcaactgatctttgatcgggggctaagaatatacaatggggaaggaatagtctcttcaacaaatggtgctgagaaaactggatatccatatggaaaaaaaaattggaattgtttcttgcaccgcacacacaagtcaatgcaagatggattagatgtaaataaaggcttaaaataacaaaatccttgaaagagacaaaagtggaaagcttcatgacattggtcttagcaatagtttcttggatataacactaacaacattggcaacaaaagtaaaaataaaccagtggggctacatcaaactaaaaatcttttgcaccgcaaaggaaacaattaatagattgaaaaggcaatttatgaatttggagaaaatatttgcaatccatatatctgataaaggatttatattcaaaatatattaaaaaacctacaatgcaatcgcagaaacaaacaagaaaaaaaggacaaaacaaaaaaagtacactattaaagaaagaggaaaagactcccataaacatttatccaaagaagacatacaaatgtcaaataggtatataaaaagatacttaacatcattaattctcagggaaatccaaatcaaactcacaatgatatatcaccttacacctgttaggactaccattattaaataacagatttgggtaagaataggaagacactgaaagcattgtacactattgttgggaaagtaaattggtgcaactgctatggagaagagtatggcggtgccttaaacattttaaaatataactgccatatgatccaacatcctacttctgtatatttattcaaaataactaaaaccaggatcttgattagatatttgcacttccatgcacttctattctatctatgaatgatacttggagtatcattcataatggccgaagtatggaaatttttaattgtccattgatgtataaacggacaaagcaaatgtgatatacatacaatggagtattattcagctattaataaaacaagaaaattctgcaatatgccaaaacatggatgaacctggaagacattatgttaagtggaattagccagtcacaggataaatactgcatgatcccatttatatgaggtatctaaaggagtcaaactcacagaagcagagggtagaatggtggttgccagaagataagagggagaggaatatagggagtttctgttcaatggatagaaagtttcagttatacaagataataagttcaaagatttgctgtatttcatgcctatagttaataatactgtattgtatatttaaaattatttttaaagggtagatctcatattaaatgttcctactctaataaaaaataatgagaaaaacagaattgagttagctgactgggaatggtaaacctgtgacatttgccacataatgctacacactagttatttatatttattcttatttctctcagcagaatattaacttgagagagccaattaaagttgcaatgtgtatgtatgtatccccacaattcttataatactttgcattttaatagttacgaagtaagattaactacaaaaccaagaagtaaaacagcaactattatacttaaaaatcatgagatattcatttaaaagttcttggattttaaatatatttacaggaaaatatggcaagtagcaacaaatagttactatccattcaataccacatgactcaaattcatgttaaatataaggttaatggtagggttcatctgaaggacgacaagcagatgatgtacctaaaatgatttcttcatgtctgaatggttccagatggtctccatttcagacttttcatgactggtctgaaagcttctcttcttgcacgctaataagttagcctgctgtagttttatggatgctggcagaacagagtccaaacataaagccatacatatataatccattcatttcaatcaatgaactgaggaaagcaaatgaagaaaggatagttttttgaacatatagtgccagaacaactgaatgtctgtatgggaaaaaaatgaacctagggtggtatcaatgggaatggtagagactttcaagtatctgtaccttcataacagcaatgacaacactagcaaaaatggccaaaatcaactttttcagaactctggaaatgagccaaagtcttggaatatttacttaaggaagacaataacagaatctttgtaagaaaagtgagttatatggcattttaacttgcctttatcccctctcttcagctgtgcattagatttagaaaacaacagttccacaaacaaggtagctgtgaaaatcagcagcctagcagttacgaaagggggcataaaggatttgaagccctcaaaagccaaatccctagagaattgtcatcatctgacaagcaggaagtgcaagcagaaagtgaaagcagagttgtcagctgcctaagtgttgaatgaagccatgcaccaacacacacacacacacacacacacacacacacacacacacacaaccccggcttagtagagatttggagaattactgtataaaagcattttaagaaatctctgtccaattagtagcttacaatttagttaactgagcagaaatttctgtagccatacaggacaaaaaatacaaagttaacagaattagttcagtaaagtcactaaggaaacaatcaacaacaacaacaaaccttgccagagggggatctgtatcatttttctactgctttaatttaaaaaatgccatgaactacgtggcttaaaatgacacgagtttattatatgtctaaaggtcagagatctaaaattggtctcattggctaaaatcaaggtgtcagtaggcctgtattccttcctgaggctctatgggataatctgcatgttttcccttttcagtttttagaggccccctgcattacttcactcagtgcctcattcttccattactaaaaccagcaaaatatgtttcagtttttctcatgctgctaaatctctctgactctctatcttctgcctttctcttccagataaaagaaccctgtgactacattggacacactctgataatgctggataatctctccatttcaaggtcagctgatgagcattcttaattctatctgtatctttaactgttctttctcatgaaacttcatgtaatcattggttccagagattagaatgtgaacattgttggagatccattattgtgcctatcacatttaagaaaattaaaacctaatacctcatcataatctctagtagtcagaaggcagtgagatgacatttggtgctgaaagattatcaaccaaaaattctactttcagcaaaattattttgcaaatatgaaggagaaattaaaacatgcattaaatgagaacagagagaatatattattagcaaatttgtgttaaaagacatacaaaggaggttctttgagcagaaatgaaatgaaatgaagcatattcacgagttctgggaatcaggatgtggatatttggggacaattattcagcctcccacagaattatcttcattctcataaaggctgtctacaaacatctggcagctagcatgatacttaatgataaaagactgaaaactttcctcttaagattagcaataggacaaaataattcatttctcactcaatttattgaacattgtactagaaattctagccagagccacttgcaagaaaatgaaatgaaaaatcgaaaagaaagaagcaaaactatttctcttcccagaagacacaatctggtatacaaaaaaattctacagaatttaaaaagcatataataacttataaacaaattcagcaaggttgcacaatacaaaatcaacttacagaaattaattatatttttatacactagcaaagaacaacttaaaaatggaatttttaaaatttctattttaaaaattgaaaagtaacaagaaaacaatcaatgtaaatagaatcaaaaataaaatacttagaaataactacgcaaaacctgtacactgaaagctacaaaacatcactgaaaaagttaaggaagacataaagaaaacagcattttatttcatggatcagaagatttaaaagtggcaatactcctaaattgttataaacatttaaagcaattcttttttttttttttttttgagacggagtctcgctctgtctgtcgcccaggctggagtgcagtggcgcgatctcagctcactgcaagctccgcctcccgggttcataccattctcctgcctcagcctcccgagtagctgggactacagatgcccaccaccacgcccagctaattttttttgtatttttagtagagacggggtttcaccatgttagccaggatgttctcgagctcctgacctcgtgatccgcccacctcgacctcccaaagtgctgggattacaggtgtgagccatcgcgcccggcccatttaaagcaattcttatcaaaatcctagccaacatttttttttcccagaaactgaaaagcagattctaaaattcacatagaaacacaagggacccagaatattcaaaacaatcttgaaaataaaagatagaaaaattcatactacatgatttaaaaactgagagctacagtaatcaagatgacatggtgcttgcattaggatagacataaaactatgaagtataattgagattccaagtataaatccttgaacttataataattaatttttgataagcatgccaagataattcagcggaggaaagaatagtcttttcaacaaatagtactggaacaactagttatccatggcaaaataccaagcttgacctctaactcacaacatatccaaaaacaaaacaacaaataagcaaacaaacaaaaactcaaaatagataagattccaaaatgtaagtgctaaaactctaaaacttttttagaaaaatgagtccattttcttgaccttgatttaagcaattttttttctaatatgagaccaaaagcacaaacaataaaaggaaaaatagacaaactgtactttataaaaattataaaattttctgccttgaaaaatcccatcaaaaaagtaaaacaacaagccacaaaataggagaaaatgtttgcaaatcctgtatctgttaaaagacttatataaacaactgctgcaatttaatcaaaaatcacatgaaaatatgttcaaccttatttctcatatatgaagtgcaaattagcacaacaatgagatacctctgtctacccattataatagcttaaaaatcaaagacgtatataaacaactacttcaacttaacattcaaaagacaaacattatacacaaatgtcaataagcacaagacaaaagagcagcatcattagtcatttgagagatacaaatcaaaccacaatgagataccatttcacacctacgaggataactataataaaaaagatgcacaagtgttagcaaggatgtggataaattataaccctcatacattgcaagcaggagtctaaaatggtacagcaattatggaaaataacttggtagttctcaaaatgttaaaggtagagttaccatataatgtttttgatgttgatgaaaatgttctggaattagatagtggtgatggccacacagttttgtgaatatactaaagaccattgaattgtacattttaaaagagtgagttttatgacatgtgaattatatctcaataaaaatgaacatatacacttagttcatgtcacatatatactgaacacaaaatggaccatcaattcaaacataaagttagaactattaaaactttcagaaaaaaatacaaaaaaaaatattactatctttggtgctgtaaccactcaagaatcagaactgaccctcacctaaaatttggttcaaatgtctaacaataccacacatatccctggactatgaaaggtttattactcatataatgaggctcctgggaaaaccaggacaaacttagcactatggttccaaaataggttttgagagcagagcaaagtgactttttatttatttatttgtttgtttgtttgtttgtttgtttatttatttagagatggagtcttgctctgtccccaggctggaatgcagtggcgtgatctcggctcactgcaagttccgcctcccgggttcacgccattctcctgcctcagcctcccgagtagctgggacgacaggcgcccgccaccacgcccggctaattttgtttttgtatttttagtagtaacggggtttcaccgtattagccagatggtctcgatctcctgacctcgtgatctgcctgcctcgacctcccaaagtgctgggattacaggcgtgagccaccgtgcccggccgactttgtgtttttttatggtggtgagacagtggggtaaaggataggggtccctttcaggcctgctttgaactttccccgtgttaaagaagaaaacatgcaagctttcttatcaacctgcagaaatatggggcaagatgagaagtgaatcctaaaaactgtcaaataaaccattaaaataatgagtcagactgttcattacatttggaatacttgaagatttcttaggtagatcaccaactgcatgaacaacaacaacaaaaaaatgaatagagttgacttcataaaacttaaccacttttgttctccgaaagaaactactaagaaaatacaaatcaagtcacagcctaggattctgtatatttgacctttgtacaaaatatacatatataacttgaaagtaaataataagacaaagtaaagaaataggcaaaatatttaaagtctctttgcaaaataagctatataaatcatcactaatcacatgaaaatatgttcaaacttatttctcatacatgaaatgcaaattagcacatcagtgagatacctctacccattataatagctaaactcataaaattcaatagcaaatattgaagaggatagaaagaaaccagaatacttaaatattgctgacagaaatacaaaatgatacagccactctggcaaacagtttgggagcttttagaaagtttaacatatgcttatagtatggctcatcctacccattcctaggcctttccatatgaaaaaagaaagtataattgctcaaaaagacttgcacactactacttctatcaggcatattcagtaaagtcacatctggaagcaaacatctgtcaaacatctgtcaggaggaaaattcccaactcattgtagcttatctgttcaatgaaatcctactcagcagtaaaaattaaaaaaaaaatctattgacacacataaaatggatgaatcaataaaatagtgtgccactgaaaagaaaccaaacataaaggaatacagattgcattattctaccttatatgccattctagaaaagacaaatttaattcagaaaaacaccaggtgagtagtgcctagtcctaagtctgaatggaaggcggagattgtctgaaaagaaatacaaggaaatttttggtgagatcgaaatttttatgactagattgtggtaattgctcaagtgcataaaattcatcagacattatcaaaatgtttactgaaaatgtgtttattttcacttaacataattacctccagttctatgttgctgcaaatgacaggatttctttcttttctaatgattgaataacattccattgtgtatacataatacattttctttttcagtgtatacattgatgagaactttggttgattccatattttggctattgtgaatagtgctgcaataaatatgggagtgcagatatctctttgaaatactgatttcatttattttggatatatacccagtagtgagattgctggatcatgtggcagttctacctttagtttttgaggacctccatactgttctccacagtggttgtactaatttacattcctaccaaccgtgtatgagggttcccttttctctacatccttcccagcatctgttattgcctgtctttttaaatacaagccattttaactggggtgtaatgatatctcattttggttttgatttgtgattctttgatgattagtgatgttgattattttttaacttacctattggccatttgtgtatcttcttttgagaaatgtatgttcaaatattttacctatttttaaatcagactatctgcattgttttcttttgctatttgagccctttatatattctggttattaatcccatatccaacagatagtttgtaaatattttctcccattctgtgggttattactttacttcttttcttctttgtgcataagattttttagcttgatgtaatcccaattgtctaattttgcttttgttgcctgtgtttttgaggtcttacacaaaaaatatttgtgcagatcaatgtcctgggattttcccccaatgtttttttctagtagttttatcatttttgatcttatgtttaagtctttaatgtatttctttttaatttaacatttattttaagtgcagagtacatgtgcagatttgttctatgggtaaacttgtgtcatgggggtatgttgtacagattatttcatcactcatgtattaagcctggttagtaatcattagttattttttcctgatcctctccctcctcctgtcatccaccctccaataggtcccagtgtgcttcatactcttctatgtgcccatatgttctcatcatttagctcccacttataagtgagaatatgtggtgttcagatttctgttcttgcatctgtttgctaaggatgatggcctccagctccatccatgttcttgcaaaggacacgatctcattcttttttatggctgcatagtatctaactcatgatgtatatctaccacattttctttttccagtctacctttgatgggcatttaggttgactccttatcattgcaattgtgaatagtgctgcaatgaacatatgtgtgcatgtatgtttatgacagaataatttatatttctttgggcatatactcagtaattggattactaagtggaatggtagttctgtttttaggtctttgaggaattaccaaccactgtcttccacaatggttgaactaatttatattcccatcaacagtgtataagcattcctttttctctggaacctcacaagcacctgttatttttttcactgtttattaatagccattctgactggtgtgagatggtatctcattgtgatttaagtttgcatttctcaaataatcactgacattgaacttttttcacatgcttgtttgcttcatgtatgtcttttaaaatatgtctgttcttgtcctctgtccactttttaaagaaattgttttttatcgaaatttgtttaagttccttatagatgctggatattagacacttgccagatatatagtttgacaatattttctcccatcctgtaggttgtgtgttcactctgtagatagtttcttttgctgtgcagaagctctttagttaaattagatcccatttgtcaatttttgcttttgttgcaattgtttttggcaactttgtcataaaatacatgcttgttcctgtgcccaaaatggtattgcctaggttgtcttcaagggtttttatagttttagattttacatttaagtctttaatccatcctgagttgagttttgtatatggtgtaagaaaggggccgactttcaatcttcctcgttttgctaaccagttattctagcaccatttattgaatagggtgtcctttacccattgcttgtttttgtcagccttgtcaaggatcagatagtgctaggtatgtggccgtatttctgagttctctattctgttccattggtctatatgtctgtttttgtagcagtactatgctgctctgtttactgtagccctgtagtatagtttgaagttgggtaatgtgatttctccacacttgttctttttgcttaggattgccttggctattcaggcttcgtatttgtttgtttgtttgtctttttggttccatatgaatttttaattttttttctagtctgtgaagagcatcattggtactttaataagaataatatttaatatataaatatttaatctataaattgctttgggcagtatggccattttaacaacattgattcttcctattcatgagcatggaatgttttcccatttggttgtcattcctttttttcctttgggcagtgttttgtagttctccatgtagagatatttcacctccttggttagctgtattcccagtcatttcattctttttgtggtgattgtgaatgggattgccttcctgatttggctattggctagattgttgttgtagtgtaggaatgctagtgattttgtacattgatttggtatcctgagagtttgttaaagttatttattagctgaaggagatttggggctgagactatggggttttctagacaaagcatcatgtcatctgcaaaccgggatagtttcacttcctcttttccaatttggatgccctttatctctttctgttgcctaattactctgctcaggacttctaatactatgttgaataggagtggtgagagaggatatctttgtcctgtgacaggtttcaagaggaatgctttcagctcttgtccattcattatgatgttggctgtgggcttatcatatatggctcttattattttggggtatgttccttcagtacccagtttgttgagagtttttaacataaagagtgttgaaatttattaaaattcttctccacatctattgagataatcatgtgattttgtctttagttctgtttatgtaatgaatcacatttattgatttgcatatgttgaaccaactttgcatcccagagataaagtctacttgatcatggtagataagatttttgatgtgctgctggattaggtttgccagaatctgaggatgtttgcatcaatattcatcaagggtgtcagtctgaagttttctttttttgttgtatcttggccaggttttggtatcaggaagacgctggtcttatggaatgtgttaaggaagtatttctcctcctcaattttttggaatagtttcagcaggaacggtaccagctcctctttgtacatctggtaaaattcagtagtgaatccatctggtcctggacttttgttggttggtatgctattttttactgattcaattttggagctcattatcggtgtgttcaagattcaacttcttcctggctcagtcttaggaggctggggatgtctgtgtccaggaatttaatcatttattctagattttcaagtttatgttcatagaggcattcataatattgtttgagggttatttgtatttcagttaggtcactggtaatattctctttttcatttctaattgtgtttatctggatctctcttttcttctttattagtctagctggtattctatctgtttcattaatttaaaaaaacaattcctggattagttgatcttttgaatggttttctgtgtctcaatctccttcagttcagctctgatttccggtatttattgtcttctagttttgtgtgtgatgttgtgtgttgtgctttgtgttgtgtgtgatgttaggttgctaaattgagatctttctaactttttgatgttggcattcggtgctataaatttccctcttaatactgcctttgctgtttctcagagattctagtgtcttgtatctttgttctcattagtttcaaataacttcttgatttctgccttaatttcattatgttcccaaaagtcattcaggagcaggttattcaatttccatgtaaacatatggttttgagtgagttcattagtcttgatttataatttgatcacgctgtgatctgaaagattggctgttctgatttcagtacttctgcatttgctgaaggttttacttccaaccacgtgatgaactttatattatgttacatgtggcaatgagaagaatgcatattctgttttgggagtggggagagttccacatatttcaatcaggtccatgtaagatgcagtgctcagttcaggttctgaatatctttgttaattttttgcctcaatgatctaattctgtcagtggggttgtaaagcatctcactattattgtgcaggagtttaagtctctttgaaggtctctaagagcttgctttatgaacataggtgctactgtgttggatgcatatatatttaggatagttaggtgttcttgtagaatttaaccctttatcattatttaatgcccctttttgtcttttttcatatttgttgctctaaagtcacttttgtctgaaactagggtggcaatccctgctttcttctgttttcatttgcttggtagatttttcttcatccctttattttgagactatgtgtgttattgtatgtgagatgagtctcttgaagacagcatacaaagagatcttggttctttatccagcttcccattctgtgccttttaattgggtcatatagctagctcacttacattccaggttggtatggatatgtgtgaatttgatcctgtcatcatgatgttggctggtgattctgccgacttgtttatgtaattgttttatcgtgtcacacgtctatgtacttcagcctgtttttgtagtggctgataatgttctttctttctcatatttatgtgcttccttcaggagctctagtaaggcaggtctggtgctaacaaatgtcctcagcatttacttggctgaaaaggaccttatttttccttcactcttgaagcttagtttggccagatatgaaattctgggttggaattgctttcctctaaaaatgttgaatattggcccccaatctactctggctactgttagtctgatgagcttccctttctaggtggcctgacctttctatctagctgccttgaacactttttctttcattttgaccttggagaatctgaagattatgtgtcttagggttagtcttctcatggagtatcttactggggttctctggattttctgaatttgaatattggtctctctagtttcattgggaaatttctcatggatgatatcctgaagtatgctatccaaattgcttatactctccccttctttttcagggacaccaatgagtcttacatttggtatctttatataattccacatttcccagaagtttcgtgtattcccttatttttttctttattcttttttgcctgtcttatttcagaaagccagtattcaggctctgagattctttcctttgcttcatctattttgctattaatacttgtgattgcattatgaaactcttatagtgtgttttcagctctatcagatcagttacattgttttctataatggttattttgtccttcagcttctacattgttttattatgattcttaacttacttggagtgggtttcaacatacttttacatcttaatgatattcgattatattgatattctgaattctgtttctgttatttcaactataatatggtttggctctgtggacccactcaaacctcatcttgaattgtaatctccacatgtcagaggagggacctggtgagaagtaactgaatcatggacgcagtttcctccatgctgttctcattatactgagtgagttctcacaaaatctgatggtttaaaagtgtttggcagtttccctcccaccatcctctctctcctactgcctgtgaagaaggtggttgcttcccccttgccttccaccatgattgtaagtttcctgaggcctccccagtcacatggaactggaagttgattaaacctctttcctttataaattacccagtctcaggtcattctttatagcattgtaaaaatggactactacaagctatctcagcccagttcagaacacttgctggagaggtagtgtggttgtttggaggaaaaaagatattctgactttctgagttgtcagggttcttggattggttctttctcatcttcgagggcttatgttctttcaatctttgaagttgctgacctttgcatgtttttttcttttttaatcgtatttgacaacattaaggatttgattgtggtataaggtggattcagctgactggctttatttctggaagattttatgggaccaacactcagctcccaactcctggactgtgtgctctaactctagggagcttgtattgggccctgactttgttcactggatcattgaggttaggaatccactgcactgttggaaggtttgggactgagagtctcctagactgctggccactatgctctgatgggtagtgtcagccaaaggatttcatactgtagtgacagtgggatccgtcctcattcgcatgtgccagcagcagtggcaatgcagcagcatgtacacttgttggctatggcagggggccagcaggtgctggggtgcctgcctccatgcagttattcaaaacagtggtggatacaataaatgtggctggattggcagagggaggggagttcctgctggtaactgtgcatggagtcaggtggtgttggcacagggacggtgctgttgggcaagggtggttgctcaggatgggggagggtctgctgttctctgtgcctagtttcactcccatggcagtgttggtacaagggcagggtgctggcaggagcagggttggccggctctgtgcccaccaaggttccaactgccattggttggtagggggaggagggttggcggggagtaaactgcactcctgctgcagcagtggcagggcagcgtgcatgtacacatgcacactggtggagcaagaaaagcaacacacacacacaaagtgatatggagggtttccatgggcccctgggaagctgcagtgtgaggacagagcaggtcagctggtgtgtggccatgagggctgccctgctggagctctctgctggtcaggaatggtctagtagttcagaatctatgatggaggcccccagggaacccaaggctgccctgcatgcaggagtggcaaggctggagccccaggagaggtgtgcagatcaaggaccactcaggctaactgacctcacctatgggcaagaatgccctgcagagttcaggtctgacagtttccctaggactaaagtctcctaagagagcaagttaagcctagggggagggccatcgctggccatgcaccactacagatgttcacacaccaaaccgtttgggttccatatcagcttgcttgctgcccctacaacttctctaagcagctctccctgccaactcgagtgtccatggtggtgcaggggtctcctcctgctggaattctagaggcctgtggcgagagtgggttcctccttgccagttcaattcacccattgtcctggagttgttgggggccaggaacgagtcccagtgtgtggtagccctgtgcagggttcccagcttcctcctccttcagtccaacttctgtgtcttccctctgtccactcttggtgcattccttctgaatatttgttatgagtgcacaagtcatctgggtcctttggtggcagctgtttcacctggctggatctagtggcacctggccatcttgccagatgttaattttaatttgatttttgtacataatgagagataagggtctagtttcattcctttgcatataattatccagtttctccagcaacatttattgaaaatactgttctttctctattgtatgttcttggcatcttgtcagcaatgatttggttgtaaatacatgaatttgtatctcttttccattggcctatgtgtctgtttttatgcaagtacaacaccatttttattactgtatctttgtcatatatttgaagtcaggtaatgtaatgcctacagctttgttctttttgctcaggcctgctttgtctatttggggtattttgtggtttcatataaactttagaattttttttctatttctgtgaagaatgtcaccagtgatttgatagggcttgcattgaatctgtgaattgctttgggttactattgtcattttaacaatattaattcttccaatccataagcattgaatatctttccatttttggtgtgtcctcttttatttctttcatcagagttgtctagtttttcttatacatatcttccacttcttttgttggattaatttctagttattttatattgtttgtagctattataaatgggattgctttcttgatttctttttcaaattgtttgctatttgtatttataaacgctactgatatagaaagacaaatatcacatgttctcactcatatgtggtagctaaaaagtggacttcataaaaatagagtagactggtggttacaaggctgaaagtgaggcaggtgatgaagaaaaaaatgtaaatgtatttatcaccactgaactgtacacttaaatgtggtaaagatggtaaaataaaaataaatgttaaaaatcataaaaagtatatatcttatcatgtgtgaattatagttcattaaagctgattaaagataacatgatctcacataatataatttcatttcattttctataaaacattaactttctaggagaataatgctgcataaatacatttgaaaacattttaaaatgaaataatttatgtatttttatataatcaaaagtaaagaagattattgctatgatgttgtgagtgaagtaattataatgttggtctcaagcttgcatggccacaaaataaccattaatttaaaacagagatggactcaatgtactcacagtttcactctatttctcagagacaagggattttatatctttaagtgttttaaaatcctcatataagttatatttgcttttctagaaaacaaaaatattcaatagacagatttaaatattatctttcttcttcctatgtacttaggccaaataaaaatatactgtatataaatgtaatttttctttagtatagaaagttagaaatatatcataatgcatcctattaatattaaagtgttgtatattttgctgatgactggtagaaaattaatttcatgaacaatatgaacttatgcaaaaattaaacaaaatacaaatgttaatgtgaaaattttgtgtttctgttttagaaaaatataatcataagtccttcacttttttgtaagatattcttaatgatttaagactttagtgtatgattcagcccttttgttcatatatttattttcctttcactcctcatttaactctttcctttcttctgactgataatcagcttttgacagttgataattgaagctatcacatcaaagtgatgcaaaaaacattaattaacactaaaaagccaccgtggcacacatttacctatataacaaacttgcacatcctgcacatgtacccctgaacttaaaataaaagttgaaaaaaaaaccactaaaagaatattcaaagtaaaatacattaaaactcacttctccagtttgacacagacaaccagataggtgttagggtaaaaacaacaacaacaaaaatgggaatggttttccttttcctttctttggtattctagccttggtcatgatccaaaggggcaagtgcattaactataccaaacttgctcttggcctataaaataacttttttcatttctagattatgtgcttggcgagaagtatctccactcataaagttcatgtgtaattgaataaagtatacattttgattaaatgtcactcttatctttgggtatgaggcaattcactgcacctgaagaccataccattattacagtaatgtgagtaagcaccagtatgagcattccaccttctcttttccctctgtggacactgtaggaaatgtaatacactcttgacaactagttctttgtctatttaaaccacaaacccagacattcacacttgcttcagtggcaggcaatttttttttctttaagggaagatttaaggagctatgaacaaatcgtttatcatctcttattaactgcactgccaaacttattttaaatgatatctctgttataagtcccatcattgattttattgcctgcaatcattccaccaacttgccttctaggtctagtaatttgttttggtttttgatttccttttttttatgtttccatagcagaagcttccaaagtaaaggctacagattattattattttttagtttttttattgtgtacacaatgtctggaattttccttagaatatatatggtagtctcttggtatccatgagggattcattccaggagtccttcatggataccaaaaatctgtacatgttcaagtctcatataaaatggcatagtatttgtatattgtctacatacatcctctcacataccttaaattatctccagactacttaaaatgccaaataaaatgtaaatgctgtgtagatggttgtggtaatgtatttaaaattttatattatttcacattttcgtatcttttttaatttatttagttttaaaaatattgtcaatctttaattgggtgaatattcagatgcagaactgtggatatggacgactgaatgtattaacttatatagctgtctattaaaatttattctttacttaggactggtcgttgttatgcaatcttctttgttccttataactagagtcctgccttgaaacctaaaccccttataatccttggcattagcaactagttctcacttttacctaattctccagacttctatatatttgatttttgcttattttctttcaaacatctaaactgaataaatatttcatctatcccctaggaagatagcctctgaatcttatttctatcccacttcttttctagtagatgctgctaaccattctcctttccttaaagatgaagcaaagacatattatgtactccttagaaataaataaaatgaatatattccctaaaaataaatagtatgcttttaaaagcaacactaactcttgcaggtaacttagcaaactaaatcataccttatttgttgtactctttaattttctaaggtctcctacttttccagaagatttacatgtttgatatttatgttagtacttaatgtagacacacattagttcaacaaagtactcatgtttcaaaaagcaatatagtagcctgaacaaatccatataacataaacaatttgttcactatttctcaatcaagaatgccatcctaggaatccaatgaaagaagaaactgtcctgctaaaggcttcaatatagcttcttttccaatccatttgaagaaataatatatactccattaggaataagaccatgtctattatgtaccatatatacactatgtacagcaaatgttatatacatatatcttacatagatagaaatagccaagttcaatgcataatacatgagaatctgtaaattttcagtctttcaaaataatacacatgcttaattgagggtaaggatagcagccccctctattattctcaaaaagaaaggggcattggccaactactcatggatgatgtaaacttgtttttagataaaatagtagagcattgacaacaaattttatctttgtaccataacaaatagcttatgcaacattcatttttaaaaaatgcatcataaactatttcagatatgacagtctttgtgttgcaatttatggaacagtgccagttagcatgtgatctgtccatcatttcctctacttttgaaaatccaaattagattattcaaatgtgcactcaaagagcttacccctggaaaccacttatagacttcacggggtacagaatggcttggttgctgattggttttagcctcaatgaatatcacatcaatgcacagcagtctcctatgactaccaatttgcttccctgtttgatgctaggtattgcctgtggtcactaaagccatatttggtaaagggcttcacttgtttactgattgccctttccttcattagcagtcaaaacaatgaagacagcaaattgcatatttaaaatttaactctcaaacttctcaagtttacaatattatattgaagccactttttttcagactttacatccattcagttatgaaatcactctccacaacacatgatttgtagactcaagccagatgcaatttattttattttattattttatttcatgtttgcagattttttgttaggtagcattacaaacaaaatgctctatttacttttcatcatttaatattttattttaattatacttaactgttaatattttgagtttgttatataggttttggtaacaattttaactttaaaattaaaaaatacttttttaataaacatgaaatccctagtatattggcatgctaattaatgaaacttaaacaactggctttacaaattggctaatggattagtcaactctatggaatcatctaattggtaaattgcaaatttacactaattttctaaatactcaaacttctattttaaaataagaatatcagtcaagttatcatagtcatttttatagattctttaacttaggaataggataattttgggggcattaaattaagtgactgaaattcctatactttaaatgacgttaagtgggacaataagctataagctgtatttcagtgaacagaactgtaactactagtagtgataattgattgtactattattagacaatctgtggattcatacatataacacttattcagttataaatacctaataaggtttatcttttgataggtaactcaaaattattgttagatctaagaaaaatgaattcaaataaatttagttatctacagtgtaaatcttccagaataaaatgctctaagaaatttttaactaaagacaaagtaggtttttcttaatatagaatagaaatggattttaacaatgtagaaaatttgtacaccacagtaatttttctgggagcataaattaatgcaggtcaaaggccaaagacaatgttggtgagttaaaaggcaaaaaggcattcaaagaataattttgaatagtccaattgtatttgccaagctgttactgcctcatgtattaaatttagtttaactagctgtaaattaaggcaatagtatggatttagaaacaacctattaaatatggttctgataagattgcatcttaaaggctggcaatctggggacaactacattttaatatgaatgccattttatgtatttattttttgataggtaacttattgctcaatcttttgtcatttttagtcatgatatttttacactttgctttatcatgtttactcacatagagatttggatagagttagatttgacctctcagttataccaagctgatagattaataataataaaactctgacaattacagagacgatttattatattctaggcattctgctaagtctttaacatgcactattttatcttcacattaaccatttgaaaaaaattgttattttccacatatcagataagaaaactaagcctcagataggttatataatttctacagattcacataatcataaactggccatgtcagaatgtaaacacagttaatttggattccagaaccccaacttttagcgatacagcaacattttttatagtagaataaatgtttaactgcaaagtagtcagccacaaaccgttcagaaaccatcaaatctacaaatggaggaatcttgatgagctactcttccagtctggtagttcatctaatagtttcctttctataatctcagaaacgttgtcacccatttttcaaacaactttctactgaagctcttggtagcttaaaatatagcccattctgtggagaaggagtcacttggattgttcaaaagttatttctcataaggtcattttgggcctgcttgtacctttttcccaagaattctagtttggctcttctactctgacactgaaattttccagtatctcagatccttttaacagtcatattgaatatctaaaatgtactagataggcatttatatgtgtgtgtgcgtgtatgtatatacataattaattaaattataattatttatacacactatgtactatatactactatatacacacattattgtatatacacacattaattaaattacataattataactttatatatctatatatataaacaaaaataaaattctaagccacacaattgactgatggacccccctttaggccaagggtattccaaagtacacctgagaaactagttcaggtcatgatgggaagcacccccaccacccacccccaacatttctcattatatattcttcctttggaattcaggcacaactgaccagcataaatgttaaaacagagatcttaagactgacaaagcagactctttgtagcaataagataccaaattccaatttcattcttgaatagtatctcatgacagatagtaggccctgaaggaagttgaggtattttacttcaaaatatatttcattgatatatattgaaatggcctcacaaagctgtcacttgtgggtaaaatctacattctgtagagaatcccctttccctttcaggtccattcctgatccagagacaattcaccaagagagtttgccaccgttttaggtctgataagaactctgaagcttgctacctggaagcttcatctgcataatcaaaaccttggtctttacaacctcttcttttaaccccacacttctttctactgatttcaggtctttagataataacttaacactttaaatcacttgccaatcagaaaagtctttgaatctacccctgacctatataagctttgagttgtcctgcctttctgaactgaactaatgtataccttacatgtattgattgatgtctgcctgtaacttctgtccccataaaatgtatgaaatcaaactgtacaccaaccaccttaggaacatgttctcagtacttcttggtgttcatggttcacacagtcatctcagaataaatctctttaaatattttacaatatgttacctcatttaactctcaccatatatttatgaagtagatttttgtcatttcctttaaataggccaggagaaattgaataattgcccatagttacagaacaaataaccatggatagtaactatgtcttttgacttcaaattcattttgccctagagaatcaatcttacaaatttacaattcaatggtttttgcttcataatagatgtaattataactctcacttacttttcatttctgtttattctgcccctgttttgttatgaagtgtaggagctctgggttttgtatgctgctttatgtttgcaaataaataaagcaaggcctccctgactcctagactgaaatacacctattcaaataatggttccaatccaactgattccctttcttcttatcttcaaaagaaaaatacagaggtaatatctaggaaaaaatttcatgcaaaatactctaaatataagctcatctttaactagaagttcatttgtgaagacaaagcaaacaacaaatgaaatactgtgaatacataatttagagtgaaagcatttgcagtctaattattgatatcatagtaattatgttgcttgaaaagcatctttaacatatttatttaaactaatattatttgccaatgacccgtgtatttcacgcataaaatggatgacctaatttaactcaattaaagcaacatgaaacattacacgttttaccaatattaattttcacacatcataatttttgttttataattcttaacaattaagataaacagattatatttgtctacaattttttaaatgaaattatttcttcagaatagagtaatgcaatgtcatgtctgattttcagtacaatcttaacaatacattatgtattaaagttttttaaaccctgtgttcactgtctgtaagtatagataaatctcatttaaagagagttaacagctgattcactcagcttccccttccaattgttaggtttgagtcctgtaattagacagcataacagctaaggtacttttttatcagcttgccaaaaagggagttttagttagtgatacattatataatgagaaacctccttcaacaggacttttaaaaagaacttgtacaaatctaaacaattaatcctcctggagcattccaatgaaatcactaataaggcatccagaaatgcaaatacctacataaattgttcctatgtgaatttggagtttgggattatcacatttgtttttgccctatcctggagaacagttagttttgttagtaattatactcttcaagcctttatttgtatgaaagtttgaattcaaaagagatgtgtaaacaaaacatacataaaattattgtagatattttcattatgtgttttcttaatcttgtcagtattttgttgatgaaatactgatacgattatctacttaattaaatgtaattcatttgtatacaactataatgaaacattagaaatttaaaagataataatgagtacaatgcatataaaatgcaaaagttctatgactactttaaagaaccatccatgttaatacacagtcttgtggatatggcagcatacacctccagctaacctttaattttttcattattataacctcatcactgtcttccactaaagagactttgttagacaaaggaaaaagaaaacacatatctggatactataacagtcacctataatcattatttacataatatgaattccacagttcataaaggacatagatttgcaatctaacctttggaagtgtaagtgtcatgtattcctgttaagacatggatccttgatggaagcatagtcatttgctaataggtaggttcttaataaaaattttgaaaaaaggaaataaaatcatattttaagagatatgataatttaaaactttactaaacttaaaatgagtcttcagttaaggggattcattgtataatcaaacaaaatccagaagtcatgaataatttatgctgaaaattataaataaaataaaacctctttaagcattcaggtagtaaaaaatggttatcaatagagaaacaaaaatttagttgaggacaatagtacactttctagagagttttaagcagaaaagattgtgattcaataattttctatccagcagagacctgccatacacagacaaatttgtagaaaatataccacccatgtgttctttcttgagaataaaattaaaatttaaaaatcaacagttattgtggaagtcagtgtggcgattcctcagggatctagaactagaaataccatttgacccagccatcccattactgggtatatacccaaaggattataaatcatgctgctataaagacacatgcacatatatgtttattgaggcactattcacaatagcaaagacttggaaccaacccaaatgtccaacaatgacagatgggattaagaaaatgtggcacatatacaacatggaatactatgcagccataaaaaatgatgagttcatgtcctttgtagggaggacatggatgaagctggaaaccatcactctcagcaaactatcgcaaggacaaaaaaccaaacaccgcatgttctcactcataggtgggaattgaacaatgagaacacatggacacaggaaggggaacatcacacatcagggcctgttgtggggtgtggggagaggggagggatagcattaggagatacacctaacattaaatgacgagttaatgggtgcagcacaccaacatggcacatgtatacatatgtaacaaacctgcacgttgtgctcatgcatcctaaaacttaaagtataacaaaaaaaaaacaacagttaaggctttttcatacttgttaacttagttataaaagtaaatgtctctttaatagtaaatgatacacagtattgatagtaactcagtagattaccatataaaattatatatattttcaaccaaaaaggaaaaaaaagtgaagaaataaataataataatggtgcttaatttcagttttgcatgccctgtgcggtcaggagtcatttctcacttgattgtccttatatttctcctgtccagaacaatttctggcacacagtagaactttaattaatatttgttgagtgaacgcctctaatttggggacaatgaataaatactattttattcttgacattgatgattctagagccatgtacatgaatatacatccatacttaaaggtgaacattggttgatacaaataattttttttgggccaggtgtggtggctcatgcctgtaatcccaacactttgggaggccaaggtgggtggatcacctcagctcaggagttcaagaccaggctggccaacatggcaaaaccccgtctctactaaaaatacaaaaattagccaggcgtggtggtgggcgcctgtaatcccagctactcgggaggctgaggtaggagaatcacttgaacctgggaggtggaggtggcagtgagccaagatcatgccagtgcactccagcctgggcaacagagcaagactccatctcaataaataaataaacaaataaataaataataaaaaatttatttgtatttgaaagcctaatttttaaaaagtcttaaatcagagtctgagatgagaaggcacatgaggcgatatgattagggaactggccaaagtactgtatagacagccaggatggcattgatttttcagagttaagaagagaggaattagatattcaacaggagaaacataagcattttgagaaacattattctcaagttggcagggatccaaggaaagaatagcttcatgagagtctgtgaggactgcaatggctggacaccaggcactacagtccagaggatctcatgatggagtttacatggagggattggatctttcagtaatgcctgatgagtttaaacatacctgttttggaataggtaaggtgttatcagctggggtcaccagaagctgaaatctagggcttaactcatattcttttactgataaaatatttcatattaacgttatggtgtctgtgctcaaagtgtaatacttcttttttttttttttttgagacaagagtcttgctctgtcgcccaggctggagtacagtggcactatcttggctcactgcaagctccacctcccaggttcatgccattctcctgcctcagcctccggagtagctgggactacaggcgcccgccaccacgcctggctaattttttatatttttagtagaggtggggtttcaccgtgttagccaggatggtctcgatcttctgacctcctgatctgcccgcctcggtctcccaaagtactgggattacaggcatgagccactgtgcctggcccaaagtggaatacatttatataaggaaataaatgttttgtttctcataactactgcatatgcataatttaataggttatttcatttttatttatatttttcatatattctaaaaacttttttttaattattattatactttaagttctagggtacatgtgcacaacatgcaggtttgttacatatgtatacatgtgccatgttggtgtgctgcacccattaactcatcatttacattaggtatatctcctaatgctatcccttccccctcccccgaccccactacaggctccggtgtatgacgttccccttcccgtgtccaagtgttctcattgttcaattcccacctatgaatgagaacatgcagtgtttggttttctgtccttgcaatagtttgctgagaatgatggtttccagcttcatccatgtccctacaaaggacatgaactcatcattttttatggctacatagtattccatggtgtacatgtgccacatttcttaatccaatctatcattgatggacatttgggttggttccaagtctttgccattgtgaatagtgccgcaataaacatacgtgtgcatgtgtctttatagcagcatgatttataatcctttgggtatgtacccagtaatgggatggctgggtcaaatggtatttctagttctagatacttgaggaatcgccacactgtcttccacaatggttgaactagtttacactcccaccaacagtgtaaaagtgtttctatttctccacatcctctccagcacctgtttcctgactttttaatgatagccattctaactggtgtgagatggtatctcattgtggttttgatttgcatttctctgatggccagttatgatgagcattttttcatgtatctgttggctgcataaatgtcttcttttgagaagtgtctgttcatatcctttgcccactttttgatgaggttgtttgattttttttcttgtaaatttgtttaagttctttgtagttccagtattagccctttgtcagattggtagattgtaaaaattttctcccattctgtaggttgccttttcattctgatggtagtttcttttgctgtgcagaagctctttagtttaattagatcccatttgtcaatgttggcttttgttgccattgcttttggtgttttagtcatgaagtccttgcccatgcctatgtcctgaatggtaatgcctaggttttcttctagggtttttatggttttaggtctaacatttaagcctttaatccatcttgattaagtgtgactactgaagctaggtatttaaagtcatggtggcttccaccatagcttctgctggatgacttattctggagaaagccagcagccctaaaaacagctcaaaatgttgagagactgaggattcccaaaaacaactaacaatcatttctcaggcaattaaatttgagccatgttgaaagcaggtatagcagcccaggttaagcctcaatgtgactgtatcagggtcaacatcttggatgaaacctcatgagaaattctaagcttggctgggcgcggtggctcatgccggtaattccagcactttgtgaggccgagacatgcagatcacgaggtcaggagtttgagaccagcctggccaatatagtgaaaccctgtctctactaaaaatacaaaaattagctgggcgtggtggcacgagcctgtagtcccagctactcaggaggctgaggcagaagaatctcttgaagccgggaggcggaggttgcagtgagccgagattgcaccactgcactccagcctgagtgacagagtgagactccatctccagaaagagagagagagagagagagagaaattctaagctgaaaccactcagtttgaatttgggaattcatatttttaaattttgaatgattttgagataataaatgttcgttttccttttaagccactgaatttgaggcaacttattaggcagcaataggcaatgaacaaaacatccatctagaggtacacaagggtgggtgaggtatctcaaatatttaagcagtcatatttttacttggcctatccttaccatacatactcaaagcaagattttcagattgaaacaggaaggttgtttcaaagagttgattttgaagacattgttcattgaagttacctatggtaacactaaaggtctaagttaaaggagcccaaacgtaaggttttgtaaagtaagataaatatacaacacctttcctatccttcatgttgttctctatagggagacataatccaatatagactgagaaaagaaatgcttccaacaaagtcttcaattgcaacattattaaatgcactttagctagtgaaaatatgttttagatatcaaaattactttgtataaaatcagactaaatttatgaaagtcaaccagaagtcagagcaacataaaatttgtggactacgatctgttgaaaatctatcaatgactggtaaatacgagatggtagattatgcaaaagttcaaaatactgatttaaaagttcaaaatgatttcacccaaaatggcattgacttgttattgatttaaccaaaagcagtccaaatttacacactaccacatttaaaatttacaaaataagcagctgaaaatggcaaattaaaatgcattaatcaattgcttgacaagtctagattttataactaaagaattatgaaaaactcaaccaagttatacaagtagataattttagaagtgaaattgtattttaagttaaatgttacttagtctaaagctattacaaatgataggaacttaatcacttttattcatttttaatgatttataaaaatgtttcaaccatggatgtcaacattgattcatctccaacctgattttcactcccaccttaagcttcatgtcatctttagctttgtataagcaaatcaatacaggcatgccaaataaattctatttctgtactcacttctggtttaggcttatgtcaggtaccctttccttgtagttcatccaagtatttattaaaatgttcccaatgatgttgataaaggaaagcaaaattaatattctttaacaaaaacatgacatttgagcctttataagtgtctgagaggacttgtcactaactagaacagtggttctcaacctgtggactccgagtgagaagcaccagtaacacctgaaaacatgttacacatgaaaacttgtaggatcccaccttagacatgctgaatctgaaacgctggggaaatagggctcagtgatattttaacaagccctttgtgattctaagacatgctaaagattgaggaacaattagaatgtagaagaaattggactgatattcatgatgtggactatgcacacctatttgcaaaaacaaaacatttcacattcaggaaataagtaggaagaggttctactcagctccaacaacaattcctagttcagaaatacagaatctgttactcaaccaaaataaaaaccaaaccaaaggaagtatccactctaactgtgtagacaccaccatctgaggaactgtgggagagctgtttttctcctaccttagctctcaaccattatgttgtgggccatttaatttttcctacttctttcatggcatttttgtgtgtttttattatttaatacatatcttttcctctcatagtaccttgagagtagtggccatgccttttctttttttgccactgaatgtccagcaactatatcagtacctgatatgctgtagaaacttaataaatatgctaaataagcatggaattaatggattaatgacaaagtgaatgaatgctgcactataaactgtcatgtctgtatcagttttcactggattcttctgaactattattgtaactggcacagggcaagcacataataaatatttggtcaattaataaatttactaatgcatcaaaactattttcccaacttgcgctttgcctttaaacttaaaaacattttaaacttacaaatattttttgattttatatattcaaatatagtttttgtctttttgggggatttctctccataattctaatcattaaagcctcccattaatatattcctaagtctaactagacatatgttacttttattttgctaatccctacttctgtttaaagaaattttattttgtttacttaggattagtcaatgaaataaccaaactgagtgggttctgttttatatgattaagagcgttgatgagtaaatttttcacacacatatacagaagagttcaaaaaggataaaatgataaagaaattacatagcattattagttttatattcctaccttattaatcatatggcaatttttatatttacattaatagtataataatcatatattattaattttatataccttattggaaaattcactaacaaattccacatttctttttttaaaccttgaaacattccagattaacacccagaaaggacagtctctgacagtaaaaatatataaattataaaaatttaaaaaattccttagattattctgtttctcttttttaagacatggtatttagctatctttgagggtttttttaaatagaagtgttggaattacatatctactatgttccaggtatagtactaagtactttttccacaattgcattaatttatatagaaaaattctaacataattttttgcctctttatttttcagaatagaaaactttcagataatgtcagcatttctgtagggaaacattactagtattttacccaagaattatacttaagtctatttgattccaataatacatcagtcaactcttgctgtgcaaaagataatccaaaatctagtgacttaaaacaatgaatctttattattttctacaattctgtggatggctaatggttcttttagtctatgcgtttagctgattcctctggtcaggtggtggctttactggggcctgacagtctgggaggtccttattcacataccacgcagctggcccactctcagccacagtgccacatgttattttctacatggactcctcatcaggggggctcaggctattcacacgatgatataaggatactacattcagctagatagtgagccccatttcagaagctgtttcacacttcagaatcattagttgattctgcttccatatcaactaatgtctcagtggccaaacaagtcacatagccaagcctggattcaaagagaggagaagctttccacaatgcaatttttagaacaagatctgaattgtgtgttttccaaataatctaaactgtacatactttagataaaatcatattcctgcatacatatttgagaagacatctaatattttcatggaaggtgactaaaagtttgattattattttttggaaaacatatacaattgctcagaaatatgtttaatcaattcaattatattttaatactaatttgcaaagcaatatatatgttcttggtggatttatttgtatcctcagtttatttgtgtgtaacattttgatgtttatttctataattatctaatgtttctgaaagttaattttagttggatagtgatcaagaagtagaagccactccaacctcaaaggaatttgttgattaaaacacatggtctatacaaacattttagttactgatcctcaattaacatgctttatctcaagtgtacacaatgtgtttttgctacaattaagtacagtatacatacagttagaatgttgtctattaaatatagcactgcttggccaatcaaatcattgtactgtggaacagggaatggcttgctataaataagaaagaaagacatagcataggattaaagaaaagcagatacaaatgcttatttcctggaacttagaaatatagtaccttagtagtgaattgtagcatgtagtcagggaactaaactgttatactcaatagatacattattcttagagatatgaaatgaaaaaaagataactgagtctgcttttatgttcaccatgcaactctttaaatttaatagtgattgttttatactcactgttaacctacttaacatttttagtcttttattttttataagttagcctccaaaaattctatgtccaaagtgtgccttgaactcagaaacattcataaatatttctcgctatggatctaaagggataaattaggtgatgatcattcaacttacaagtcaatttgttacagtattcctttcaacagccaccctctggcatattaaaatgtaaatcaatttataaatgatgacttaaatgatgacttatacacttgctgagagagtaatgcaacttattgacatgaagattgcttgtaaaagttttcaaatatgaatccatttttctaaaatagatgcaatagcaattagataatatagtacacttttttctaaaatgcttaatatgaaatggtaattttgataacctcaagtagatactatgtcacaaaatatttatttcaaatagaacaaactcagtctatagttcaatataggttgaataattttacataaccacaggctatgtctcttctaaatatagcacatatttgatattacatctcgttgccagattagatgacaagcaatattcaaatcaaaaaatcctcttgtataaacagactgttactatagtgtcagattatgattttcaattaccatatgtttctaaatgtttgtttaggattttagaaacagtgtgcttttttctctcaagcaataaaataaaataagcctttattttggtaatatttgaaagtataaatagtggaaagagaagacaaatgaactttaactctcggcttgatagaagggaattatggtattttggcctagaaaaaaaaacaaaaactgaaattaactcaaaaaaccagtcaggctcacaacaccaaaaaataaaggtagtaagaatactgtcatagaagcaaagttctatttcttttatgaatgtgtcagtgaataacaacactacttgaagctttaaactgctattataaaacattttcaaaagattatattttttcttatcatgatataaaattaccagaaacattttaaaggttatttgctatgtttcctacaattaaattaataaaataaatagatcccaatgctcaaaacgttgacgtttttgaattatggtcatagttctctttcgatcacatctgaactagataattatggaagtgtataaatctgtataactgaattacagactgaaaggccttaagcttgtttatgtattttgctttattctttcatattgtagtatcaaacattcagaaaacaattttcatcattgaccttcagaaactctttactttttctaggattataaagttctatctctatttattactgcattcaaaactgaaatttataaaatgattaaataattatatattattctatatactaaatagccgtcaacataggatatggaagaaaaagaagctcagtttttctattgcatctctgcatggacacttctgaaacttggtaggtgaaaaacttggtaggaaaaaaattttctactgattactgaggataaaatgaaaccatatgtctccaaacatctttaaattcacaaaagacttcctttataggcatcaagtaaaactaaactttgacttaaagttcacaaagttaagcagaggcaaattttaaaaatgcttttggtggaatagtttatagaattaaattttacctgctgtgaaagtgtatttactccaacactttaaaaattgtatttttttctaagctgtaagtacatggacacaaatagaaatacatttatctgaaaatatactgaattgggaagctgaaatgtcataaaacccttctaaaataatgtgtggggatagtcataactgagaaggcatcccccaaaaaacaccactgtctagatgccgcctaaaagcgtcatggtaaaaacagaaatgctaggggaaaatgtaggagaaaaacagagtgggttgagcccatggtgttatttctaaaattttgacttcgaggacattttaaatatattttaataaataaaaagaatttatttattattatggcaacacagatatattatgtaaaaatttttttccagggtaaatcagatagtaaaatttattgattaatgtccatatattgaagttgcttttattttcccatgttttatttttattttgctataagaattttcaccagggttaatgttttctgtaaattttagaataaagtttgacatattaatactttcttttttgcttatgcaaagttttagtaattgtggcctttgccaaagtgaagcttgtttttcttcttcttcctctgcttcctcatcctcttcttctccccttgttttctttcctccccccttcctcttcctgctcttccttttgctcctccttctcttctttctttatcctcttatcttcctttattcttatgaagtccaatatttctaatcatttttagcacatctaaatgtttttaaaaaatataatattcatgtagacaggcatttttgactgtttatctcattgatatcttacctgtgcatctaaaaatgcctggttcatagcatgtactcaaagataccaagagaaattttggttaacacatatgacaatgtccaatttaagcttgtatctgttagatgttatttgctcagaaaattaaataaatatttggtaaattttgtttattacttggaagaaaaagaaaactaatttagagtagagttaaatgatctgaatatacgatgcagtcagaacacaaagtggtggaattaaatcattgggtcaaaacatcatgaattttgctaagtcttgtctgattaggcaaaccaaccacaaaaagagacagacaaacatattccctatttgtgaagatgcaaaatttctggaagttttcagaagacatgaattcactttacagggtaggcatgtttttctgccctaaaagttcctattcaacactttggttggctttttcttgtatttcagatctcagttcaaatgtcaactttgtgagaaatgtattcccattaggttatctgaagaagtcttcccacctccggtaattctgtagctcttaggatcttcagatcatgatacatacatatgcacatgcatatacatgactgtatgtgtattttatagttgtctgtctcccacattagaagctaaattcatggagggtggagaacaggataaccttctgtttattccagttgtatactcaggatcaataggaatatgcatggcaaaaataagtcaaagtaagaaactgaagatatttccttgtgttaaaagatgatccacactgggagggcatttttcttgattttttttaatactgggaaaacatgaggtgctcatttaatatttgagaacttaagatgtccacaatagaataatctctcaaggttaatttatttaatatattccccttaagtgaaaatatgacagttaacatacttcttaaaagttgttctttctctttctcacaattccctttagttaatccccaattcccaatttgctttagcaaattcccgtttacgcaggcttggatacacggaataaattgtgaactatcttaatggtctactgtgtagcatacaaaacaaagggacatcagccagatgaacattttaggcaaaatctaagataaagaatagagtagtgattaagagcacagagcacagagtctgcagacacactgagtttgtttcaaatcccagctcttttcattattgagtgtgtgatttttgagaaatgtacatgattactagctgggccatagtctctttatctgtaaaatgtaataaaaactactcatacatattttgtgaagattagataactcactgtatgtgaagaatttagaactgtgtatagaatgctataatcaatgtgttttatttattatttttaaatatgtaagaaggaaacttctcgaaaaggatggaagaagctaattccaaaggagatttattttgtaacctggctctactgctaactggctttattaattctttcatctgtgaaggcaatacttcctgcctacttcacagggtaatactgcctgcctacttcacagggattttttgagttacaatatggaaaatccttaaaaccagataaggtatatagtagcactctataaaaagtgaactattttattttgttaatgattttaacattgactgtgatgatcttacaaaggtatccaagatatatgccaaaatattaagagtactatcataagatttctggcagctttttaaaaaattgtatacatacttaaaatatattgtatataatttttaaataaataaatacaagaaatattagtgctttttgaacatgaagttcatctgactgccaatgtttcatcagaaagattctataaagttgctcactaatgcatattactatatttctgtcaaaggcatttaattattaagtcatctgaggagtttaattgcttgttatacctattgacttacagttggaaatataatgtgattttctttttaatttgaagatgataatttacagactaggcttttctcattttaggtttaatgatgctttatttcctattggaaagactgttttgtttctcatccccaaacattttaataatgcttctacttagagtgttaaatgaggaatgacaagtttaaactagtattattttgtgggtagctgagtaacgtcagcaagacgcctcagaagagatgcttgatgctcaccaccaccacaaaatgaaccacgacaacccatagacagctaagatttgactggagggagagtgctgaaaacaatgggaaagtggaaacgcacctatggtgattggaagcataggaggacatatggagacacccagcctctgcagacactctcccccacttagattgacccagagtcgggagtgagttcctgttgtggggaaagagaagcagactgataggatttggttctgtgtccccacccaaatctcatcttgaaatgtaatccccacatgtccagggaggaacctgtaatccccacctgtccagggagcaaggtgattggatcatggggcagtttcccccaagctgttttgatgatagtgagtgacttctcatgagatctgatggttttatatggggcttttcccccttcactttccctctctttcctgctgcctcgtgaagaaataggtacttgtttcttcttcaccttctgccatgatcgtaagtttcctggggcttttccagccatgtggaactgtgagtcaattaaacctctttcctttataaactaccctgtctcaggtattctttacagcagtgtgagaatggactaatacacagaggaacctcaccagtcccattgccactccaaacacttacagtctgtactatagggaaatcccacagtccttgaaagccctgaggccactttgaatagctgctgggaattcacacagctgcattgccatgcattagaagcacaaggtggacaatctccacccttcatctactgtgaccaaactgcttcagcacagggtcatctggaaatgagtgccacctctggagtgtgccctgctttgaggccagtaggcactgcacctctccagcactggggcttcattttcattccaccaagtccacaaaggtggcttaacaccacaatatcactgtgctaagcttggcccagtatccgctatgactgtggtcctgcagagcagggaaactaacacccacgatcaacactcccagctggagaaacagtctggcactctcactcagtgcaaacctgcccataagctagccaaaccactgtacacccctccctagtgggaaaagtctctgagttaccaagcagttgacatgcaccctggctggcagcataaatacatgcccacgcctggggcctgacaaatagccctacagccctacattgcttccccactctccatggacatttctctgccgggcccaatgtgggtgcctataatcagggccggggaaacagccgtgcctgtgggtcacccctggcagacatgcccccaggccagctgatcagtcacgtgcccacatctcaagcccaagacagagcaccaattgacactctttaagggaacacacccagggctactgagcagctttgtgcctgtatccaggctagaaaaatagccctagggactgcctttggtgagcatgcccccaggccagccaaatagctatatgccaatgttatcagcctaagaaacaaccctttaaggttcccctggtggtcaagccctgaggctggccaaacagacttatgaccatatcccaggcctgataaacagtcttttgggccagaccgggcaggcacatagccaaggcagccaagcagccttgcacatgtgtcctgggccttagaaacagccctgtggactgttcccagctgacttatctccaggccagactggtagaaacagcctcatgggacatctctggcagacattcctccaggccagccaaacagctgtgtgcccatgttccaggcctcagaaacagtcccatgggctgctcctggttgaaacacccccacattggccaagtagccttgtgcctacatccaaagcctgataaacagccctgtggttcactgccagcagacatgcacgcaggccagctgagtaactaggtggctgtgcccccacccagagtaacagccttatggctctaaccccagtgaaacagaccttatgatggcaaacccactgtgtggacacacgtacccccaacctgagaaacagcctaataaggcaacaccaggcaaagctgcaccaccactgccataaattctctcaacttaggccactgagatgcttgcaaatgtcactagcatggattacatctgaagaaactacacagagattacactattgtgtccaactagaaccaaagccagtgcatcccacctaatggatacaccaagctccacctatacaaataagccttcccctagaaaaccccctccataaagttggaagaggtaactgttttaccagatgtgtaggcacacattaaacattaaaaaaagcaaaaaaaaaaaaaaaaccaaaaaacagacacttctaaaataacaaaaaattatccagtaatagacctcaatcataaggaaaaatacaaaattcaaggaaaagaatttattgtaataatctgaagaacactcactgagacacagaaaaatatagacagaaaattcaacaaaattatgaaaataattcactattatttttattactcacttaacgtaggatattatgttaagtgaagttagtgagaaattgaaagttaatcagtgcatgttcttactcatttgtggaagcaaaaaaggtgatttcctagaagtataaaggagaacagaggataatacaggttaggaagggcaaggggaagaggaagatacagagatttttcaaagaatataaaattatagctacacagaaaaaataagttctagtgttctatgccattgtagattgactacagttaacaataatatatcatataatttcaaatagctaaagggaatatattaaattttctgaacacaaagaaataataaatgtttgagatgaatagttattctaattaccttgatctgatcattatacattatatgtatcaaatatcactatgtacttcataaatatgtacaattattatgtgccaatttaaaaatatacaatcaatacatacaaaataaatagaattaggaaggtagagaatgtgaaaaaataaaaacagttataaattaatgtctgtgaaataagctattaattttctgagggtagctcagtaactcttgtgaagtaaattgcataactatatctctcaattttaatgacttgcatcaaaaatatgttttaggctgatgtaattgtggttttaccattacttttaatgccattattttttaatttgttattacttgtaatggcaaaaccacaattacttttgcaccaagctaatataagtacaagtcacattctagtttgatattagccataatattttttcttagtgatgaagaatacagaaataataatcatttgctttttctagatatcatactacctaggtaagtatttcttaaagtaatttcagagcttgtgtaccggcacataattatcaagcaaatcacttaaggtcaattttatatctaatacatggcaataaagttgcagtccagtcagcaaaaccttggcataacctttattctgttcagaaaattctattaattctaattgttgctggcttaatgaaagtgtgattcaatattctatattgaccttgggccatttctttttaggggtggtcatgtcactagtaaaggtataagagtcatttttaactttaaatatttaaactcacacctactctaaattctaagcaaaagaaaactgaataaacaaaattatcctgaatcaataaagcttcacaataagtttaccctagacttttaaagcccataactaagtaaatccagttttgttcataactacttcttgccaccctcctcactattatgttatcactcccattgaatcagcttcatactgccctagaaacttgttctataatcgtttatctttaaatttgcaccctccaatcatttgttttacctgaaaacatgcttcttcctgatgacaccagtttacctatagcttgcttgaacacatgactacacgttttttctcttcccatatagcacaaagactttaagaatacagtgacataaagctagctctctcaaatgctaaatcattgctattaggcccatttttagaaattgtaattggaagcttgactttcagttgtgccatcctttactacttcactcatctaagcataaatatatgaatacctgcctctgagtttacaaattaattgagaaagtcagaaatttccagaacttcttggtctcctacccatttataaatgcttccaatttataaccatgctttatctcttccttccatttcatcatagaaatagtcctcctatttaatgaaactcatatctcagagaccttatgtttgtttcttccttttttttcatagttttcaacctctctttaccttcaatatgcccaaagttctcctatattaaaaacacacagcacgtaaacacatacacatacatacacacacacacacacacacacacacgtgttcaggcactctcatgtccctttctgttaagtatttacatttctcatatttcttaaaagtcaaaaacacttggtcttcaccactgatctttagttcaccacttgacccactgctgcatgctctctatccctgacatgccactgaaatttctctgaatgaggtcactagtgctctattattaaataaaataaaccatcttcaaaccctgattcacttttaggtacacttgtcattatttgctacttccttctatttgaaattaactcattttttgtctaccatattgcccagctttgctgcttttcactaccatactagtctgtgtatccttttcacaagatcctcttctgtttccccaagatccttcttctgttaattgtggatacttccaggacttccaggtgctcctattttgtcttcaacttacatattattcataagaaagatctcatcaatacatgtagtttcaacaatcactatgttattgcaaccaccaaatcatatcactagactcattttctctttcttactgccagatatctctattaggcctccaactgaaactcaccatttctatattagctttctattgctgctataacaaattgccagaaactctggtttaaaacaacataaatttgttatcttacattttggagatcaggagtctgaaatgagtcttactatgttggaaatctaggtttccacagggctgtattccttctggaagttctagaggagaattcatttctttgctttttcctgcttctggaggtaacccgaattccttagcttatggccccctcctctgtcttcaaagccagcagcataacaactttaaatcttttatttattttctttctctctctgacctgtacttagatagccatattttcatctgacactcctgcctccttttccttttaaggggcttggtgacttaattgggcctatatggataatactagataaacacccccatttcaggatctttaattttatgatctctgcaaagtaccttttggtatttaaagtaacatattcacagttcaggagactggaatggggacatatttagtgtaccatttttctgtataccacagtgtccaaaaaaagacagtaattgtcctgaaatgatactgtattaattttaaagattattgtttcaatcaattagaattaaatacaaatgggacattttatatatgttgggaaaagctgagtattgggagaagctgaggcagggctttcatgtctgacataatgtaaaagagtcttggaacatgtccggggtccagggtctaaaaccctttgtggactttggaacaccaagctctgtgctaaagggtggaaggctaccctgacgcaccataatctaagcccagggcataaaacccctcatggcttggatagaatccagggctcgtggctctggaatggaatccttgctccttgctgtcccaggatcgattgtatcttgagttaaaagaacctgctctccattatctcaagtaacagagcaaatgctaaaccatcacagctgtaaatcatatgcttaatgcagagcgcccttttgacccccacattctcaccacctgtttctttgtttgatcaccaataaatagtctgggcttccagagcttggggccttcgcagcctccacactcatgatggccccctggacctgcttttctctctcaaactgtcttttctgattcctttgactccccctgacttcatcacccccatgacctggtgttgggtctgatcacttcaacaatataaatataaatgggatatttgaactactggaagatatatttcagcggagatatacacgatgcctatgcatgtaatatgtagaactgatattttctcaagtctataattctttttgttacatataaagacaacaaacttgctcttcaagaaattattattgcatttttattattgcatttttaaatgtggatgttgctctgctaaccacttagcgagacttgagtgaccattgttaaataattagactttaaaaatacttaaagatgaggggtaaatataagtaatgtatagtattttttaatgaaggaaggaaggtatgatatagaactgcaagaataaaacttaatatttgttttaagttaaacatttatttataaaaactatagtcttgctttcaagaaacttttcaacatggagacctataacttacttcacatatacttaactaaaatatgttaacaggtgattttacctgttacctgatcttttacatttttgctctaccaaaagagctgcagcaaacaacagcatcctaaagactggaaagatagtcaatgtttagggtttttgtgtaaatattcttccaggattcccttgacattactagatggcatttttactgtttttgttttatctatacccaaaatgaggcttacatatctgaatttttaaaaagccgtaatgcatgcagtaattattgctgatattttttcctttaatatgcattaagtatagggttttagtttgtcataattttaaaatgttaaataaacccattgtttttcttttaagtcactgcatgtactagaaacaatatttatactcttaatgaagatggcattttctgaactacctggccatttcctaatgaatgaatactgcagaaaaataagtaaagctcaactattcagttacaaatgttgcacgttacattaatattataagacctttattatttccaaattttcagttgattttattcgactatttttttaagaagaaagctattatgttgatagataaagagaaaactgaagaaagactcatgaaaatataagaagagtgaaaggaggaaaaaatgtaaaaacatcagttttgagagattcagtaagaatatttccattaatttttaggcaattttcttcattgtttttatagaaataaggtatacacttttgatatttatctatttttgttctctagatatttctcagtaaattatttcatgttaaaaatttggaagttagagtatcttgctataaacattttgtatctaaaagcagcagagttatcctcaggagaaataaataaataataactttgatccatgaatttctgttgaccacaataataaaatatttttgggaaaggcctgcctcacccaccattggtgcctgtacaagtcgcttggggtcctggggttcagccaaccctgccagtcaccagtgatgcctgcagataacatctagtggtctgaggacaagcctgctattcccagaactgctgatacccatgcacattatctgggccctctggataagtatgctccaatgaataccaccaccatggtgcctgaggactggcccacctgatgtccctattcttagaaaagcttcaccaatccttcactaaaaaccacagcctaagtcatgaggaagtcatggacaccactgatgctgattaccaacaaataattatatggagactacataacagtacctgctcagaatcaaagccaaaacactgtagtaaacaaacactataaatatatctgtatgaaaaagtgtttctctaagaaggccaatccattaaattgggaaacagtgactatttcaccattggtatcaacataaggacacaggaacatgaaaaagcaaggaaacatgacaactccaaagaaacataatagtgcttcagtaacagatcctaatggaaaggaaatatatgaattacctgaaaaataataatcatattaaggaaactcagtgagttacaaaagaacacagataaaccatacaaagaaatcagaaaaaaattctaagctgaataaaaaattaaataaagatatagatgtaataaaaagcaaccaaatagaaatcctggaaattaagaatttattaaatgaaaatttaaaaatacaatgaagagctacaacaataaactagatcaatcacaaaaaaattctgaacttgaaaagttttttaataacaccatcagacaaaagaaaataaaagaaagatgaagcctgcttatatgacatatatgacatcataaagtgataaaatatttgagtctgggagtttcagagcgaggagataggcaaaaacatggaaagttcatttaacagaataatagtttaaaaacatttcaagtcttacaagtgatattgatatctacatttatgaagctcaaagattcccaaatagatttaacacaaaaagtaatccccaaagcacattatagtcaaatggagaaaagtcaaggacaaagaaaaagttataataacagcaagagaaaagcatgaagtcacatataaccaagcaaaacacaaacaaacaaaactaaactaaatgtcagccaagcatattttacatagcaaagaaaagccgtccttcaaaaatcaagaagaaataaaatttttcccagacaaacaaaaacagaaaagtcatcatcactaaaccagtcctataggaaatgcataagtgagtcctatatctgaaagttaaatgacagtatctacaattatcaaaacacatggaagtgtaaaactcactcatagagcagatacacaaatgagaaatagaaaggagtcaaacattaccactacagaaaaatatcaaaccatgatgataattagaaagtaacaaaagctacacaaaacaatgagaaaacaattaacaaaataatataaataattctcatttatcagtaataatgtagactgtaaacaaatccaatttttcacttaaaaatataaacagaatggataaaaaacaatgcgccaactacatgtcaactataagaaactcacttcactaaaaataaaagactacagacagtctatgcaattggaaaccaaatgtgagcaggcatacctatatttgtgtcagacagaacagactttaagtcaaaaactgtagaaaaaaaagaaaaagattatcatataataataatggaatcaattcaggaatagaatataatactggagcacccagatatacaaaacaaatattgttagatctaaagggagagagagaatctaatactacaatactcagaacttcaacactcttctctcagcattgaacagattaggtatgcaaaatattaatgcagaaacatcagctttaaactgcattttacaacaaatggatctaacagacatttagagaagatttaattcaacagccacagaagacatattcttattagcacacggaacattctctaggatagaccacatattagtccacaaaaaaacataaagataccaaaatcatatcaaataatcttcccagatcacaatggaatgaaactagaaatcaataacaagaaaaactttaaaaactgtagaaatacatagaaattcaacaacatgctcttgaacaaccaatgggttaatgaagaaattaagatgaaaaaccaaaaccaaaacaaataaaaaatgaaaacacagcataccaaaaacctatggcatatagcaaaagcagtgctcaaagggacttttataagaataaatgcctacatcaaaaaggataaattttaaataaacaatctaatgatgtatctcaaaaaacaagaaaagcaagaacaaaacaaaaccaaaattgttagaaggaaagatttaaaaaatatcagagcaaaactaaattagagaataaagaaacatacaaagaatcagtgaaataaatagttgttgttgttgtgtgtgtgtttttaagataaatgaaaccaagaaacttctagctagactaaccaagaaaataagggagaaggcccaagtaaataaaatcagaaataaagagactttaaatcacagatatcccaagggtcaatagaaactgttatgaacagctacaaactaacaaatgggaagaccaaaagagaaaatggacaagttgctggacacataaaacctaccaagattaaatcagggagaattaaaaaaaaattgaacagataaataataaattacaacattgacaacatcttcaaaaaacaaaattatagtactaaatagcttgataaattgtaccaagcttataaaggagagataacatcaatttttttcagactttgccaacaaattgaagatgagagaattctttctgtctcatctatgaggctggcattaccatgataccaaaactagacaaagatacagtaataaaaatgaaaattacaagccaatgaccctcatgaacatagatgccaaaatcctcaacaaaatactagcaagtttagtccaataacacatcaaaaaaaaatacaccatgatcaagtgaggttggttccacgaattcaaggatggttcaacatacacaaatcaacaaacgtaatatatcacattaataaaggacaaaaccacaaagccatatgaccatctcaatagatgtagacaaaacatttgataaacctcaatattctttcatgataaagtttctgggcaaattcagcatagaagatgcatgcctctacatccaaaaagtcatgtatgacaagcccacagctaatattatactgaactgggaaaagctgaacacattttttataataactggaacaagaaaagaaatcccaatttcaccagttgtattaaacatattacttactgaaagtactattcagagcaattagatcagagaaagaaataaaacataacaaaactggaaaaaaggaagtaaaattgtacttctttgcagaaaacaaaatcttatataaagataaacctgaagactctactaaagaaaacacaaactattagaatggatcagtgaatacagtaaagtttcaggatacaaaaccaacatacaaaaatcagtagcatttctatacaccaataagtagctgaaaaagaaactaaaaaagcactttcatttaaagtagttcaaaaatatgcttatgaataaatttaaccaaggaggtgaaagaaatcagagatacctcatgctcatgaactggaagaatatatattgttaaaaaacatattacacaaaacaatcaacagagtaaatgagatttctgtcaaaatactcatgacatttttatcagaaataaaaaaaattatcctataactcatatggaaccacaaaagaccctgtgatcgttaatactgagtgtcaacttgactgaattgaaggatgcaaagtattgttcctgggtgtgtctgagaggttgttgccaaaggagattaaaatagagtcagtgaactgagagaggcagacccaccctcagtctaatcagctgccagcataattagaataaagcaggcagaagaaggtggaaagagcagacatgctgagttttccagccttcatctttcccccatgctggatgtttcctgcccttgtacatcagactccaagttattcaccttttggactcttgaacttataccagtggttttccaggggctctcaggtcttcagacccagattgaaggctccactcatagtatttctaattttgagattttgggactgaggctggcttgcttgatactcagattgtaggtggcctattgtgggacttcaccttgtgatcctgtgagtcaatgctcctcaataaattccccttcatatatacatctatcctattagatctgtccctctagaaaaccctgactaatacagattttggtaccaggcgtgtttctagagaaaccaacttttaaatatggatttctttagttgctttggcatttctggagttggctgctttatcttactagactccaaaatgctaaggactctacttctaaaagtatagagaacactgatagtcctgggcatgaactgtttagagagttgtgcaaaataaatacacatttgatactcctgattcactgctcttgagaggcaaggagtttagtgactctatacatatacctttcaccacatgtggagaaccaacgaatataatgacattggttggctgctctaagttcactggacaaagtgatgaaagaaaatgaaattctcagggtttctaactctcagcttcagaagcacactctgagcctcaaatcttctaagactgttctgagtgggaattttatctcctgtagacaaaaggctgaaattgcagaaaatcagacacaagctcttatgtgagtggctgtcctgcaaggaaaggtgcactctcagccttgccaggtgtctactgttaaagtgagggcactggttggaaaagaatgggaccctgccacttggaattgggacaggtgggaggatgctgatgatgctgggggcgctgagctcctaaattctgaggaggctttttttgccagaggaaaaagcctcctcactcctagtagtggcaacatcccctcccctacccatgctaccaccagcctttacacctttgtctgaggagattaaccctgatttgtctggggcaaatgacctccccagaggcaatttccaggcaagacaatgctgattctcctcagaacccatccccaacacctctgtttgcttctagacctataactaaagtcctgcaggcccctagaggtgaggttcagagtgtgacccatgaggaggtgcactacactccaaaacaactgcttgagttttctaatttatataagcagaaatctggagaacacccataggaatggatattaagggtgtgggataatggtagaaagaacataaagttgcatcaaattgaatttattgatatgggcctaaccagggattctgcatttaatgttccagctaggggagtttaaaaaggtcctaatagtttatatacttggttggctgaaacatggataaaaagatggcccattttgagtgagctggaaatgcctgatctcccttggtttacagtagagggagggatccaaaggcttagggagattggggtgctggagaggattagtcactttagacctactcatcccaactgggatggtccagaagacatacccttcaccaataccttgtgaaacagatttgtgaggggaacacttgcatccctgaagagttctgtgatttctgttctctgcatgccagatctaacagtgggaaccatagtcactcaattggaaaatttaaatgcaatgggaataattggatcccaaagtggcaggagccaactggtgacactcaactgtcaaaggcaaggtgggcacacttaccctaatggacagcagaggcaaagcagcaatcagaatgtagagctctggcatgggctaattaatcacagtgttcctagaagtgaaattgataagaagcctactgcattcttacagaatttgtataagcagaaaaattccaggttgagtggaccaaagactaatttgaattataaaaatagagaatcatggctcctaaatcaattttcaaacttgaaccagtttacaggcccagaaccttaaataaaggggaggctgggtccccttgaggaaggacccaattacactactgaaaagttattctgttaatctttctcccatccttccccaaggagacctctggtcttttaccagggtaactgtgctttggggataggggaatgatcagaccttttgggaactactggacactggctctaagttattgactccaggggacccaaaaggttattgtggtcctccagttaaagtaggggcttatggaggtcaggtaattaatggagttttagctgaggtctgacttacagtgggtccagtgtgttcctggactcatcctgtggtcatttccccagtgccagaatgcataattggcactgacatacttagcagctggcagaatccccacattggttccctggctggtagagtgaggactattatggtgggaaaggccaaatggaatccagtagagctgcctctacctagaaaaatagtaaatcaaaaatagtatcatatctgtggagagattgaagagattagtgccaccatcaaagacttgaaagatgcaggggtggtgattcccgccatatccccattcaactctcctatttggcctgtgcagaagaaagatgaatcttggagaatgacagtggattatagtaagcttaaccaggtagtaactccaattgcagctgctgtagcagtagtttcatttttgatcaaattaacacattttctggtatgcaaccattgatttggcaaatccctttttttttttctattcctgtctataaagcccaccagaagcaattttccttcagctggcaaggccagcaatataccttcactgttgtacctcaggggtatatcaactctctggctttgtgtcataatcttgtttggagtgaccttggtcattcttcccttccacaagatatcacactggtccattacattgatggcattatgctgattgggtccagtaacaataagtagcaaacacactggacttattggtgatacatttgcatgcaatgggatggaaaataaatccgactaaaattcggggaacttctaccttagtaaaatttctggggatccagtggtgtagggcctgttgagatattccttctaaggtgaaagataagttgctgtatttgcccctcgtacaatcaagaaagattcacaatgcctagtgggcctgtttgaattttggaggcaacacatgcctcatttgtgtgtgttattctggcccatttatccagtgacctgaaaggctgccagttttgagttgggtctagaacaggagaaggctctgcaacaggtccaggctgctgtgcaagctgctctgccacttgggccatatgactcagcagatccaatggttcttgaggtgtcaggggcagagagggatgctgtttgtagcctttggcaggcccccataggtgaattacagcagaggcctctgggattttggaacaaggtcctactatcttctgcagataactactctcttcttgagagacagctcttggcctgttactgcgctttggtagaaactgaacatatgaatatgggtcatcaaagtcaccatgtgacctgaactgcctatcattaagtgggtgctttctgtcccatctagccataaagttgggtgtgcacagcagcatttcatcatcaagttgaagtggtatatatgtgatcaggctcaagcaggtcctgacgtcacaaattacatgaagaagtggctcaaatgcccatggtccccactcctaccaccctgccttctctctcccagcctgcactgatggcctcatgggaagttccctatgatcagttgacagaggaaggaaagactagggcctggtttacagatggttctgcaaggtatgcaggcattacctgaaagtgggcagctgcagcactacagcccatttctaggacatccctgaaggtcagtggcaaagagaagtctttccagtggggagaacttcaagcagtgcacctggttgtgcactttgcatggatggagaaatggccagatgtgtgattatatactgatttatgggctgtacccaatggcgtggctggatgcccagggacttagaaaaagcatgattagagaattggtgacaaataaatttggggaagagggatgtggatggacctctctgagtggtcaaaaactgtgaagacatttgtatcccatgtgagtgctcaccaacagtgacctcagcagaggagaattttaataatcaaatggataggatgacttgttctgtggacaccacttagcctctttcccagccacccttgtcattgcccagtgggcccaagaacaaagtggccatgggggcaggggtagaggttactcatggggtcagcaacatggacttccactcaccaaggctgacctggctacagctaccgctgagtgcccaatttgccagcagcagacagcagcactgagccctcaatatggcaccctatcttggggtgatcagccagctacttggcgacaagttgattatattggatctcttctatcacggaaagggcagcagtttgtcctcacctgaatagacagttacttcggatttgggtttgtctattgtgatggttaatactgagtgtcaacttgattggattgaaggatacaaagtattgattgtgggtgtgtctgtgatggtgttgccaaaggagattaacattttagtcagtgggctgggaaagggagacccacccttaacctgggtgggcacaatctaatccgctgccagcacagctagagtataaaagcaagcagcaaaatatgaaaagagagacttggactggcctcccagcctacatctttctcccgtggtggatgctccctgcccttgaacattggactccaagttcttcagttttggaactcagactggctctccttgctcctcagcctgcagatggcctcttgtgggactttgtgatcatgtgagttaatacttagtaaactcatatacatatatatatatatatatatatatatatatatatatatatatatgtatatgtatatatatgtattatatgtattattgtattatatatgtatatatgtattatatatacataaatgtatataggtatgtatatgtatgtataatacatatatgtatatattatatgtattatatatgtattatatgtatatatacatacatatgtatacaatgtatctgtgtgtgtgtgtatatatatatatatatattccactagttctggccctctagagaaccctaactaatacacctatcctgcaagcaatgtttcttccaagactaccatccatggaatcacagaatgctttatcctccatcatggtatttcacatagcattgactctgaccaaagcaattactttatggctaaagaagtgtggcagtgggctcacgctcatggaattcactggtcttaccatgttccctatcatcctgaagcagctggattaatacaagagtggaatacccttttgaaatcaaattacaatgtcaactaggtaacaatactttgcagggctgtggcaaagtactccaggaggctgtgtgtgttctgaatcagtatccaatatatggtactgtttctcccatagccaggattcacaggtccatgaatcaaggggtagaagtcgaagtgacaccaatcaccatcacccctggtgactcagtagcaatttttttgtttcctgttcctgtgacattacgttctgctggcctagaagtcatgttatcagaggaagaaatgctgacaccaggagacacaacaatgacttcattaaacaggaagttaagattgccacctggccactttgggctcctctcacctctaagtcaataggctaagaaaagagttacagtgttggctaggatgactgacctggattatcaagatgaaatcagtctactactcaacaattaggataaggaagagtatcagtggaatacaggagatcccttagggcatctcttagaattaccatgccctgtgattaaggtcaatgggaaattacaacagcccactccaggcaggactacagatgacccagacacttcagaaatgaagggttgggtcactccaccaggtaaaaaccacgatgtgctgaggtgcttgctgaaggcaatgggaatacagaatgggtagaagaaggtggtcatcaataccagctacaaccacgtgaccagttgcagaaatgaggactgtgattgtcatgagtatttcttccttattttgttaaggacatgtttgtgcatgtacacacttgtacaaggaaaatgtcttcattttatttcctttctttttctgatttattgacttcatatcagcatttcagtgttgttaactttatgtaacagcacttaggttaaagattagtgtgcttctggtcgacaaaggatagctgtattatgttaggtgtaattaagaacttattattctctttatttgaagattatgcttgatgtcaggagatgtatatgggttcacgttgacaaggggtggacttgtgatgatgaatactagttgtcaatttgattggattgaagaatacaaagcattgttcctgggtttgtctgtgagggtgttgccaaaggagattaacatttgagtcagtggactgggagaggcagacccaccctcaatctgagtgggcaccatctaataagctgccagcttgattagaataaagcaggtagaggaaggtggaaagagcagatttgctgagttttctggcctttatctttctcctatactggatgcttctgccctcgaacatcagactccaagttattccccttatgcactcttggacttacactagtggtctgccagaggctcacagactgaaagctgccctgttcgattccctacttttgaggttttgagacacagattggcttccttgctcctcagcttgcagatggcctattgtgggacttcactttgtgatcatgtgagtcaatattccttaaactccccttcatatatatatatatatatatatcctgttagttctctccctctagagaaccctaatacagactctaaatagccaaagcaatcctgaacagaaagaacaaagctcaaagtatcacactacttgacttcagaagatactacaaagctatggtaaccaaaacagcatggtattggtataaaaacagaaacatagactgatgaaaaagcatagagaacttggaaataaatttacgtatatacagacaactgatttttaacaaaggcaccaagaacattcattgggagaaagatgcccttttcaataaactgtgctgggaaaacgggaaatccatatgtggaagaattaacatagaacccaactcctcagcttatacaaaaatcagctcaaaatgaattaaaaactagctgaaaaaaattaaactaaaaaggcgcttccatttaaaatagctcaaaaatatgtacatgaataaatttaaccaaggaggtgaaaaaatgggcggggggaataaaacaaatagaaagacacctttgtttgtgaattagaagaatatatatatatattcttcaggagaatagtctaggcaaaggttttatgactaagacatcagattcatagggtaaaagcctccaaatagaaaaataacactatattatactgaaaacctttgcacagcaaaagaaaacattaaacagattaaagaaacaattggttgaatgggagaaaatatttgcaaagtattcttctgacaaagaactaatatccaaaatttacagggaatttaacatctccacagcagaaaaccaaataaccccattaaaaagttggcaaaggatatccgtagagctttctcaatacaaattgtcaatgggtatatttaaaaagtttgacatcacttatcatcagagaaatgcaaatcaaaaccttgatatgatatcatctctccccagttagaatggctggggaattgtcttttatcaaaaagacaaaaataccccaaattaaatgttggtgaagatgtaaagggaactcttagactctgttgctatgagtgttaattatcacagccattacggaaaaacagtactgatatttctcaaaacactaaaaatagaagtaccaaaaattgggcaattctacttctgggtatttatccaaagaaaagaaaaccagtatatcaaagagatatgtgaagctctatttttattgcagcactatttataatatccaaaatagaaaattaacttacatgactggcaatcgatgaagggattacaaaaacgtggtgtaaacatacacaatggaatactattcagctttaagaaagatagaaatcctactacctaagactatctaagacaatatggatgaacctggagggcattctgttaagtaaaataaacaaagcataaaaagataaatacattatctcacttatatatagaatctaaaaaagttgaactcattgtagcagagagtatgatggtgattattagaagttgagggtgcaagcaaaggctggggaaatgctgaccaaaagtcataaaatttcaatgaaacaggatgaatacattcaagagacctattgtaactaacaatgacaatagttaatacgttgtacaattgaaaatagctaaaagagtagattttatgtgttctcaccacaaaaaagacaagtagtgaagtagtgcatatgtaattagctttaggtcatttgacaatgtatacatatatttaaatgtcatgctgcacaacacaaatatataatatttgtcaattaaaaataaattttaaaaattttacgtattttagacattcagaaaggtatgagagtctcaaatccttttagattcaatttttttgtctaataagacttgttcaaatgtactatttcaaatgtcctaagaatgaacatggaccccgactcctcaccttgtacaaaaatcagctcaaaatgagttaaaaactagctgaaaaattaaactaaaaaagcgcatccatttaaaatggctcaaaaatatgtaatgaataactttaatcaaggaggtgaaaaagtggcgggggaataaaacaaatggaaagacacctatgttggtgaattagaagaatatacatgtatgcttcaggacaatggtctaggcaaatggggttttatgactaagacatcagattcacagggtaaaagccccaaaatattaattcatatacaactacttcaattatagccgtgtccatctattacccccatgttatttacttaatattttcttttaaatttatttatttattcagagacagaatctcactctgtcatccaggctggaatgcagtggcgtgaccttggctcaccgcatcctccaactcctgggtttaagcgattctcatgcctcaaactcccaagtacctggaattacaggtatatgccatcacacccagctaacttttgtattttttagcagagattgggtttccccatattgcccaggctggtttcgaactcctgacctcaagtgatccacccacctcggcttcccaaagtgctgggattacaggagtgagctaccggtgcctgccctcttttaactttaatcactctttcttagctttatttgaataataatacccatttatccttgagttttaatgctcattattttttaatacatttcttctaaaatacttttaatgtagaaatacattttatagtagtgatattttctacactggtatattgaggaaaccagttttggtgtaaacaattaatttactctactgggcataagataatttcaaagatgaatataaaacatgaaagctcttttgtcagcagtatactatatataggaagaaagaggtatacataagtgtgtatatatatatgaaaaaaatgtatatatacacatacactaaaatatgcattaaagaaaaccttgtataggtggcaaaactgaaatttaaagtactgcaattgtttcagtagcattgcttatacagtctttaacaaaatccttaatagagtggaaataaaggggatactctttatgaatacagtatgcgtgagtgtctgtgtgtgtgtatgtgtgtgcacgtgcatatgtgtgtatttatatatgtacatgtggacacatgcattgtatagattataagctttaatcctaccttagcatggataatggagagttaactgtaaaatgttttaattttatctgaataggaaaactcaaagacaatccccacactgctgaatgctaaatgttcttctatgagtttaaggtcaaagacatgaaatgtagattaggcacttagatttctacctgaattttcagaagcccttttaagaaggcagttcacattaaatgcatggttataaatcccatttaaaataactcacttcatgttttattttaggtctagaatttcttttacttttatcaataaaattatgccccttccaacaacttaaagcgataatttgtggtagtttatgatggcatttgaaccacatcttatctttactcatttgaacttagatatgcattggacaaggatggataatttgccatattgctcacatgaaaatggagagaatttcttaacttgaagaattgttttaagattagctttgtgcactggaagagtgtgtgagattaaactaaaaatgggaatacatttcaaaatagtataaacattcttagtttacaaataaaaatatataaatcaacacaaccaggcagtgtctgctcagaaaatacttccacaaattctgggaataaccttcatccccttctttccctcacatcctattccttttgtactcaatcagtcatacaatcctgtggtttctataaccaatatgtctctcaaattctgctttactcccttacaattttattaatatacataaccctgattttatcactccattgctaaaaatcttttaaggatgctattgaaggacacactctttactatcatgtctgcctatctttgtatctgcatcacccacatctagctcacatggatcctatgtctgtgtagacatactgaactacttactcttctctaaatgtgtcctgctgttgcatatgacctttgtatttttatgcacagtcctcttaatctacaataatctttttctaactggtctgcctcaattacacatgattaaacaaaccagctcaaaatctgcccactctgttacatcaacactggctctcccaaccttaatcaggcagtgttctgtcctctttttcacggagcctgaagcacacatcaattatcaaatcatctctctctctctctgtctcactctgcccttctctcttttcttcccttccttcccctttttcctaagaatagcggacaccttgagggcaaggggcttttgtatttcttaatttaaccaatcaaagcatgatttttcaaaattatagatacttgtaactgcatccaatctaggatgttagttttttaaatttgtgtagataaaacatgtctgtttttttttcctccagcgtactttcaaaccctattaaagcaaaggcagtcacctgttacttcgacacctgtttcctttttagtacctaacagtatctcacttgtcagattgttgaaatgtataaagaaaacaacataaatcctgtctcatggtaagtatacaagaaattttagccattttaatatttttgaaataattatttaaggttttacttgtgatcataataacacatgcatttttaaacacagaatacaattagaaaatacgagaggcaattgaactaaaggggttatctgaaagctgtgtattcctctaattgtatctataagaaaattaagacagagaagtaaatgatcctacagttcagtgttataaaagagaaagaaattgagtccattttactgactaatcttttcattttataaactcccacacattcaaaacatgcttactgtttgattttagttagtgacgtaattttgatgctgacatgtaacccatttttattgtacgtgtagaacttccctaccaccaacatcaccaccattaccattctagaatatggctccatgagggcaacaataatgtgaactttctttactattctgtaaagagctccttggcaattagtatgtgttcactaaatgtggtagaagcaatatctgttttaatttaggtgttctggaaaagagttcctcaagtgcatgtttaaattggcttgttagaatttattatataactttctaatagcttgactttgacataattttctctcagaatattagctatcattttcaaattccagaactcattgattgcatattcttctaaagttaatcacatttcataagatacatttccttgaatctgtaacttgaacagatatcttcaaagcaacaaacttgtcttagataaaactcttaagaaactacactgacaccagactttatatactcttacacaaggtacgttgaataatcttggaatagaaactatgctttagagatacttttttttcatttcctaaaaaaaaacctgtatgaaaattagctattttctattcccctacccctctaaatgaccccattttctttctttcttttctcagccataattatggtatggatatctatgcattaggatattgagagaaaaagagagagtatgagttgggatccacctcctcagaaaacttctatcaaagagccttcagttccatattcaagtagggatgacatttttctgctcacagtgtccagtgaaaacttcaagttcatcactttccatattaagatgaaatatttatatttgcagtgtcagcacctgacatagggccccagacatcacagatactcaatagttatttcttcacctgaatattagaatgcattttctaaccctagcaccaatttcctaatttattttacaattaagtaatcctctcaatcttataattatattagttttagtcattatatttggaaccagctggattcttctcttgagcatgttaaaatgtttaagattagtgatgttcatatatggatgcatgattaaatattgtataatatttaataatctagttatttggttcataaacagcaaagtgaatgcaattagcaatgtatgctgcttacttgattaaaaattattcctcatttaagctagtaataactgccttcattgattgagcaatttagtgtgtgccaggcaagtatatttatgaattatttgaatccctactataatatttttattaacctatttatattggtgatgaatttgagcattaaattaattagacaatatgcatgatattaaccccctgatttttatcctaaagttcatatttgattaatgctcttttaccaagttgatacagtgagtatctacatctatcactggctgaaatataccagtatgctaaatcagtaagatcactttctatttcacttcaaaatcaaaaccttaggttttccaggtctatgttacattccctgtaggaacacactcacacacaaaccacatgtacacactataaacataaacacaaataatctctctagactcatctcttctcatttatgccctcattcattcatgtcaccagaattagcttccttgcccttcttcaaaattatttttcttaagccatcccctcaagcatttatcctttgagttacaatccaattgcattctttattttaaaatacacaagttattaatgactgtagtcatcttgttgtgctatcaaacagtcagtcttattcattctttttaatttttggcacccattaaacatccttacttcccatccccaaaccccaatacccttcacagcctctggtaactatccttctgctttctatgttaatgaggtcaattgttttgatttttagatcccacaaataaatgagaacatgtgatatttgtcattctgtgcctggcttattgcaacataatgagctccagttctatccatgttgttgcaaatgattggatctcatttttatggctaaatagtactccattgtgtatatgtatcgtatttttctgatttattcatctgttgatggacacttaggttgcttccaaatcttagctattgtaaacagtgctacaacaaacacaagagtccaggtatctcattgatatgctgatttcctttattttgagtatatacccagcagtgggattgctggataatatagtagctcaatttttagttaattgaggaacctctcaactattctccctagtgattgtattaatttacattcccaccaacaatgcacaatgtccccatttctccaatccttgtcatttgttattgactgttcaatttttatttaattgaggaacctctaaactgttctccatagtgattttactaatttacattcccaccaacaacgtacaatgtccccatttacccacatccttatcatcatttgttattgcctgtttttagatgtaagccattttaactgggatgagatgatatctcattgtagctttgattagcatttctttgatgaccattgatgctaagcatctttttatatgcctgtctgccacttttatgtttccttttgagaaatgtctattcaaatcttttgtatgttttttgattggattattagatttttttcctctaaatttgtttgagcttcttatatattatcattattaatcccttgtcagagaggtagtttgcaaatattttctcccattttgtgggttgtctcttcactttgttgattatatcctttgctgtgcaaaagctttttaatctggtgtgattccatttgttcacgtttgctttggttttcttgtggggtactgctccagaaatctttgcccagaccagtgtcctgagacttcccccagtgttttcatgcagttgtcagatagtttgaggtcttagattttagcctttaatccactttaatttttgtatatggtgagagaaagaagtctagtttcattcttttgcatatggatatcaagtttttccagcaccatttattgaagagactgtcatttccccagtgtatgttcttgccagctttgtcaaaaatgagttcactgtaggtatctggatttgtgtttgagttctctgttctgttccactggtctatgtgtctgtttttatgccagtaccatgctgttttggttactatagatctgtagtataatttgaagtaagttaatgtgattcttccagttttgttcttttttgcgtagaatagctttggctattctgagttttctttacttccatattcattttaggatcttattttctatttctataaagaatatcattggtattttcatagggattgcattgaatctgtagattgttttggatactatggacattgtaacgatattgattcttccaatctatgcaaatggaatatttttctattttttggtgtcctctttatttcatcagtgttttatggttttcattatagagctcttcttttgttatgttaattcctagttatttaattttatgtgtgactattgtgaacaggatttcctttttatttctttttcacattttcactgttggcatatagaaatgctactgatttttgtacaatgattttgtatcctgcaactttactgaatttatccgttctaatagttttcttgtgtagtctttagttttttccaaatataagatcatattatcagcaaataagaataatttaacttatgcctttccaatttggatgttctttaaatatttatcttgtctgattgttctacctaggacttccagtactatgttgaataacagtggttagagtggacatccttgtcatgctccagaacttagaggaaaagctttcagtttttcccctttcagtataatactagttttgggtctgtcgtatatggcttttattatgttaaggtacgttttcttctatatccagctttctgagaatttttatcataaagggacattcttcagcatcaactgaaatggtcatatagtttttaccctttattctgttgatataatgtttcatgttttattagcatatgttcagccatcctcgcattccacagataaatctcacttggtcatgattaatgatctttctaattttgaattttctaatgtttgaattttgttgaattttgtttgctactattttattgaggatttttgcataaatattaatcagatatattgacctgtcattttatttctttttggggagggtgttttaatttttattaagttctcaaaaccactaatacaagtctccaacttatctcttcaaatatgtttttttattcattgtttaagtccaatatatcagattttaaatacttcttcattaaaattattttattatgggtagggtcataagacagctcatacaatggtcacagttctcttgctgtctaaacatgtccgtgtttggcatattgagtaccttttgagggccagccaggaaacctgtaacctgattacctcttataatggtttataagattgttatttctgtggccagtatgtttcattatatcctccaaatggcaagaataggatgaggaggacctatctgtgtggtaagggaggaaaagagagtctgggtccaagatagtcgaataggagggtgaatgctaatgcataggcagaattgctctcacaggccctggaccttgtgcctccctctctccctcctcttcctttctcagaaggacatgtggtgacatcagaaatatagacttcacctaccttctgtattatttatctgtagctacataacaatcatgtgtctttctctggctttggtatcagggtaacactggcctcatagaatgaatttggaagtatttccttctctatttttgggaattgtttaagtaggattggtagtagttctttacatgtttggtagaattcagaagtgaaggcatcaggtcccgggcttttctttgcagggaaactttttattacagctttgaccttgttacttgttattggcctgttcaggttttagatttcttcctgattcaattttagtaggttgtatgtatttagtaacatttattctagatttttcaatttattggcatatagttgctgatattagccactaatgatactttgaatttctgcagtatcagttgtaatgtttcctttttcatttctcattttaatatttggaccttcccttgttttttcttaatctggctaaacgtttgtcaattttgtttaaattttcagaaaactttttgtttcattgatcttttgtattttttatttcatctatttctgctctgatctttatttttttcttctaatgtttttggttttgctttgctgttgcttttctagttatatagtgaccttgtctcttattatagtttttgttttgaaatctattttttctgatataagtatagtgattcctgctttttattggttttcattggcattgaatacattttttcatattttattttcagtctatgtgtgtccttataggtgaagtgtgtttcttgtaggctacagatcaattgtttatataactattcagatagtctatgtttattgatcggagagtctatttacattcaatgttattattgataagtagggactctggtcattttgttattggttttctgattgttttgtggtcttctcttcctcctttcttttcttcctgtcttcctctaatgaaggtgatttttctctggtgatataattcaggtttttgctttttattttttgtgtatccattgtaagtttcttggtttgtggttactataaggcttgcaaatactatcttataagccataattttaacctgatataaatactatttgcataaacaagcaaaaacaaaactaataaaaactctacacctaaattttaagaagttaaaaatgctttttaacttctcattgtttctatttattgtactgagtgcgtcttgaaaagttgttgcggtaattatttttcctgacttatcatttagtctttttacttaggataagagttgtttacacaccatagttacaatgttgtaatagtctgtgtttttctgtgtacttactattagctgtgagtcttgtaccttcaggactcattattgctcattaatgtccctttctttctaattgagtattccctttagcatttcttgtaggacaagtctggtattgatgaaatctagcaggtttgtttgtctggggaagtatttctctttcatgtttgaagaatatttttgccaggtatacgattataggttaaaagatttttccttcagcattttaaatgtgtcatgccattctttcctggcctctaaggtttccactgaaaagactgctgtcaaatgtattgaagccccattatctgttatttgttttctcttgctgcttttaggatcctttcttaatccttgacatttgggagtttgattattaaatgcttgaggtagtcttctttgggccaaatttgcttggtggtctataatcttcttgtacttggatattgatatctttctctaggtttgggattaaaacttatttctacccctagtttacattttctatttttctgcctaagtgctcttaatgataacttgacctctgtaatatctccagtgtaatttctattaatcagtgactgctcaaatttaaatagcaactctcacctacacctctccctatcatacctacatgctatattttctctaggcactttttaaatcatttaacacattttgtctctcttctttgtaatatattccctctctctagattgctagcttgacagggataagaattttctctctttagtctaacactatatctatccctaaggtatagattatagtctggttcatagtaggtactcaattaatggttgtggaatataccaatgaatgaaataataatgcatgaaaaaatgcctgaaatccataataaatttgacagaaacatttatcagcacagaattgattatagctataatctacataattaactaaaattatgtccgatagtcacacaggcttaaacttaaattcatccttgctcacttatttactatgtgatgggtgtaattagcactttcttcaaaccttgcatcttttaatgtaaaatgttaataatttcttcatagccttattttcggtattgaataagaagacatataccagttaataacactttcttccattttcttctctatatgctgtaggataagataaacatacatgaaggtaaagtgaaagtgtaatttatctttcaaaccagaactcatttaagagcaaaaaagggtaatatttataattatattgggacaacagatgtacatcaggtctgtcacaagtaaaccagaacgtatggttagcctacctaataagcacacacaaattcagatattgaaaagaattaaaagcataccagtgtgctggcatagtgggttggcacttagtatcatttgcatcattttcagaggttgggtatctaaaaacatttctcaagacgcccttgcacaagttttcttagtattaattaggtttttccagtgtaatgcttaatatgagattcagagggtataagcataggaaagggcatacttcctttgctttagctgttgctgcagacaagtacagtgatgttgagattttctataacagagactaatgtctagccactaccttagtggttgttgagagacagttttgatagtggtgtcttccttgtgcctagataatagccacagtggtattttattaaagtccgaaaaagacagcagctcactggcaagccagttcttcatggagtgattctgaatattaggccaaaagaccttcaagtgatttgtaagcatttgcattcccatattaaatgcttgctgctagggatggtactgtttcctgcagctgagagttaacgaacatacaagatatactaacagagcctcctaattcacagcactgcttctccacttagtgctaatatgatcttttcataagtgagtgagtagtcttggccagtctgcttaaacagcatactaacaaattttgaaatacatcttcattttagtcaagaatatagaagaactatcactctttctaattggttgcttctctggaagttttatcttaaatatgtctgttatggatcaatatttctgggataagttttcttggattgcatggaaaagccacacatgttcactaacactcttatctaatctcagttcttctgatagtgaaaatacataaccacaaattaagtcaagtttttaacaattaaggaatgtgctgtgctgtctagataaaactatgctcaccttttatgattaatctttaattagtagttgacttaggttaacatctgctggcttcctcttttattaataagcaaagatacagtccgtgtcttatagattttctgggatattctggtgtaagtatctatgataagtacaagtttttgacttcattcacaagtttttgggttggcataatgcacatgagttaaggcattcttgtaaaagagtataaatgcattagtatttatttttctgaagcttcctagaaagcattattattaatgatagtacaagatgatcatgtatatacaaagaccaatgcaatcttttcagatgtttgtgttgagacaattgttgcatctgctgataacaacaacaaagtcttcaggagactgtttataatttttttagaatgttataactttgaatgtgaaatgatgagtacctccttttaataattcaatattagagtaaaatattttagccttaggtgaagctgagtcaatgagaacttacatggagtatgtttagacctcacagtcagaagaacaaagctgtttagagccaatttgtttgcttgaaattgaatgaaatccaattatgcctacactgtgataataaatatgtaaaattcatgaatgcaaatgggtaacagttggaagggaacagaagtgttactgtagttgatttgatagtttagtaggatttggaatattttaattttactttcaggttattggtatgataaacacatagaaatataatgaattaaatttctgtctagcattttatcccacaatttatcatggtgatatctgaatctgatacacagtctggtcaagtatcctggtgatattgaataggctggttcaattatgcttaaattagaaatggagaagtagagtcccaaggacattgggacttatgtcgaccaagtgactcccagactgtatccagtaatggcaataaaggaatgaatctaaccctgtcaacattcaaactccttcgggttaaccaaacaaatcaagatgaggtatttaagaatataattttcttacagtaaagactacataaataaataaaacatcactactttacccagcatataaacacagataagaaaatggcacaaactgggaaataatataaaagagaaaataaggacagtaaaattatattatattgcctccggcttacacaaactattttaaggatgcaatgacctctttcacataaaattttagaaaattaaaatcagaatattttctctgaaagaagttttcagaaagtttgtgtgttaaatagctttacgccttcaggactacatatttcacatgaaacactaagaaagcagaaaacaaagtaaaagacccctagggatttcaaatctcacagatttactttaaaatgttttttgaggaaatgagtttcctacaaagggacattcaggctatcaaaatatctactgaaaagaaagtgaatgaaatattcaatgacttttctcaaaataacaaaagtaataaagaaaaccattagcaacagtaacctattttaaaggcaaaagtcctttcagacttagtgctttatttttcctctctatatttcagtggcattatctgccaacaaataactgaactctatttatcagggtcaacacatctgctaataaataccaacattagctttcaagccttgcatttccaagtttaatactgtatttaaatggtaccacaaagtttaactattcctttattccattttgaaaatataaataaactatatgtatcactgccattacagcttatttaagcagtcttctggtgaaaatatattctatacataatgagttcaataatccttcattaatagtttaaaatgtcaaaaatgaaaattaaattaaaattatttgcataaaattgtaaactgtccttcagtgtgggaaatatattttaaagtatttattgtatccctagaaaaagaatctttcttaacgttttgcaatcttgaatattgggaaatcttttaaaaattatttggcagctaaattttagactgtctcttcctttaccttatactactaataaaataagttactatgatacatttaatgtatattattttgacatatttaaaaatacaagtcaaacattatcagaagataattggctcatagataaggaataacaaggacgatatataaaagtcaaatattttataaaatttttatcagtgagttttatcagtgagtttaaaactcactgataattcagtgaatatccacatatacattgagtgctatgtatatttcaaacactgtgaaacacaaatgagagatacagaaataaagttttgcctattagaaaaatagatttttaaaagatagcgctacattgatgagttcatagagaatttaggatgtctcaaacaaaattaatttataaaataatataatatttttaatgggatttggtcatattatcaaacattaaaattatgtcctcattgatgccacagtctctaaggaattcttcctgtgaagttaattacaagttttcctaagaaaacaataatatatgaatatattattctgtaatttgctcttttaacttaacaatatatgttgctcaacctaaatatttacatttgatcccagagtattgacttaccagaatttaatatttcttttacctattttgtatttcaaataaagtataataaaaatccttttagcacagtatttctatgtgattaaacttcaatttctattggatcaaggcctagaaaataagttgctcattcaatgcgtatatatactttaatgtttaaagatgctgctaaacgaatttcacaaagttttgagtgaagtccaattttattggaaaggttatgattgcaacactgaatatcatcaatctcagatttctgtcaacttgattgtttaaatagatttcattatttcaatcatcatgtccacgatggcttgtgaagtggagctattttcattgatagtcatttgcattttctcttcattttattaacatatatgtttttatgtaaagcagcaatattaacttcttatctgttaaatatctcatatagcaggttgagccatgtgtatttgtcaattagtgaaaatttttgttctacatgaatgacattagagtatggttcaaccattattttatctcagtctattatttgttatttgaattgcttatcacttctttaaaaactaaaattttaatttaatgtaatttgtactgtacctatattcctttatgttatacttaaatattatagttttatagctttgtacatagcataaaatgggactctcctttctttccaagtaatagctgcttttagtatttcaaaattaattcattattaataaatttccacttatttgtaggactggaaaaatgattccaaactaaaattcctacagcctttcagagttaatgtaacagtttaattattgtttaattatgtgtaatgcattgaactagacattctttttgtctatgactcctaaataacgtgaaatgtaaaatgatcaaaatgaatttaaattttacaaaatgatactataaaaacatattacattaattaaaaatgaaaaattttgcctaaaggtaaaatgctatttgcaatgggaaaatgttattgatggctataatttcttatgagattgacatattaataatttaatgaaccatgtgatgacttgaagttctcagcctttttggcttctgaaacctttgctgtctacaggatattgtattatcacttgtcttcatttttctttaaggcatcatgaagactatctccatactttcccaaataggctccatgttttattttttttaattttttttttaatttttctttttttttttcattcccccactttattgaaacaattttcactcaacagatgacaggctgcagcttgaggaagagctgatcaccttttaactgaaggtgatgattatgactaatactttttaagccctttcatgcaacatacatcttcttgaatttctcacaacactacaaggtaggcactttttttttccctttttttaattattattattatactttaagttttagggtacatgtgcacaatgtgcaggttagttacataggtatacatgtgccatgctggtgtgctgcacccattaactcctcatttagcattaggtatatctcctaaagctatccctcccccctccccccaccccacaacagtccccagagtgtgatgttccccttcctgtgtccatgtgttctcattgtttaattcccacctatgagtgagaatatgtggtgtttggttttttgttcttgcgatagtttactgagaacaatgatttccaatttcatctatgtacctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtatctttatagcagcatgatttatagtcctttgggtatatatccagtaatgggatggcagggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttttcatgtgttgtttggctgcataaatgtcttcttttgagaagtgcctgtttatatccttcgcccactttttgatggggttgtttgttttttttcttgtaaatttgttggagttcattgtagattctggatattagccctttgtcagatgagtaggttgcgaaaattttctcccattttgtgggttgcctgttcactctgagggtagtttcttttgctgtgcagaagctctttagtttaattagatctcatttgtcaatgttggcttttgttgccattgcttttggtgttttagtcatgaagtccttgtccatgcctatgtcctgaatggtattgcctaggttttcttttagggtttttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgaggactctgttctgttccattgatctatatctctgttttagtaccagtaccatgctgttttggttactgtagccttgtagtatagtttgaagtcaggtagtgtgatgcctccagctttgttcttttggcttaggattgacttggcaatgcggactgtttggttccatatgaactttaaagttgttttttccaattctgtgaagaaagtcattggtagcttgatggggatggcattgaatctataaattaccttgggcagtatggccattttcacgatattcattcttcctacccatgagcatggaatgttcttccatttgtttgtcctcttttatttccttgagcagtggtttgtagttctccttgaagaggtccttcatgtcccttgtaaggtggattcctaggtattttattctctttgaagcaattgtgaatgggagttcactcatgatttggctctctgtttgtctcttattggtgtataagaatgcttgtggtttttgtacattgattttgtatcctgagactttgctgaagttgcttatcagctttaggagattttgggctgagacaatggggttttctagatatacaatcatgtcatgtgcaaacagggacaatttgacttcctcttttcctaattgaataccctttatttccttctcctgactgattgccctggccagaacttccaacactatgttgaataggagtggtgagagagggcatccctgtcttgtgccagttttcaaagggaatccttccagtttgtgcccattcagtatgatattggctgtgggtctgtcatagacagctcttactattttgagatacgtcccatcaatacctaatttattgagagtttttagcatgaagcattgttgaattttgtcaaaggccttttctgcatctattgagaggaagatctaccaagcaaatggaaaacaaaaaaaggcaggatttgcaatcctagtctctgataaaacagactttaaaccaaaaaagatcaaaagagacaaagaaggccattacataatggtaaaggaatcaattcaacaagaagagctaactatcctaaatatatatgcacccaatacaggagcacccagattcataaagcaagtcctgagtgacctacaaagagacttagactaacacacattaataatgggagactttaacaccccactgtcaacattagacagatcaacaagacagaaagttaacaaggacacccaggaattgaactcagctcggcaccaagtggacctaatagacatctacagaactctccaccccaaatcaacagaatatagattttttcagcaccacaccacacctattccaaaactgaccacatacttggaagtaaagctctcctcagtaaatgtaaaagaacagaaattataacaaactgtctctcagaccgcagtgcaatcaaactagaactcaggattaagaaactcactcaaaaccgctcaactacatggaagctgaacaacctgctcctgaatgactactgggtacataacgaaatgaaggcagaaataaagatgttctttgaaaccaacgagaacaaagacacaacataccagaatctctgggacacattcaaagcagtgagtagagggaaatttatagcactaaatgcccacaagagaaagcagaaaagatccaaaattgacaccctaacgtcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttctgaaaggatcaacaaaattgatagaccgctggcaagactaataaagaaaaaaagagagaaaaatcaaatagacgcaataaaaaatgataaaggggatatcaccaccaatcccacagaaatacaaactaccatcagagattactacaaacacctctacgcaaataaactagaaaatctagaagaaatggataaattccttgacacatacactctcccaagactaaaccaggaagaagttgaatctctgaattgaccaataacaggagctgaaattgtggcaataatcaataccttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgacgcaaaaaatcctcaataaaatactggcaaaccgaatccagcagcacatcaaaaagcttatccaccatgatcaagtgggcttcatccctgggatgcaaggctggttcaatatacgcaaatcactaagtgtactccagcatataaacagaacccaagacaaaaaccacatgattatctcaataggctccatgttttaaagcaatattacttggaagtaaaatgttcccaagcacaaacaaaagcacaaggcctaaatcagatggctatccaatgattcaaaatatgcttctgcgtttcattattcaaattaaaacaatacaaaatacaaaatgtaaacattattgtagagaacttctagaagcataaaattaagtccagggaacacttcgtaggatgctgatggatgcacctctctctgtttccctttaacaaagggagaggagtacagctgtgtgaattaaaacaaaacaaaacaaaacaaaacagtaaaaacagaatacatgcatttcacaccagtaaaatgtagatacttccctaggtgctctacagccgcgattctctaataaaccctgtgtatgaacattaatcatgaccatttaccaaggatgaaattgaagctcagagaaattttaagaatttccctgaaccacacaattattaggcatgagacttagttttcatacctaagtgtgtctctttcaaagcccctgtctttctgctttcaaccctgaagcaataactttcagctgagtgtctgctatttaactggttcctgctcactacatatggcttcatttcactgctcttatatttgctgaaaaatgttagaaaaggcaaacaacttattgacaaaatgagcctatggcagtcaatttaattccaaagctctttcaaaaccctgccagtaatcttagctgctgtttcttgtatacatatggctccctattttcaaaaaatatattaaaaacatattttgtcataattaacagcaatgtgattatgcagatggcttaagcttacacaggcatacaacaaaatgacataaatacagaaacaaaaaaaaattgagagatcagactggaatgtttaattccctgaattttaacctagattgaattcagtggtactttcagcagaactccctcctgctttacacctgaaagcagatggaggcagattgcattatgagttcagtcctttcaaattacaatagtttatgatgctcatctgcattttaatcagatacaaatgatttattcctgaaatgcatcaagaaggcctattttcagcacttggaaatgcatcagaaagtttatggccaatcaagtaaaatatggtgcatattttaactttatatctatttcttgggagtatatgttacatggacagaggtgtcagctgttttattagtagctgtgcataatcctttcaaaatagggatggagaggtggtttcatactcaaaaattatttttattagaattaactcattttaaaaggagttgggttttgtcattcaatttaataatcatttacctaaaatgttagtcttaataacaaagtagttagcaaatagtaacttccatctactatagcctccttaagatcaaataggacttgatcagcatacatccagtccctggaaattaagtagggcatcagatctatgatattaatagaataagtgaggagattttaatgttactatttagaggatactatttattcacttttaaaatttatggcaattatgaaattaaatcattttcaatgtaatacctctgccatattgaataaaatacattttagttttccacctagtatttgaatgattacaaattttgcaatctgctttgttattttttaattgatttttacatactaactaaaagggatataaaatgtaataaattactaaggtcccaaaacaaatatcaaaattaaagagaatacttaagaactcattatgttgaaaagtatgtttttatgaagatgatatatttaaactaatacacataaacttgtaatatttatacctttagttcaatacattttaagcaatagatatacaaatgttccagaatttaaatcatcccaggttattaatatattaccttttgcaaatttaattatataaaagcattaattattcaaatgaaattcaaagaatcatctcattttttctggtgatccaaattgtttacttatctatagtttctcaaatggtaaattactatattacctttttacctgtttagatgtttactgatctattgttaaaaaccagcaaagacaaaatgttgtcagcaaattaatagtatcttatttctggaaaaaattatgaagtctttgttatttaagtctttcattaaataagtgtacatattttaaaaatgaaattgtattcatcaatttatagtagcatggaaaagacatggcagaaattcagttcttaaggaatcttaagttaggaagcaaattaataccatttcattttgtaactaaaggtctaatatttattttatcagaagttgattgaaccaaatcaagtatggacttggctctttgtagaaaatacaacatagaagatatcattagtgtgatggaagcagctgtgatagaacataatccatatattttgattagaagacatgaatttctttctactttatctacttactgtgtgattttgaacacgtcatttggccccattgagactcagtactagaatgagtattatctttttcttcaaaaacggctgtgaaaatttacttatataatttatataaaagtgttatcaaactgtataattggtaaaaacgttaagtttcacattttttaaaaaaaagtatcatcaaattccaaagtctctgtacatcttccagaatccacttcctataggtttctaatcagatttgtcaatgcgaggcacatgcccaattttaggcggctgaaagggatataccattaaatctgtagggagaggcagctttagctaggtgtatgtgcagaggtgaaattcccagctagtgaaccactctagtgagtcactggcctctattctttagactggggtcttttgcttatgatacctccaagtttaactaatctctccatggtttttgcttctctaaattttccaattattgtgtagtctctttttacctgatattaaatattttcacctaaatatgtattgaatgacttctgttctcctagccaaacccttaatgatatatcaacatttacctttattgtctatatcaactgttggattgaaaagttgcatagcagtcatttgtgaacacaaagtaatcagtagtatcaagaggtttttggttatataatatcatacttaatattggcactgtttataaacttttcactttgaagctatcttttgccttgtcttcctttaattctcaacatttgtacttttttttttctttctagattgtgtttctctggtttccttgattttttataggaagttgtccatttcaccaaagttgtataacttactgacatacaattgttcataatatttatttgtaaaataatctcatgtatttcaggaagttcagagcaatgtcccttcttttatttatgattctaggaatttaagtattttttttttggtcaaggtagctaaatgttgattttgttaattgtttcaaagaatcagcttttggtttcattgattttctctactgtttttccattgtctatttcattaatttctgctctaattttcaatattttctactctctgctagctttaggattaatttgctctttttttccaatgccaagggttgaagtttaggttgtggatttgagatccttctttttcaatatatgcatctgcagctataaatttccctctaagcactgctgtagcttcattccataaattttggtatgatgtgacttcatttttattcatttcaaaacattttctaattcccctggtgatttcttctttgaatcattccttacttagcatgatgtttaacttccatatacttgtaagtttcctatattgatttctaatttcattttatgattattggaaaatgcactttttattatttctattcttttaaatagactgagatttttttcggctgcatatttgtctaccctagtgttgggtgaggtactccacagatttccattaaatgtagttggtagggatttagagtctctgttctacgtcatgcttctccaggcaaaatctctgaaccatacctctggtggtgggagtagagacaatgtcatgcttttctcatggtgacacctccactttaggaactgaaaatctgatagataacgaaggcagcagccccaagattcctcggcttgcttctcctagcatggaacctctgccacaaaagccaggacaatggcggttagggttccagtatactccgcagtactgtgtccaaggtagatcgtctgcctcttaagtagggagtgagaagaacaacggtgcttccactattgaactgttttcaccaggaactcagcttcagcgatatgtagctaggagtagtgtgagaattgctgatatcttaccctcctgaaagaatacttctctgactgggaacttgagggaaagggaactccatatagtgtctgtatcagtctggagtgcaattttcatttcactaagctgggaggagttgtttatcaattttagtatatttaaaaaaataagtgtttcttcatttactgtatgttctcagggccattgacttgaaatggtggttattttataatactcaccagtttcgctgggagtgaatccctagagctcctcaggctatcatgctaaaagtggaattctcctttcttgacttttaaaatccacttgttacaaaatacattatgtttttatattaggtaaattctaagaaaaactgctgagaagaacagtacattcccattattttgctaccgttcaaggagagaaattatttcgccaattaaattcaatggggtttatttgagcaattaaaagcaaaatggaacaaaataaaaatgattcatgaagcagaccactctcagatccaaatcaggttcagagaactccagctaactatgtgacctgacagcatttatagaaaacataactgagacatagagacaactaaattggttacaacaaaattggttatttggttacagagcttcctgcaattacctaaagctcagctactgtgattaaactttatattggtttggtctgttgggtccagtgcaggagcccagtctaaatctgtggcctcctgtaaattttatttaactctactgtctaactttgttctacacacacggtcctcagagccccgtattatggggtcatcattaaggttatttccttatgatttagtacattctattccagtgcttctcaaagattaggtatgcacaacaaactttaagatcttgttaaaataggttctaatttagggagtcatgctgggcctaagattgttatatttttactaatctccatgtgacactgatgctgctggtctgtggattactctttaagtagcaaggtttggttcatccttaaaaacctaaataaccgttcttttaaaactgatcatctattggccaggttcggtggctcatgcctgtaatcccagcactttgggaggataacctgaggtcaggagttcgagaccagcctggccaacatgctgaaacaccatctctactaaaaatacaaaaattagcaggatgtggtggcacacgcctgtagtcccagctactcgggaggctgaggcaggagaatcgcttgaatccgtgaggcggaggttgcagtgagcagagattgtaccactgcactccagcctgggtgacagagtgaaactctgtctcaaaaaaaaaaaaaaaatcaactattaaataaacccattctaaagtatatatcatcattctttgaccaaacatcagtctatgatagactgcatattaagaattttacatccttgtaacttactgtatggccatcaaatattttgattattactcctggttaaatgaataacaagtattttaacaaagactgtgattctgctttgatcaaattttttgagccttttaacatttttgacaaacatccttaaaatcaaattctaaattaagtttctgacttagacttattggtgggccttattaaagctacacaattagtcaccacaaagttataaaatatttttacagcttccggtcagaccatgaactccagtatcaccacctccagtctaacagttacatatactgggagaggcatcagttaaatgactcttcccaccccgtccccccttgaaagggtcccttatcagacgctattaactaatccttgtactattaatttacagggctttgactcctggatacatatatctcatctaaaacaagtaccaactcttttttttttaattattatactttaagttctagggtacatgtgcacaacgtgcaggtttgttacatttattaacttttttatgttttataattatgagataaataaaatcacggattaaaataaataaataaataaataaataaaacaagtaccaactcttgctcaatcatgaatgttgacaccagtatctgacatcaaactcaagttaaccaaagcctcatcttcagacccagaaaaaggtgacaatcaaaataaactgcttttgtgaaacacagggccagaaattaaaactattcaatccctttaggcccggggactatcgttaaagagatggccacgtgaaattgtaaggccaggtttgagggatagaattagttcagatcctccaaaaaagatgggctcacagatgcctaagagccgatggcccaacacatagaacttatagataaatcggttttgtaagcttactttttggcttttggtttgtggctcttatattgctcaaaaggtttttaaggaataatgaatgccttcccacctccattcccttttgtcctagaatgtttaattggctgtaagtcttttggctataagtcccttggctatatgggtcccattgaagaacagaatatatctgagatagatagccacaccacctggtaataatatggaatgaaataagagcttggctattgatgctacttttggcatattttgaccaaaatgggggaatgtgaattaaagatgataaatcctaagccctctactgaactgactgaacagatccccttgtggcttagaggccccaaaaaagcttaaaactaaattcctgaccataacagcatggaaagtcatacaaacttcttcttttagggtctagacacaactgagcatcattaatgttaaaacagatatcataagatggacagaacagactctttgtggcaataagatcttacaaacaccataaagttttcagtttattttaaaactactcttaaaattttggctcatgattctgacaacaggaattctaatctatacagtggacagcagtcctaatatattcatgctacatgcctgaaatcctggaccaggaactggtaaatacttgtaggttactgcccggcagtttcattcctgtaattctgactcttaccctaactcttgtccttgccagcaagaaaaagctagagtgctcttcacccaattcccaccatattagctcttgcctccagattgacatatgataaagcccagggggaaccgaaaccatccctgtaaactttataaaattaatcagggaaaaaggaagagggagaaatgaaaataaaccaagcttgcagctcatgcagcattaatcattaggccaggttgttgtctgactggatttcccacagttgtgttgtccctattgcctcagaatcatgtagactctgttaaaagattatagttctctttaacttttgtatagataataatttgaacattacataatgttaagtttttcctttctgatgttctttcaggtcctgcatactgatgaaactactgactcagctggtttgaacaatccccacagatgccagctgatctgaaggaccacacaggagctgacttaccaaagagtacagtctctatatcctgatgatttcatcccctattcccctctcaatcaatcaccccaatttcccagcccccttccatccacaatccctttaaaaagtcctgtgggagatggatttgagggacttctcccacctcctcccttggcaccctgtgataactaaactcttcctctgctgcaaaccctgccatctcattgtaatggggctgttactgtgcagtgggcattcgaacttgttggtcctataacactgactcacctagagcaacttcaggtcctgcaagctccattcatggtaagtgtcttatacaagtgtaccatttttatcctttatactttacttttctatgtaaagaaaagtaacttttctttttactttaccatacttttacttttctatgtttatatatgtttagatacacaaacaccattgtgttacaattgccaatttatacatgttcgtagaaaactattttctttaaagatttttacttatttgtatgcaagttatttgaagtcttttataactcatttagtagtgattcacaatgtataatttatatataattgtaaaactatcataaaataaactcaaagtatacttattcctttcattgaaaaataaagaaaacattaaaaccttcatatatatgtttgtgtatagagatatatgtatttatacatcacatttaagtatataataatacttcttccacctatttagaagcagagtatagaaacaaatagtatatttggtataaatttactgtgagctgtggtttcttataagattaggaaaagctagtctttaaaacttcaaaggaaagctactctactttctaattgtgttgataaaagttagcaaaaattcccttcatcacaaaacctaaacatgtagtgtaattatttacacatctgtttcaacaattatcatataagctcatcagggaaattcattgtcttcagctctctctaaactaccctaaaaggtattattatagtaatttttctaaaatttaaatctacttgtattattcacgatactaaaacacttcagtgccttcacagtacctaatggaaaaggtttaaacttcttggaggcaaaagtcttctgcttacttcttttgctttatttgctgatattcacatatattcacatagtaaaataaataatagacattctgtctacaccattttgtttagcaagggaagactttacacactgaaataagtaaataaatactgaagctaacagaactaagggatttatggatggagaagaaagaagagatgtttcctttgaggaatacacaatatacaaaaatagtataagtacaccattccttcttcactgcatataaactgctaaaggtagaatggggagagtgttatttctccatttctgtctatatgtctagtcttgaaatccaattattatatttatcaaccttagaagcttagacaaaacccatagagcctgtaagcctatttcttcatatgtcagatatgaataataaatgtatatactgcacaatctggttgattagattaaaaaagtaagacatatatatttattcacattttcctggcagattagatgcattaaaaattccaatcattattatcattttcattacgttatctgtaaatattacaatttaacttctagcttattgatgaaaaaatagccattggcagaaataaatacctgtctacaaacgcaagataacacaacccaaataagatcaacattttaaaacattttaaagcattatgaatgtacttcatttgatttagactgcaaaacaatagtgctaagtgagaaataagtatggttgctacttgttgccaaataatggagacttacattgttatagtgctttacagtctaaagtatcacatatctgagctcacagcagggtggtggggtgaacattatcccattttacagctgaaaaaaaatggagcaaaaggatgttaaattcctctctaaattcacagaagtagaatatagtgtttatatcgcataactttgtgaaacattcttagaaatgtataattaaaggcattaggaggtaacttttgggagaaataaaaagtgtatagttttacatactgtctactatagttatttattcaaaaatatttatcaaacctggaccatgttctatggactcaggtacctccatgaagtacacagtggtttttttttgttttgttttgttttgtttccttcttgagcttgcagtccagggaaggatattgaaaataaacaaaaaaaccagaaacaaagtaaacaatttcacaggtgacaagttccatgaaagtagcaaacagggtgctaaaagaaaagaaacacttttggggtactttctctaaatctagaaagaatgctaagggaacgtcaccttctacaggttatatttactctctagaagccatgaagagtaaaagtgacaagcagggaaaacatttcagacaaagaaggacagttatgacagatgctttgtggtgggatataagttggtcagttgtgaaaaactgaaagcctattagtgtgactggagcacaatgaaataagaaagaaaggcccaggttgagcctgtgggtataggtgggacgtgcatcggtagctgttcataagaacttacattttgttttatattagatggaggctcgttaatggttttaaacaaggacatgatgtgatctcatgatctcatttatagtataaaaggtcatttggaagagaacatatttgagttgtggaagaatgtcagcagggaaattaattaggatgtcacaaatctcgtgaggtgtgcactgggctgtgatcttcagcagcctatctctggagactgggctcttagccagcacaaagtatggcccatctaaagaagcattttcatcataatgatggcagcagtggcccggttggagcagccgctgtgaagacacagctccagtgaggaaggctcggccagggctgcgcactctgcggagccagtgggtgctggaaacaggtgatcccaggggagccctgtgccctactgagttggtgggacaggagcttgcgttcccgctgcagccgcccagccatggctttggactccggcatccctgtactctcggggccgggaaagcccccgcctccacaggctcagaagttcctgttcccactccctggcccctccctgctcccagtgcctgctctgcagtggagcaaagttgcgactatgtcctgatagccgagcccaggcgctgtagcgacccagccaggtgtgtgcacactcgcggtagtgctgacacgccagctccccgctgtctcggccccctccagaaactgcttctgaggctgaaatgttgggtgctgatgagcatggaagagaggctgggggctgacggtggctcggtgcgggcctacaggcacccctgggagcagtcagcctgggggccatgaacggcctgttgatggcagcgggagcagacagtttcctaggtgggaaggggtgtgtacctggcaggtcctgaccttcaggcctggcggcgagacggccatttccggatggagaccacaaccgggagtgagaattttttttgatagcttttggccaatggaatggtgtttttttcaagccctcccatggccacctgtaaccaatcagcactcacttcatcctacccgtgaaccaattagcatgaacttcctccatcctgagccccataaaaaccttgcactcaagcccctggggactactgcctgtggatagcggttacctgtgtccggtctcatctcctttgagagctgtatggtcacctaataaagctcttccccaccttgctcaccctccaattgtctgagtaatctcatttttcctgaagcaggccaggaactcaggacccccagactgcgggagcgaaagaagctgtaacatttccctgctggctcactgagctgtgggctggagctaaaaggcctgtaccactattaaccctcacaccctttgccagcggccaccccacccaaccgggaagaagtggtggggccggagcggggcagagggactgaaagagctgtaacacaaacaggctaaacacacacaccccaccctcatccacttgctgtgggcgacaaggagagaaggtctgaagcctttctgggagtccatgccttcaggctctctgacccagggctgtaacatgctgtaataccctctttggggctctgtggttcctggtgtctccgagctttggggtgccaccgcgttcccgttgtccagaaactggcgcctgcagcggaagccgcggtacgtctggtccagtagcagcctcgcatgaagccggagcctgtgctggcacctggagctgcccaccccgaggcagcagccagcatgcctggctgtgcacagtggccagacccgtgttcattttctcccttgctgttcctcgcctggctgacccttggcaggtgtgggatccgggctggtagcatgagccgagcacagcctgccgggccaagtgggtgaaacaagcccagcaggcacggacaaaactcaagcagaggcgccagtggccacagaggtttgtggctggcgaagccataccctaaggatcctgtgacaataaggtggtacttcttgttaaagaatgaaaatcaacttcctaaagtgatcatgtatatgcccaaggaatgtgggctgcacattttgaggtgtgctctaagcactggaaataatatcaaagagcacaatgtcatccttccaaaatttccttgttctacatccatgaatagaaacctggcttggagaaaccgaaatctaacataagaaaattgttaatagaccagtaatgttattttaatactgatataccagtatgttatatttacaaatctgaaaagcaatttccaaccctaaaagttatttaaactctgcaggaattacttttttaaatgttttctgaacctctgattcgaggtctcccttacaaatgtttgttcaagagatgtaattatgtggtattacttttaccacctgtaatgagttgatttaattaagattactgaatgaaggatccttaaaaacttaaaagtagaattaccatacgatgcaacaatctcgccatctgtatgtaaagcagatgaaatcagtatctcaaacacctgcccatctgcgtgtgtgtgtgtgtgtgtgtgtgtgtgtgtaaaatgtatcatttagccttaaaaagaaggaaattgtgtcatttgagacaacactgatgaatatgaagcatattacgctacgtgaaagaagccaggcacgaaaaacaaaatatggcacaatgtcacttattggaggaatctaaaccagtgaaattcacagaagcagacagtaggatggtggtttccaggatatgagagaaattgggagatgttagcaaaagcgtacaaagttttaatcgggcaggatgaataatgtatagcatgatgactatactatattctatatagaataatactatatagtataatataatataatatattatataatggtatatatactatataactataatataattataattaattatatatagtatagcatataattatatagtatatatataaaattatatagtatagtatataattatatagtatagtatatgctatatactatatatactatactatataatatatattatatattagtatatatagtatatagtatatatactatatatagtctatagactatataatatatactatatatagtctatagactatataatatatactatatatagtctatagtctatagactatatatagtctatagactatagataatatatagtctatagactatagataatatatagtcatatagtctatagactatagataatatatattatatagtctatagactatatatagtatatattatatagtctatattatatatagtatatatactatatatagactatatattatctatagtctatagactatatactatataattatatatactatatattatatataatatatagtataattatatatactatataatatatagtatatatattatatagtatataataatagtaaatatagaagaatactatattgcatatttgaaatttgcgaagagagtatatcttaagtacttatgggacacacaaaagataactatttgaggtgctggatatcttaattaacctgatatagttacatttcacaatgtacacagatatcagaacatgatattatacattacaactattataaacatatataattttttgtcaattaaacctcaataaagctgagggaaagaagagttgctgtagttgtgaacagaaggggattctgcctaactaaattacaaagaggctttaatcaacggatagcctggttgttgacaggatgccaagaacagctaagaaaatgtgctccacctgggagaatggaaataatggcagctaaagaaactgcagaagttgggcttgggagaacttcttttgaaatgactttaccaaagttcaatgctagtgatttttattttctaggtctctctattctaggctaaaattctcaggaaggatgatctgatgacccagctttgatttacctctggatcaatcagctagagctgcagatgtaagacccccaaaagggctcagttttttttttaactgagggctttccagggaacagaacatttctgtatgccagaagctaaaccaaaatggcatattttagactctaccttatggctgttttcaggcatgcacacacatgcacagacatatagatacacataaagttattcccctctatccaaatgtacgtatctaacatgatccacataaactacacactcattcttctttcacaaaagaaaaaactggaagtcactttcagatattttagtccgtattctttagagtgttcaatactgacagttgttttataattccatctcaatattcaaatactttagaaacaaatggaaatttaatgccttgtctatattatatactgaagaacaaaagaaacacataaaatacatacttaaagatagaattaaaaataaaaaattattccatgcagcaaacaagaaaaaagcttcggttctcatctttgaaggtcataagactctagggagcatgtaccatgtctcttctcaacatcttcgccttcaccttttattctagctgactggggcagaagaattctcctttgggaattcctttcaaagaccacagaatacaggaagttaatatttatggactattaagtgggatacagagaaatgttactacataattctgatctatttgtcatgattagggaacagtgcttcagggaatgttttgaatcctgaaaaatgcttgccaatcctcacagggtgtggtctcattataactgaccacataactgaatttttaatatggcagtattttgttttatgggtctagatgctttgggatataaaggtacttttcaagaagggtaaattcttgtataattgcttcctaattattcttgccagatatatatatattagtcagtttcagggatgggagtttcatgctgctccatgaatttccttcatctttggaattatgatcattgttctttcacccgtttactgagtagatttttcgatgagtaaacatgaccactggcatatgtagatcaactcggcagcctgttcagaataataataatagtagtgctaatagtaatgataattttctggtaatcaatcaaaaatatttctagtctccatatttttctgagaggtccatttccataactaactctcgattttccattggaacaacctcattatctaagtcatttactattttaaacaatcattactttgaaagtgatatggatctttcattaaggctatccattcaggaaagctgagcaatggtgagtacttctggaagctctgaccacttggaagatttccattttgagtgaaactgtgtagcattccattcccagcaagcactggtattaacatagagaatcaatgtcaatctcaagcagttatttttttcactttcattggccagatagtatcccctgagatcacagtttataggctaagagaaaatgcaaatgtagcaggcataggtaactgtattagtcagttatactgttataaagaactgcctgacactgggtaatttgtaaaggaaagaagtttaattgactcactgttcagcattgctggagaggccttagaaagcttaccattatgtcagaaggcgaagggtaagcaagacaccttctttacaaggctgcaggaaggagaagtgctaagtgaaggggaaagagcctcttataaaaccattagatctcgtgaaaactcactatcatgagaacagcatgggggaaaccacccccatgattcagttaccttcacctggtctattttttgacgcatggggattatgggaattacaattcgtgatgagatttgggtggggatgcaaagcttaaccgtatcagcaactatatactaaatgtagacactagtgaaatataaactctgactaaggttatgtaacctatttcatatatttctataccaccaaaatgttattgcggtgtggacgtggataaatatttttaacttaagtaattattttgctttcatatcctcttaaatgccatctggcatgcaaatatgtaaaataacaaaaatacagattgccatattcttctatcactcctctgtaattagcaatgaactacataaagtaccagacatttgggatgtcatttagcttgtgtgactccctttgtgagctagagcagagaataagcagcttgctctcctgattgggaatttcatagccctagttcctgttaactcactcagaaaacacagctgtgcatgttacctctgaatgcccacctcaaaaagatgcatttttaacagtcattgtcttcgttcaaattcagtgttatgtatcaaagcaaacaactaccaagattgctggataaaaaaaaaggctgcattattacaggtaaaacaaatatttcatccctaaatctctactctcttggagaccacttggatgtttggtttttgttcaaattatctctacattacatggcagagtgacacattagatttaggatatttcttaatttgaaatttacctattggtatttagatggttcaataattcataaaatgatttaacagtaaatacactgaatattttaacattattcctgtgtataaaatttatcttctattttttggaaagtatatgatgaacttggaaagtatatgatgaactataactgaaaatatgctaaatttttccataagaatattttaaaagagtaatacttgagaaaaagagaaattctcatacttttttcccttttcattagaaacacatgctatttagctcttctagaaagtaaaaaacactgaaattaaaattcctaccactcataatgtatatattgatttttgaaaaatggaagaaactaatattttaaaactacatttattattaacttattaatactaatatttgacccatgagttagacagtgattgtaaaaataagtataaaaatagtgctcaatgttagtacttgtattttctgatttcatcattaaaatttcctttcaatgtacatacaacataacagaattaaagttactcctgtataaaaaatgtatagtaattatgccttatgtctctttggtgtttgtatccatttttgttttgtcaataacaaaatttttactaacatgagacattattctccatcacagggctgtttatttgcagaattttatttacattcacagaaaacaatgtgaatagtggtctcttgtgttatgctgcatatcatctatgctgttatcatctatactctctgttacacaaataatacattttaaaaaggtgaaatcatagataggattagcctttaaaaatccacttcagtccatttttaaaaaataatttgacatgatctatcatttgcactttctttgaatgctccttctcaatccatgaggtttgcctgatttgtaaaacttagtaaaataaattaagagtcatggcacctggcggggtgcagggttgggggagaaacacatgtcacctgttggatatctttatgccatcattatttgattgattgattagttgattgattgagacaggaattcactatgttgccaggtcttccctgggctcaagcaatccttctccctcagccttccaaaaagccgagaaacatcaatattttaatgtgcaccctatattcactttaataaatattaatttgaggttaatatgttaccataatttactatgacaaaaactgaaatatataatacaaactagtacatagttcctgccttcaagaagttagtaatctgataagaaagacaaatatataaacctaattatcataccatatgataaagtccataatggaaagagctcaaaatagatgtatcacataaagcataaaagaattctccacaaaatatcttatatcacaggaaaaatgaaaagattcggccagcatggtgactcacacctataatcccagcactttgggaggcttagaaagggagatcacttaaagccagaagttcgagaccagcctgggcaatatagaaagactctgtcactacaaaaaaatttaaaaaaataacaaggcatggtggtgcacatctgtagtcacctcttaggaggctgatttggaagaattgcttgagcccaggagtttatggtgagccatgatcatgggactatactgcaacttgggtgccagagtgagatgctgtctctaataatgacctctttcaatgtgctagtactttataatacatacatattgctcaaaacccttgactgaatttcatgtggaaaaaatagacttattttcataaaatgtactgcaatattttaaataaaccagtatgtaaaaaaaaaaaataaccaacttgatctacatctcctactataaatgtattttgtacatggaaatcacttgaaatgtgcataagatgtctatgtatgatgttgacagaaagaagaaaggcatcacaatattatacatagtgttagactttcttggtctttctagtcttgtctcaaacactttttcacactgtattttatatttgcctcctgcttttgcatactgttgtatgagtcaacaaccagttgaaactcttttgaagaaaatgtagagatgaaagcatagagaataaaaaaataatagagtaaaactaagatattttgacaaaaaagagcatgccaaagaaattgtaggcatgctaaaaatgcattattagggtacacattgcaattataaatagtaaaataaataaatttataaattagcattcctatgcactatgtgacaagaatacagcattatttgttagaaaaaacatgcaaaattattgggaaaataaatggagagacaggataatcaaagactcagattatctaccaaattgactcagaataaggacatgactgtttgcaaagttaaacgtgaagaccatgacagggggaaaggagttgtcaatgaagttgactttcaaagcaagccttagaaattcaacagaatcaatatttgttatgcttatatcaacaaaataaccgtggaagctgcattaactcttcatgagaagactgttacttttctgtcctaagtattttttaaaaagtaaaaaaaaagactactgataaacaaaattgattgtagatcagatagggttaagaaacagatattgtcctgtgggtttattcctcagaagaataaagtgtctggttatgaagttaacaggataattttactgatcttggtacttgggctaaaaatattatgttaaaatccaaaataatctgtttttctgaaaactctgtttacttaaaggaatgtccaaaggaaattacgagttgcgtggaggccctcaaaccctacttaaaaagtaagatttttttttttgagaaatatgtacagttttacctcctatgctaaataaggcactaccagaaaaaaaaaaaacttgcaaacaaggccgtagacatttttgatgccttaacatttaaagagggatgtagaatatacccctaacatccaggtgattgtcttccctccaactttgacactgcttttgcaatccatgaaccatgattttatagttcatcacattataagtcttcacagttgtcaagacttattattctcaattacttattcaaaacctggtcatggtctaggtttgtcaaacaagaagctttgctaaaaattttttgaactatttaacatttagaaaggctttggaattcactgaccatgcatggcaatttttttttctccatcaacatcaagggatatataataaagaacaaatgccacaatttgtgattgatttaaaaggttttgtaaaggtggtcgaggatagcgtgaaaatttttcttgagagggatgttaactttgaagaggttaatttaaaaatgctgaagagttcttgaactcccatgctgataaattaactactatacttgctcaggaggatatataaccctggcttgaagaagatggagatagctacaagagatgcgtagtcaaaccacaggtgccatctactttgaaggaatgtatgcgccatgcaaatataaagctaaacattatcctcccatgtatcagccatctgatgaaaagccctcattttaatattgcctgatgtatctcattgcgtcattctcctggaagcagacaccaaggaagaggtaaaagggcaacagtttttttgttttttgtttttttttcattttctttctttttgtttattattattattatacttcaagttttagggtacatgtgcacaacgtgcaggtttgttacatatgtatacatgtgccatgctggtgtgctgcacccattaactcgtcatttagcattaggtatatctcctaatgccatcccacccccctccccctaccccaccccacagcagtccccggtgtgtgatgttccccttccttgagaaaaatacctgtaaaagtaaatgagagacgggaaagtagtacgtggggtccaccttcagaccacaatgcaggtctgatatcagtgaatgaagagaggagaaagaagaaagaatgcagagcctcaggctataagaaaaccttggaaattcagagcagagattccccattagaggaattacatgtgggtcagaaatggctgactctggtaagttctctcgctgtgctcagtcataggctggagacaaccagaaggtgtatagtctcggtgtgaacatagatcctgaatgtacagcacttggaggctgtcagctaacgactccttggaagtatttgctgatgaagggatatctgatggatacatttccatggctgccaaatttagagaacgatacaaaaattttaaaggatagaaatggtgttaattgaaacaaattgaaacattttgaaataattgttattccaaaattttgtgcaccttccctgaagcctgctgttctggaatctctacagcagatacgcaaagacgtgcagacacacacacacacacgtatgatagatagacaggcagacagacaaacagatagaggtcccatagataggtaggtaggtaggtaggtaggtaggtaggtagatagatagatgacagatagatagatagatagatgatagatagatagatagatagatagatagatagatagatagatacatgtttgtatggcagttcctctggacagtttacctgaaattacccttcataactgaacaactcctctgcacgtctccttcagcaatttgtagtactgcttttgcactccttatctcctcgcatctcagttttcttcaatgtcaatttaatcatacttggtaaaatagtaatagttcaatatagaaaattgctttgtttttaactgcatttttctaaatctttttataacaaatttatttattgttatactttatttatggtgtttattttcaatgtgaaatttatgtcacagcaggcaacctgtagattttaccatttagaatgcaactgtttgttagcaaccatgttaactgtttagtaatattttaagtactttatattttattataatagtttgatacatataaatgttttaatactttaaatacattttaagaaattaatttgagatttgaatttatgtggaaacatcaggaaaaagcaaaagccactatttgtttgaaggtttatcacaacttggaggatctctaagtttaatcaacctctgggctcagaatataattcaaatttttgagcatttcatcctgggacctctacctatttgtccaatcagcctcatcttctactattccacacctcacactttatactctaatgataacaaagaacttgcatgcatgatacttgaatgcattatgctacttgagatttgcatttattttattataatattttctatatgtgaatgatccccatatacttattttctcaacctactaaaatcatatgcatgcttaaagtcttggcctaactatcatttctattagctagctgtacatctttctctgttcttcatcttccatagatgcctgttatacattcatcttatcacatagattttcaggtcaagaatgagggtttactcatcttttaaagaagaaaaagacaatttaaaaagtagatgtgggccaggcgcggtggctcaagcctgtaatcccagcactttgggaggccaaggcaagcagatcatctgaagtcaggagtttgagaccagcctggccaacatggtgaaaccccgtctttactaaaaacacacaaaaaaattagagggcatctgtagtaccagctctcaggaggctgagacaagagaatcgcttgaatccgggaagcgaaggctgcagtgagaggagatcatgccactgcactccagcctgggcaacagagtgagactctgtctcaaaaaaaaaaaaaaaaaaaaaagtagatgttacataccgcccctgcaccaaattaagctgtttttcagaaagaaaactttcattgtaaaataaattattcctacataaattatgatcttgtgttatcattgtaaaaagctctcatgtaactgcaaaactgctgcaattaatgttctactttctaatctgaagtgttcatcagaagaattagaaaatgtgaatcaatggcatttacactcttttgatgataacatgaccaaacttgttactgaatgattgtatctaaaattcatttttctctaaaaggattaattacataatctattttcctgtaaatgatatgtaagttaatgatttaaacttctacaattatatatctaaattaaaacaccaacttggggctaaatgaaaacgattaaattaatatatgaggatgattctaccaatttatatgaaatctctgttgtctaccacaactgtcaataaagaaaaatttaaaaaaatagcaaagtgacttattagcttaaaattacttaatatgaattttctctatataggttctctcaacatgtaattacaagaaaaattacacttgtattattcaaaatacctgcttttattttatgtatttaatctgtttatctcaacttttagataaagtggcaatcaatccgacaaagtaagtattgggacttaattagtcaggaagaatgggatgccctgaggctgttgtatacatgtcagaattggcaaaatatccactttctacaagcaagaggaagtcatatttcacagttatgatgcaattacattgttatttcacagctgtcaaaaagcataatcttgaaatatgactttttaaagtatgtacttaaaaactttctcaacattttaactaataatattttaggatcctaggaatactataactgcaagcaccctaaatagagaggaataaaccaaaatatattttatatgattttcaacataataaaaattatatattttaggttcaatatataccatacagcttttcataaatgtcaaatggaacacagaaagtaagattacaaaattacaacaaagacaaatctaagggttgaacaaaacaggaagtacatttaaaacatattttatttatttttcttttctagctctcacacatagtttatacataaattgaaagacataaaaacacactatcaaaagatacatgaggagatagggacaaagagatacatgagcagagcaatcaatgggaatcaagctgattttagtacacaaaatttatgccacaacatcctctataattgctaaaaatggaatgtaaattggactttggacttcttaatggggagtataaagaaaagtaattagataaaatatttagtgtgcccatcatataaaatgtagaccagattattagaagtcaggcaataacttctggttctatccagtgtgtttttatgataggctgctctgtaacaagcagattacatcctccagagaatacctaaaataaatatcatgtgagtttcagaagagtacagaatcaccgaaggctgtgcagcatgacatttgtttcaatagaacatagcactttgagaggtgaaagcaggacattttcaaactgtgtcctctgacgatgcagtgagtgtgggataaaagccagaataattaaagggattatggataatatatgctttaggtaatctctgcaaatgataatatttaaaaataattcttagttatatatcatttagtttacaattgtgtggtaacatgtcaattttataaatataatattaggtggggggaagcaaataacagaaaactgtataaatttaaataccatttttaagcactgattacctgaaaacaagtgaagttaaacaatatatttgcaaaaatatatatatatatgtttaaattatgaagttaattaggaaaaggtaaacaaaatttccactgtaaagaaaaaccctgaggctcattaaatagtattgatgcagtccataggtccataggtagattcactgtggagtttatgaagttcctcacttggatcatttccttcaagatccttctatctaatttaattttggaaattgtgtacacttttcttagaaaatttcccctaagttgtataagagtcagacccatcgaaacttgtaatcttatgaagtaatattctatttcttttggtattgggattatgggtattattttattacttagattcataaggtgtattagagtatatcatcttgtttatataaaatgtatctaaaaagaaaaaaacaattggcagtattactgaaattgctgtatctagaatataggtattatatatggttaattgaggatagatccattattttgacagtccagtgagcaaaaagaagggtttactttctctcattacagtgaacaatatactagggcaatatactgaaaaggataatcaagtcacttctaattgatatatcactcaaaaaaatgactgggattctgaagcagcaacatatcccagaactctatactaaaaggctatgaaaatatttgactgaaaaaatattaaagcagtttactgtagtttaaggggttggagggtgcttaagaagacaggtacattagtgatttattgttgtgtaataaattgtcccaaaacttaacaccttgaaacagcaaatatctctgaggtgataaaagtaactaacaatggaaacccggtattaaactcaattgctcattttctaccaagtttcccaagaaatctagcctcatattttgttaagaaaaaaacagtttgatatgcttgagtgtgggaggaatggctaataaactaataccataatttgggagaaataaggttaactcttttaaacagagctggagcatcattgaccaaaatgcattccaaagaacgctaatcctatgagatattctgcaaattgggaacataaaaaaatgagaataacaaatcacatcaaatccatgaccctgtgaaatcctggagagatgacattttagtattttcccaaacttatctaatctcaacattttttccataaatttatggacacactctaatcaaaactagaatagatcaggctcagtctggtcagataccacagcaagagaatcaatgaatgatgaaacccactattgtgagagactcttgcaaaactggagaagcatttattaccaatagagtatttaatttagcttgatcttttaagcaaggctccagtaagaaagttgtagaatgtctacaaaattctagtcagttgtagtattcaagctcataaactttatttgcttccagaatagagctatgtacacaatgccttgagtggtgattattttgttctgcaaccagtattcattgagaacttaagtaatgatctgatatcatttagagtatagcatccatatttgttgctagcagctttggaaacttacaagctttacaatttctacatgtagttataaaacccctgctgtacttgcaacaatggcttctttccctttatacttgtgattgttgagtagatatctgtgttttgcaaaaagaataattctagattagacaaattaataatctactagaacaacccttaaatcaatcttttgttaaaagcaatagcagaataagcataagtaaacataggtaaccgtaagtaacattaaattaaaacccttgtaagaatgagagcaagaagaaagtgcaatagtgaacgttgacatttgtgaggatatttcacaagtgtagttcatgtaagagttgctatatcatgagcagaaaatgtatcatgtcagttttgatattcttgaaatactgaaaacaatataaatcttcttcaaaaatatcaacattttacacagtacatgctactcatttatttctgtatgctgtatgctgtttgtataaactgactttcatcaaagttaacagggtttctttttttttttttcttctccaagttcaacgaaaacagttttctctcaaaatgtttgtcacaacctttggacaaacaaaagcccagagagagaaaagtaaacatatgtatccacatatctatcaatcttttgatattgcaaaccatttagacaggggaataaatgtttagaagagtagtagagggacagaagcctttcacttttagtccacctacacaaatcttacttctcaaaaacctgttatttgttgtgtttgactaacaagaacatgacactggagaaaatcgtatctagcaaaaaaaaataattttagcaattaaaatacattgattacataactacagcaatggactgtattttaaaaatatttactattcccttaagtcactctcctcatggactgaaacaggttggttagttcgctaaaaattaaactgaggtcaaagcaaacactgagagcaagttagtagtcattttttctctacaaactgacctaatcttgattagttttgtaatagtttcacgtaattttttagatagatttagtatttgtgcaattttaacaatctaacgttgtcttcatagtagctatgtatttgagtaacttgctttatcattgcgatctgcatccacagattcaaccatccacagattcaaccaactccaaattgaaagtgttcattaatatgcagaagaatgaaattggacatctcgagtctcaccactaaaaaacacaaaatggataaaccacttaaaaataagacctaaaacatcaagagattaagaccatcctggctaacacggtgaaaccccgtttctactaaaaatacaaaaaattagccaggcgtggtggcagatgcctgtagtcccagctatgctggaggctgaggcaggagaatggcatgaacccgggaggcggagcttgcagtgcgcggagatcctgccgctgcactccagcctggaagacagagctagactccgtctcacaaaaaaataattgaaaaaaaaaaaaactaaaacaataaaatattagaagaagacctaggggaaatgctccagtactttgctctaggcaaagattttatggctaacactcaaagtacaagcaacaaaaccccaaatagacaaatggaactatattaaagcaaaaaatttctgcatagcaaatgaaacaatcgacaatgtgaagagaaaacgtggtgaatgaaaggaaatacttgcaaactattcatttggcaaagaactaatacccagaatatgtaaggaactcacataatagcaaaaaaacaaataatcccattaaaaagtgggcaaaggatctgaatggacatttctcaaaggaatacatacaagtggtcaacaggtatatttaaaaatactcaatatcactaacttcagggaaatgcaaatcaaaaccacaatgagatatcatcttatccaagttagaattgctattatccaaatgacaaaaaataactaatggtggcaaagatgaaaagaaagaattcttatacactgttagtgggaatgaaaattagtatagccattctggaaaatagtatggcgatttccccaaaaattaaaaattaaaactagcacaagatagaacaatctcactactgggtattttatccaaaggaaagtaaatcagtatatcagaaggatacttgcacctccatgtttattgccacaccattcaaaatagcaaaaatatacaacaatctgttcatcaacagatgaataggtaaagaaaatgtggtgtataaatacacaactgaatactatttggtcataacagtgaatgaaattttgtcatttcgagcaacatagatggaactggaggtgattatgttaagtgaattaagccaggaacagaaagataaatatatcatgttctcactcatacatgagagttaaaaaattgatctcatggaaatagtgagtagaatggtggttaccagaggctggggagggtgtgcgtctgtggtgggggataaaaagaggtagattaatgggcacaaacatacagttagatagaataagttttaatattaaatagcacagtagagtgactatagttgacaatatattgtatatttgaagacagctaaaagaaatttgaaatgttccccacacaaagaaatggcaaatgtttgcaatgatagataacctaaataccctgacttgatcattacactttctatgcatgtaccaaaatatcacatgtaccacataaatatgtacaaatattatataacaataaaataattagaaaaataataaaagtaacaataaaatataatacaaataaaaataatgcatctaacaactatttacatagagttgtattaggtattataagtaatctagagatgacttaatgtacatgagaggatatgcataggttgtatgcaaatactacatcatttcatataaggaacttgaacatttatgggttttggtatctacaggagtcttggaaccaatcttccgtggatataacagaacaactatatctctatatctagatatatatgtcttgttttcaatataactaaactaaattttcccttttaaactttcttcaactccttaatcttttattttattgataatgtcattctctcatagtatctcaggatgagatcttcaagaaatcttagttacattacatgtcagttggtctccctactgtgggtatatctcatactacaccagcttgacaaaatacttgcacctccacataattctgattctctccctcttttcatggtcttcactgttcacaaatgtactctcaacaccaaaaagtgatattatgcttctcaatattattttcctttctcctgaagctttgtttccttatactgtccttcaaatattctatacaacagtaacataaggttatttttcatactgcctcactctgtctcctgtgcccatatatgctcttttcttttttggcctttttttatacagcttagtttattcttttgaaagatactcttagtataatatatttcatctgttaaaaaatactactagctagtgaaagggaaaataaaacatcaacattatagcatatacttattctgtttcccctggcaggaataacctaaaaatatttcttgatatacttgtctggtttttccactagcttgcaaacttattaagggaaaaaaccttgtaaaaatcctctgatagttactttagaataaacctaaatttagaaaagtgatatgtaattgttgaagaaataaatgaattaaaatgagttgccaagaaacgtgaataaaatgctcaacatcactaatcactaatcatacacaagtcagaatgactattattaaaaaatcaacagatgttggtgaggatgcaaagaaaaaggaacacttatacactgttagtgagaatgtaaattactacaacctctatggaaaacagtatggagatttctcaaatactaaaaatagaactaccctctgatctggaaatcccactgctgggtaattactcataggaaaataaattattgtattaaaaatacacctgtgctattatgtttatggcaacactatttacaatgcaaagttatggaatcaacctaagtgtccatcagtcgagaattagataaaatatcacacacacacacacacacatatcctggaatactattcagccataaaaataataaaattatgtcttttgcaacaacatgaatggaattggaggccattatcttataagaaataatttagaaactgattaccaaatactgcatgttcttacttattagatggaaataaacaatgtgtacacatggatatggaaaatggaataggagacattggagattctataaggtgggagggggatggtggttaaaaaattacctattgggtacaatattcactagttgtatgatggataacgctacaagcccatacttcaacactacatagtacatccattgatatgatttggctatgtgttcccaccagaatctcaagctgaattctaatccccagtgttgaaggaggagtcttgtgggaggtgattgaatcatggaggcagatttttcccttattcttcttgtggtaatgaatgagttctcatgagatctgattgtttaaaagtgtacagaaactcccctttctctctctcttcctcctgctcccaccatgtaagacacacttgcttccccttcggcttctactgtgattgtaagtttcctaaggcttccccagaagcaaaagcctgtacagactgctgctatattaaatatagcttctttataaattacccagtctcaggtatggtatgtcttcatatcaacgtgagaatgaactaatatgtccatgtaacaaaactacactataccctctaaatctacaaaaataaaatttaaaaaattataattttatatagtacccaatcatttttcaatggtatttatttgtgaaataaaaaaatagtacacattcaaattttttaaattaaaaaatagatataaatataatgaagtgatgtttgcttctggagaaagtgctataacatagggtgaatgtatcctcctacttgaaacaaatagacatctggacaaaatacttgaaataattgtttttgcatattgaaacaaaaggctgcacaggacactgattcctgagagagtggaaataaaagagatgaactctatgagtgaccacaacttactatattgagagtatagatggttcctgaattataatgtttgcttttttgtttgtttgatcggttggctggttggttggttttgagatagagtctcactctgttgcccaggctggagtgcagtggcatgatcaaagctcactgcatccttgatttcttggactcatgtgatcctcccacttcagcctcctgagtagctgggactacaggtgcacaccaccatggctggctaattttttatagttttgtacagacaggtctcactatgttgtccaggctgctcttgaactcctgggctcaagtgatcctcctacctcagtctccaaaaatatgaggattccaggcatgagccactgtgcccagctgcaactaagttgacttaacaatttttcaactttgcagtgatggaaaagccatatgcattttagaaaccacattttaaattttgaattttgattttttctcaggctggtgatatgcagtatgatactttcttgcaatgtttggcagtggtggcaggatgcagctcacagtcagccatgtgattataaaggtaaacaactaatactctacagattctaaagtgtactgtgttgccatgtgattttactcaactgtaggctaatgtaagtgttctgtatgcttttaaggtaggctaggcttagctgcaatgtttggtagtttaggtgtattgaatacatttttattttacattatcaacttatgagtggtttattgtgacgtaattttattggtaaatggggaagtatctgtatatacacaccaacattcagggaaagtgaaataaggcgaagacatggactaaggttaagagatcaatgcaggaatccaaggagtataggcagcaaaagtcttcaggaaagagtactagtgatgataagcctgtatagagagctctgtattcaagcagaggatttcctcaagtcactactaatttcagagtaacccatctatttgaggaaactacactaggtcatagaaagtctcatgtgaaatatttagagtgaaaaaaacctaagagttcacacaggtctagaaataatttatttgccattaataataatatttaaaaaatggtaattgagggagcaccaggtaaaacactaacaaatattatgcctcagtagtgtgacaaaattagcccatgactaaaagctgtaccagcaccatgtaacaaaccttaaaagcaagactcacaataataaaagtgtttaaaataatttaacaatattctgggacaaagctcaagaatattaatgagaatacaaaacatgtagcataaacaagtttaaaaaattacaatatcttgcacccaataaaatatttctagaaattcaagaaagcaataaaatgcaactataacgagaagaaaaattaatagaaacaaatctaaaaatgacaggaatgagagaattagtagacaagtatattaaaccagctattattattatatttcacttcatcaaaaactgacagaaaagagtgagaaaattaaacataaacaagaaagctataaaaaacaaaactcccagagccaaaactacaatgtctcaagtgaaaactacttttgataggattaacaacaaattagacacttcagaacaaaagattagtgaacctggttcatagaaacaaaagttatgaagcagagcattagtgaactccatggaacagcttcaattggcctaataattgtgtagagtctctgaagaaggggaaagcagaaaaatacatatacttgagaaaacaaccaaacctgttcaaaattaataaaaacatgaatataaacatcatagatcaggaccaagaatatggatatgcagtaatctaagccagagtttctatttctgctatgcaatgtctttgtttaggaaaattactagaatttcctacattttctaagatccaaaacaaactcaagcataggtaacataaagaatagtaactaacaacaggtccatctgacttaaaacgggttatatttacagtaagcattaaaagttatcagttttttttaaaatgtatcaatgaacaaagatataaatgacagcagacttcttgatggaaacaatgcaagttgaaaagacaatgggccaatattttaaagaactgacagaaaactactagtattaatttttttaagaatttcatctagaattctatatcaagtcaaaaatatctttcaaaaatacatatggacataaatgcttccacaatgacagaatatgatcatctgaaaatttgtttgtccataaaagcaaaaagaacattggcaaaattgttaaaagccagctatttcagaactctaaaagttaacaccagtctgagaacaatgtatgaaacatttgtcaaacaaaattagattaatatatttaggaagattgagctttgtggtgttttaatttagcccatctccatccatttctccccagctatgtgaaacattgaaaatcagcagtctttcaatcattgtagctttgaatacaagcaacctagcagaaaatggaggcatccaaataagattcaagttctactaaaattcttgtcaccagagaattttcactatttgacctgtctgttagctccctacaaatgtcccatttatgacttcactcagagctcactcagggtaaacaccaccagacatatgttggtgtttggacatatgtcatatataagttgaaaataattagtggtaattatttaaaatggcagttatctgggggcagtgataccaactgaggcaagggcctacccacaaatttaaaactacattttacaaaatgagatgtccacaggggactctgagtaccccaacatatacaagggaatctaaagttgacacatacagggagcattgtgtgtacccagaaaaataacctgagaagcactgttctctcaattctggttgatcctgaggtttttcacaagcaggaagtaatggttaaggcagaattgtaaactgcccaagtattgaaaacttgccccaacatacaaacagagacccttaacagagaatgagagacttattggcttaaagcatttaagagaatctttattgaatcattagctgaccactaacctaatgaagtggaaacgtcaatggtcacagacaacataaaacagtgactttaagaaattaggccatgaaagtccctacacaatcaaacagcagcagcaaaagcaaagatagcaacaaaataaatcctggacagtggaggaagaaggggaagggaggaatctttagtttccccacatagaggtgccacattatattattttaaatgtgcagttttcagcagcaacaacaatcataagaaaagcacagacagagaaaggtatggtctatgtatggggaaaaaagcactcaataaaagttgtccattaagaaagacaaatgttgggttaatttttagaataatgtaaatcagctattataaatattttttatttttataaaataaaaaattttggttccatgtctccacacccaaatctcatctcaaattgtaatcctgataatccccacgtgtccagggagggatctggtgggaggtgactggatcatgagggcggttttccccatgctggtctcgtgatagtgagtgagttctcatgagagctaattataaagggctcttcaaaaggggccctttataaggggattttaatgggctattcataagtggctctttttagggggctttttaaaggggctcttccctctttgctctctctgctctctctcctgccaccttgtgaagaaggtgcctggttcctttccaccataattgcaggtttcctgaagcatccctagccgtgcagaactgtaagtcaattaaacctcctttgcttataaattacccagtcttgagtagtatttttattgcagtgtgacaatggactaatacactaggtataaagaattataggaatatatgagaacaatattgtgcacattggaaaatatcaatagagatatagaagttattaaaaacaataaagtaaaaatgttggatttgaaaaggaacataacagaaactaaaaattcactagaggggatcaacaatagctatgagctggtagaagaaagaatcagcaaaccctaagataggtcagttgagatgaaatcaaaggaacataagaaaatgaataaagagaatgaacacatcctcagagacctctggggcactggaaagcatactaacagatatattgggagtcctgtaagaagactagtaagaattactctaagttgactatagtaagttaatatgtattttataagtcctaaaacaaacactagaaataaaacaatgaattatatctactgagaaataggaaaagtaaaatggaaatggaattatataaataatcctcaatctaaaaatggataaaaatagaaaagaaatcagaaacatataaaattaatagaaacatagtaaatatatccatacaataatgacattaaatgtaaatggaccaaatgtctcaattaagaggcagagaatgttagacagaataaaaaaccaagacccacctatatgctgccttcaagaaacatactttaaacctaaaaatatgaataattaaaaacaaaaggatgaaaaggatgcaaatgtgaattaaaagaatggggaagtggctatattaatgcaagccaggctctatgctagataaagttttgaattaaaatttttacacaattcttgctgtgaagaagatttgaattaaaatttttacacaattcctgctgtgaagaagattttttttctagctaggaatataaaaattgagtaagtacacaggagtcatacacaaaagagatgactctaatcaatgtgtgcatataaaacaaatgacctaattctcttcctgaactgtctgaaatttaaaacaaacagtagaatcttattttaaagtacttttctggataaaataattataaccgagcggatgaaataaaattgagcaaagtactttttactctctccaaatcagacaaccttaatatgttctgattttattaaacaacttatgctgttgtagttgtggttgtttttaaactattaaagagaaagttactctataaggcagtacagattaagataaaagagaatggatctgaagtaatccaagccagaatatgaatttctgctataaaatgtatttatttaggcaaatttttgaaactttccattattttctagtgttattattaagattatggatactaaataactagcaaagtacttgagacacattactaaataaatggtaatagaattattccctaaaacattggaaattgttctgttccaaggtggcagaataggaatagctctagtctgcagctcccagtgtgattgacacagaagacaggtgatttctgcatttccaactgaggtacctggttcaactcattaggactggttggacagtgggtgcaacccacagagggtgagccaaagcagggtgggtcatcacctcacctgggaagtgcaaggggttgggggatttccctttcctagccaagggaagccgtgacaggctgtaccaggaatatcgggacactgccacctaaatactgcacttttccaatggtcttagcaaatgggacagcaggagattatatcccatgcatggctcagctggtcccatgcccacagagccttgctcacttgctagctcagcagtccaagatcgaactgccaagcagcaagcctggctggggaggggcatccaccattgctgaggcttgagtaggcaaacaaggtgaccaggaatcttgaactcggtggagcccaccacagctcagcgaggctcacctgcctctgtagactccacctctgggggcagggcatagctgaacaaaggcagtagaaacttctgcagacttaaacatccctctctgacagctctgaagagagcagtggttcttgcagcatggtgtttgagctctgagaatggatagactgcctcctcaagtgggaccctgaccccgtgtagcctaacttggagacacctccaagtaagggctgactgacacttcatacagctggtgcccctctgagatgaagcatccagaggaaggatcaggcagcaatatttgctgttctgcaatatttgctgttctgcagcctctgctggtgatacccaggcaaacagcatctggagtggagctccagcaaactccaacagacttgcagctgagggacctgactgttaggaggaaaactatcaaacagaaaggaataccactaacatcaacaaaaaggacattcacaccaaaaccccatctgtaggtcatgatcatcaaagaccaaaggtagataaaaccacacagatggggagaaacaagagcagaaaagctgaaaattctaaaaaccagagtgcgccttctcctccaaaggattgcagctccttgccagcaatggaacaaagctggatggagaatgactttgaggagttgacagaagtaggcttcagaaagtcagtaataacaaacttccctgagctaaaggaggatgttcaaacccatcacaaggaagctaaaaaccttgaaaaaagattagatgtatggcaaactagaataaacagtgtagagaagacgttaaatgacatgatggagctgaaaaccatggcaggagaactatgtgacacatgcacaagcttcagtagctgattcgatcaagtggaagaaagggtatcagtgattgaagatcaaatgaatgaaatgaagctagaagagaagtttagaggaaaaaagagtaaaaagaaacaaacaaagcctccaagaaatatgggactatgtgaaaagaccgaatctacatttgattggtgtacctgaaagtgacggggagaatggaactaagctggaaaacactcttcagtatattatccgggagaacttccccaacctagcaagtcaggccacattcaaattcaggaaatacagagaacaccacaaagatactcctcgagaagagcaaccccaagacacataattgtcagattaaccaaggttgaaatgaaggaaaaaatgttaagggtagtcagagagaaaggtcgggttacacacaaagggaagcccatcagactaatagcagatctgtcggcagaaactctacaggtcagaagagagtgagagccaatattcaacattcctaaagaaaataattttcaacccagaatttcatatacacccaaactaagcttcataagtgaaggagaaataaaatcctttacagacaagcaaatgctgagaggttttgtcaccaccaggcccgccttacaagagctactgaaggaagcactaaacacggaaaggaaaaaccagtgcaagccactgcaaaaacatgccaaattgtaaacaccattgacgctaggaagaaactgcatcaactaaagggcaaaataaccagctaacatcataatgacaggaacaaattcacacataacatattaaccttaaatgtaaatggactaaattccccaattaaaagacacagactggcaaactggataaagagtgaagacccatcagcgctattagtgcgctgtattcaggagacccatttcatatgcagagacacacataggctcaaaataaagggatggaggaagatctaccaagcaaatggaaagaaaaaaaaaccaggggttgcaatcctagtctctgattaaacagacattaaaaaaacaaaggtcaaaagagacaaagaagggcattacataatggtaaaggatcaattcaacaagaagagctaactgtcttaaatatacatgtgcccaatacaggagcacccagattcataaagcagtccttagagacctgcaaagagacttagactcccacaaaatagtatagggagaatttaacaccccactgtaaatatcagacagatcaatgagacagaaggttaacaaggatatccaggacttgaactcaggtctgcaacaagcagacctaatagacatctacagaactgtccaccccaaatcaagagagtatacattcttctcagcaccacattgcacttattccaaaattgaccacatagttggaagtaaagctctcctcagaaaatgaaaaagaacagaaatcacaacaaactgtctctcagaccacagtgcaatcaacttacaactcaggattaaggaactcactcaaaaccgcccaactacatggaaactgaacaacctgctcctgaaggactactgggtacataacgaaatgaaggcagaaataaagatgttctttgaaaccaatgagaacaaagacacaacataccagaatccctgggacacatttaaagcagtgtgtagagggaaatttacaacactaaatgcccacaagagaaagcaagaaagatctaaaatcgacaccctaacatcacaattaaaagaactagagaagcaagagcaaacacattcaaaagctagcagaaggcaagaaataattaagatcagagcagaactgaagcagacagaggcacaaaaaaccattcaaaaatcaatgaatccaggagccggttttttgaaaagatcaacaaaattgatagaccactagcaaaactaataaagaagaaaagagagaagaatcaaatagatacaataaaaaatgataaaagggatatcaccaccaatcccacagaaatacaaacttccatcagagaatactataaacacctctacgcaaatagactagaaaatctagaagaaatggataaattcctcgacacatacaccctcccaagactaaaccaggaagaagttgaccccctgaataggccaataacaggctctgaaattgaggcaataattagtagcctaccaaccaaaaaaagtccaggaccagacagattcacagccggattctaccagaggtaaaaagaggagctggtaccattccttctgaaactatcccaatcaacagaaaaagagggaatcctccctaactcatttgatgaggccagtatcactgtgataccaaagcctggcagagacacacaaaaaaagagaattttagaccaatattcctgatgaacatcgatgcaaaaatcctcaataaaatactcgcaaactgaatccagcagcatatcaaaaagcttatccaccaagatcaagttggtttcatccctgggatgcaaggctggttcaacatatgcaaatcaataaaagtaaaccatcacataaacagaaccaatgataaaaactacatgattatctcaatagatgcagaggaggcctttgacaaaattcaacaacacttcatgctaaaaactctcaataaactaggtattgatggattgtatctcaaaataataagaactgcttatgacaagcccacagccagtatcatactgaatgggcaaaaaaatggaagcattccctttgaaaactggcacaagacagggatgccgtctttcaccattcctattcaacatagtgttggaagttcaggccggggcaatcaggcaagagaaagaaataaagcgtattcaattaggaaaagaggaagtcaaattgtccctgtttgcagaagacatgatggtatatttagaaaaccccatcgtctcagcccaaaatctccttaagctgataagcaactttagcaaagtctcaggatacaaaatcaatgtgcaaaaatcacaagcattcttatacaccaacaacagacaaacagagagccaaatcatgaatgaactcccattcacaattgctacaaagagaataaaatacctaggaatccaacttacaaaggatgtgaaggacctcttcaaggagaactacaaaccactgctcaatgaaataaaggaggacacaaacaaatggaaaaacattccatgctcatggataggaagaatcaaaatcgtgaatatggccatactgtccaaggtaatttctaggttcaatgccatccccatgaagctaccaatggctttcttcacagaattagaaaaaactactttgaagttcatatggaaccaaaaaagagcccgcattgccaagtcaatcctaagccaaaagagcaaagctggaggcatcatgctacctgacttcaaactatactacaaggctacagtaaccaaaacagaatggtactggtaccaaaacagacatatagaccaatggaacagaacagagccctcagaaataacaccacacttctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaactataaaaaccctagaagaaaacttaggcaataccattcaggacataggcatgggcaaggacttcatgtctaaaacaccaaaagcaatggcaacaaaagctaaaattgacaaatgggatctaattaaactaaagagcttctgcacagcaacagaatcgaccatcagagtgaacaggcaacctacagaatgggagaaaatttttgcaatctacccatctgacaaagggctagtgtccagaatctacaaagaacttaaacaaatttataagaaaaaatcaaacaaccccatcaaaaagtgggcaaaggatatgaacagatacttctcaaaagaagacatttatgcagccagcagacacatgaaaaaatgctcatcatcactggtcatcagagaaatggaaatcaaaatcacaatgagatagcatctcataccagttagaatggggatcattaaaaagtcaggaaacaacaggtgctggataggatgtagagaaataggaatgcttttacactgttggggggactgtaaactagttcaaccattgtggaagacagtgtggcgattcctcaaggatcgagaactagaaataccatttgaaccagccatcccattactgggtatatacccaaagtattataaatcatgctactataaagagtcatgcacacatatatttgttgtggcactattcacaatagcaaagacttggaaccagcccaaatgtccatcaatgatagactggattaagaaaatgggcacatatatacactatggaatactatgcagccataaaaaaggatgagttcatgccctttgtagggacatggatgaagctggaaaccatcattctgagcaaactatcgcaaggacagaaaaccaaacactgcagtttctcgctcataggtgggaactgaacaatgagaacagttggacacagggtgtggaacatcacacactggggcctgttgtggggtggggggatgggggagggataacattaggagaaatacctaatgtaaatgatgagttaatgggtgcagcaaaccaacatggcacatgtatacatgtgtaacaaacctgcatgttgtgcaaatgtacactagaatttaaagtataataaaaaaattggaaatttgtgtgggagaaataactattgggatttaatgtcaaaggtacaatatttacacataaaaagttttattatgggtactatattgcatagcataagtgtgttttcttattttatacatatataccaaatatatattatatatttgaagggataatgtgtatattatagatcacattttatattctgccacatacgaccataattgaagtaataaatacctttaaaataaccgattattgcaagttttaaggcaggaagtctgagaacataatagaagattagagataaaatatgcacttatttccattctaatctatattattgttttaaaatatttttagatgtatgtgacaaagatattctaatattacctaattataaaacacataattaggctgtatttactatcatttttgtcatttaggtatcaaaggtcatttaagaatttgtcatgagaaactgccttttgtttttagacttacagtaatgcttaaatattatttccccaacatcttctatatctcaaacttggtggcatactttgcaggccatagtaagagactgtgacaaccatcctttccaatactcattactaagaaaataatacaatttaatctgactatacctattaggatgcaaaaaatgccagtaatctcaaaaataattagatgcaataaattatggcaaaatccctaacatttcagctttgcagttgtagaaaaatgtgccagttcagttgcatttaaaatatttaatttgatccctaaaactgaaatagttgttgccattcttattgcacttacggtaaaatgtttgctttatgtaaaacctaatgggtaaactagacgataagatttaatcatattttgttttttagccataattctaggagttcatctgagaaactcagggatgaaatgagattcttagatcattaagttgcctcctccatacttgtatatgaattgtgtaaattactttattttgctcgagttttttttttattatcgcaatgggcaacaggtgaaacataaatacaccttcccatgggtgtttctaactctgatgtgaagaaatcaacggggaaacagaaacatgctctggttaatataattaaatggagcttattgtaagtatatactgaagatatgaggatataaaaattaaaactttcccaacaggtttgttgaaatttagaaaataattcacagtcaattagaggacatacagattagtagactaaaagcagttctgattatttaacagtgaattttctaattttctatacttgaaatcatgactgcagaaagtcattgccttttaatctgccaggtgttacctggattcagatactagttcaaagatttaccaattgtgtaaacttcatgaggttatttaatccatctatacttcagttaccacatttagaataacaggactgaatttatggagttgttttaaggtgtgttgattatctattgttttgtaacaaattgccacaagtttagctggttaaaacaagatacaattattatagttcctgtaagtcaagagtctagcacagtttatcaagatctgctcagggtttcacaaggcaattgttttggctgcattccttttggagctcagagctctctttgaagctccatgtgatggttagctgaattcagtgtcttgttttgtgtgactggtgttcctattttcttgctggctaccatcctggagctgctctcagctacaaaaaacatcctataattccctgccatgaagccttgtcaggccatctcacgggtcttctattaataagacaacttgcctcttcaggaccagctggagactgtcttattcctgtctgcaaaatggaatcttatataagctaaaatagtcacgacagtgatttccatattctttaccatattctcttgactagcagcaagtcataggttcagccttcatgaaaagaaggagattatgtaaacatgtgactcattggtggtcagctcagggtgtgtcccacacacaaagattaaatcaagaaatccaggtaaaacatttataatcctgttggcataaacacatcctcagtaattgtagctcttacgtcttactgagctttttacttagaaaaattttctagtatctttgtgcctcctattgctttatgaattcagttgcttccactgttaggtcatcttacaagtttccttatagtattttctctctttctttttctgcaccactgatcacaggctctgtctttatgcatctaaactgccaagttagtgatgtgattctccggtttttgcattgtcagaaagtcaaatgccaattttataacctcatgaaggtgaagaaccagtcagattctttggttgctggggtaagaaaagttaattaaacctgtgaccattctcaaacaagtgagggcataaattccagctgatgttggcctgttcagttagtgcaataaggtctcagtcacacatcaattacatagtatagaaacagtactagcaccattattagcagatattaatgtaggccaggtgtattgtgggtgagtgcccgaatgcttctcctcagtgtttcataagtagaattatgtctcattctctcctgaaatccaatataatcatgtgtcacataattatgtttcagtaaaaaatggaccagatataccatggtagttccataagattataataccacatttttactgtaccttttctatatacattgtgtgtgtgtgtgtgtgtgtgtgtatgtatgttaagataggatcttgcacttttgcccaggctggagttccacggtggtgcaatcatagctcactgcaaccttgaactcctgggctccagggatgctcccaccttggtctcctgagtagctaggactactcagcatgcaaccatgttcaggtaattttttttttttgtaatttttagtagagatgagtttccactctttccaaggctggtcttgaactcctgggctcaagagatcttcctgcattggcctcccagtgtgctgagattacaggagtgagccaccataccctgttccttttctatatttagatatgtgtagatacaaaaatacttgccattgtgttacaattgcctacagtattcagtacagtaacgtgctgcacaggtttgtagcctaggagcaataggctaaaccatatagccttggtgtgtagcaggctagtactagtagaccagctagctttgtgtaattgtactctataatgtttgcatgaggacattgcctaaggacaaatttctgagaatctaacccctttattaagcaacacgtgactgtactgaaatacacttcttggcttgtgtttttgtagagtcaccttattaactcattagcttttttaaaattataaaccttccacagtaatgattatatccccagtaagttccctcaaaatatcttactactgtgtcaatagtactctaggatgtttgtgctctattcaaattcacattttgaagttcgatctacctatatgttagtatttggagactgggctttggggatgtagttaggataagatgaggtcataaaggcagggccatcatgatgggattagtacctttataagaaaagaaaccagagcttgctttttctctctatgcttttcatatattattgtcatcaaataattcaaatatccaaggggttaactggattgggaaagatattttcaggtaagtaaatgacactttttcacagagagaaattttcatgttgtttaacaactgaataacctttataaaataatatattgcttttagcaagtagactgaattgctaatttgtgactttattgtcaatcttgtgtaaatttggcagttgttttatatattttaaagagtactagagattatccttttaaattatcaaagtaaatcatttacatggtcaatattataaaaatatttatttcacacttatttgctgtaccctataataattccataattacatctttatcagcatatttcaacatagtaatttgtttgtattaagtgttggtcattattaagggtatttccttcccagacatatcctgttttttgtcccctgtagcaagtagaaggaggattatacatcacctttagagcttatattccaaatttttctggagtcatagccactgactgattataacaggacaattctgtacagaaatgagttccaaagtagcattcattgattacagtttttgattcccatgggcaatagcctctaatcttctactatctggagcattcctactgattatatattgaacataaatatttgttcatggtaataagcagttaggaagctgtgctataagctacattttcattttatatattcaggtactctgagttgcatatctttttcacaactttttaaaattttagcttggtattctaggatttcagactacacaattctgattccatttcaattaatgtaacaaaattctctccctgagtgaatacccaggattattttaatgtttgagttttagcctagtagccaaatatgttaaggttataatcaggccagatttataaagcttctcctccactttctggaattcctgtccttaactttatttctgaagtaaaaactgttccagtgcttctctttgacttaggaggatattctcacttcccactacttcgtttcaaatatgctaggtataacttgttaaagctcctcaggccagttaaaatggcaccgagatttcatttcctatgattatcgagtcaatgcattttaaatctcatttttcccataaatcatattaactcagaacctcttcaaaatatttcaatcagtagcacttccttcttcaggagaagacagatcatacccacgttatctacatacatcttagtctgataggactgtacaaattttcatatttcctctaactatatcatgaggctttagataatgcattctttttatgtacagctatttttgctgaaaccaaattactcagacattttatactatttgtgcatgattattttaatacttcagagaacatggccaagcagcatgtagttagaccctgtacgcagacttcctccttgttaaattgttttgtgccctctttgtctttaaaaattattgtattaattttatccgtaaacaatttacctgttaatttttatctaacaaaaaaatcaaatgttggacttactgcatataatatggcagaaattaaatctctaagggaactagaactgtgttcttagtacatgtagtagacttattctttgccccctaatatcttcctgaaaataccagttcaatttaattgcttttgaggagctttgttgagcaggcactttcctatgagaaaggcttttagacattaccctggacagctgaccacaaagtgataactcagcacatctagaggccctgttatggactgaatgtctgtgctctattcaaattcacattttgaagttctatctacctatatggtagtatttggaaattgggctttggggatgtaattaggataagatgaggtaataaatatgggaccttcatgatgggattagtacctttataagaaaagaaaccagagcttgcttttattctctatgctttttatatattattgtaatcaatagccacaattctctgagttaagtaaaatttgggtctccatgtttcagataaaagaactgccaagtttaatttacttgtgccaggtaacagctctgtaagactagtgactgatatacaagaaatctgactatagaagccaaaggtgagcatgaacaatattttattataaataaatactctgaccatattaatttttcctcaaacagctgtgtactatgaaactctgctttcttctcaggcctggaacccattatccattttatttctgcactgctgtgaaacttttataatagcattcattacatggaattcaattattggtttctatttcaagttcttcatagtaaacttgagagccctaatatctttccattatagtgcaatatgatgtaaaaaatgtcattttaaaaaataatatttctatctattggttttgcagatataaatattatcttgaaaaataacaatttgaaaatctcaataatcactttggccctttttatactcagtttaaattccagcctcttcaccttttgggacactctgctctctgttgcacaatgtcatttaccaaaattattttgctttaccttgggcacaatgatatttttgtttcttgtaaaaatccatctgataatgaagatacatttcaaaacaaagtagacttatttgtctctgtgtattgatttacattttacatcaggcaatctattctttattttaatactaattctatttcatcacaaattctcaaacagtcatctgaagtagtctatcaataagagaactttgtataagtattttctattattggtttttgggacattcttaatgaacataaaaaatatatattttgcctgaattacaaggtaaatttaggtgaaacaaaaagtgaggaaatgcaaagtcaacctatcaaatatttagaagaatacaaatggaggcagccagaaccataagaaaaaatacatttatttgattttataaaataaaatattaaaaagtgtctaagttctttgattgccaagaatagtttatgcctatattagttgaagttgagcaaaattatcattttacaattatctggcataatggttgctcataatgtatcttatgtgtcagataaaatctcccaataggaatggagaaaatcatttaaatgctgtataatagatatccaatagctgttgatattttcaatgatttaactttagttttgattggaatcaacaactcaaacctcccaaatctgaaacagaaaatttagcaacatcaagattataaggtttctttgattactttcctcctctgattggcttcctgtgctggctacttaatcagctagtaacaggcccaatcagatataaatttcctaaacttctaaattatgaaacatcatatatatatagttacacttattttttcaaataaatttgattttaaactaacccatacttatttatgctcaattttgtttcattttctaattattcaaaaagaagacttttaacaaattaatataaacataaacctcacattgcaccccataaatatatctaagaagaaatattttagaataaaaacaagttagcatattaattaaaaagatagctttacccaccatatataagtattttacattctaggaggactgttttgaataaccactactgtattcactatttattctcaacttaaatgctacaatagtatagtttgctatggtaataagtacttgagttattttgattgaataaagtttagatagaaatatgtcaaatttttaaaagcagaactcctaatacaaatggaaagttatttcaacctgtccataagttttaagaattctgtgggatcggtggtgatatcccctttatcattttttattgcatctatttgattcttctctcttttcttctttattagtcttgctagtggtctatcaatttagttgatcctttcaaaaaaccagctcctggattcgttaattttttgaagggttttttgagtctctatttccttcagttctactctgattttagttatttcttgccttctgctagcttttgaatgtgtttgctcttgcttttctagttcttttaattgtgatgttagggtgtcaattttggatctttcctgctttctcttgtgggcattcagtgctataaatttccttctacacactgctttgaatgtgtcccagagattctggtatgttgtgtctttgttctcgttggtttcaaagaacacctttatttctgccttcatttcgttatgtacccagtagtcattcagaagcaggttgttcagtttccatgtagttgagcggttttgagtgagtttcttaatcctaagttctagtttgattgcactgtgatctgagagacagtttgttataatttctgttcttgtacatttgctgaggagagctttacttccaagtatgtggtcaattttggaatacgtgtggtgtggtgcggaaaaaaatgtatgtttattgcggcactattcacaatagcaaagacttggaaccaacccaaatgtccaacaatgatagactggattaagaaaatgtggcacttatacaccatggaatactatgcagccataaaaaatgatgagttcatgtcctttgtagggacatggatgaaattggaaataatcattctcagtaaactattgcaagaacaaaaaaccaaacaccacatattctcactcataggtgggaattgaacaatgacaacacatggacacaggaaggggaacattacactctggggactgttgtggggtggggggagaggggagggatagctttaggagatatacctaatgctaaatgaccagttaatgggtgcagcacaccagcatggcacatgtatacatatgtaactaatctgcacattgtgcacatgtaccctaaaacttaaagtataataataataaaataaaaaaataaaaataaaaataaaagaattctaaggagaggtactgatccctgataagaatgaatgtggagagaaggtgacggtgccgattttgattgcttttctccagcttactgaacaaacagactgaagaattactgcagagatatataggcaactatgtttagctgaaataggattgtgtgataacagcaaattaacagagaacatctgatgaaagcaaaggaaaacataacctccgcaaaaaaggagtataatatacaattcaaatatagtcctgattgggaaggaacattagtatttaactaaagatatatcattaagtgaaataatgtatggagaaagaaacatgccaattgttctataaatgctcatgtttgcttggaaatatattacctgtttttcctaagaaataattttgataaagtgttatgtattcatttagtaaaatattttgtcaataggaccatgtttgagtcaggaggaccatatcttattttacatgctacttaaaaatgcaagaacgaaataggaatgacaaatagaaagagagtgtgtagttgtggcattattgttcctacaaattggaggagtaattgatatggagataagaaggaattaatgctgtgaacaaagactgagattatatagacaagaatttgagatacgtataaaaacacatttgttcaacctattagctaaataatatcttggaagtttctctctcttgccatttatcctgctaatatgttcctgatcagtttaaatgaccaagtgtgcataaatctacatggcttttcattcttttccattggcaacacttcatggaaagaaactctacaggagagggttagaacaagttatgaacaagttaggagaattcataatccatcaatattgaaatatttttggtaagtataacataatagaataccctgtgttatgttatacatgatagaatactattattaatgttgctaagtaaagggcttcaagctccagcatttgccaaaagactgagaggagtttgcaaattaaatttgaattaatggtgtcctggcaggagcatgtaaaggagtcacgagactaggttatgccagatactaaaaatttgacattagagaaatcattcaaactcattggacattcacctgtaaggttttgtctttatttctttcattttcctaattagattacattgctcattatattaacatgttttgagaatatatatttttatgtttttcataaaacattttatatgtatatatatattttatatgtatatctatgtgataccacatatacattaggaaacctataataaaaaagacagaagataagttttgatgaggatatggcaaaaatgaaaccttcgtacatgatttcggggatgtaaaatgatgtaactgcttagaaaaatgccttaacagtcttcaaaaaattaaacttagagttaccatagtacctagcaattccactgttaggcatatacttttctgagtctgttctgtgctgttacagcagaatactatatactaggtaatttataaagaaaataaaatcatctcacggtggaaggcaggagggcaagagagctcgagaaatagcaagggagatagagatggccaaactcgcttttataacaagcccactgctgtgataatgaacccacaataacagcattaatttattcatgagggcagagccgccatgacctatacacctgccgttaggtcccacttctcaacactattgcactggggattaggattccaacatatgaaatttgggggacacattcaaatcatagcaatgctcaaaataattgaaaacatatgcaaacacaaaacattttcatgaatagccataaccacattgttcataatagcccaaagtggaaatagactgaatattcattaattgatacacaataaacaaaatgtgacatacccactcataggagtaatattgatctataaaaatgaacgaaatactgactcatgctacaacataggtgaatcttgaaatcattatactaaatgaaacaagctacacacaaaaggctaatcattttatgattatatttttatgaagtgtccaaaatagacaaattcatagaaacagaaagtaggtttacaaggaggcctggaggggaaaatgagatgtgacttctaatgggtatctggtttcttttgggttaatgaagatattctggaattagagtgattattgtaaaactatatgaatatgtgataatacactaaattgtatactttaaaaggtgaatttgttgttttgtgaattaatctcaataggcataaagtgattattgtaaaacttttatgaatatagtaaaatacactaaattgtatactttaaaaggtgaatttgttgttttgtgaattaatctcaataagaataataaaatttaatacattataggtggaatttaaggttaactgtaaaaaataattcaggttctacatttttatagttttatttatgaattttgactagagaaagttaacttagaacaacaaatttactatttcttaagctttttataatcactttgattatattagaattataatgctttattaattaacatagactgtgtgtgaatggaaaataatttcaagtttggaaaaagatacaactgacaaagagtttatattcacaatacactaaagctcacttaaatcaataagaataaactaagaatcttacttaaaattgataaacagactcgaacaggaattctcaaagaggatattcaaatgtcagatatattttaaaatggtcagtcacattagaaaatgctcatttatccttagcaagttaagatgaaaactatgtattattgcaaacaaatcagaataaatagaattttaagaatagtaataacaagtgttggcaacaatgtaaggtattagtatatccaccatattgctgatggaagttcaaatttgtataattgtattagaaaactcttaggcattatctactaaaaatagacatatacataccctgtaacctagcaattctacccgaagtatcaacgagccaaatgcaaaatgcctgtatgtatacaagaagcttcattgcattgctgttttagcccaaagtccatcaattgtagactgacgaatagatcaacgaatagattatattagattttcatcaacaatgaaaatatatgaatagcatataaaaataaaatttaattttatctatataatgtaaccagacatgttattaatttaattaaaaatacatgcaaacctaatatatggtataaaaagtcacgattttgatgaagtttaggaagacaagagcatttatttactagaagagaacataggaacttctaacatgctggtaatgttctatattttgagttaggtacggttacgtaaccactgagcagacccattgtgatttctgcattcttttgtatgttgtgcttccatgcaaatgttatttaaaatttaagttaacaacttatatacatatgtgatctcatatatatgaatacttctgtacaaaatcatatctatatattatttataaatacattatatttaaaatagtctgtgttcatagctgaaaaatgcattacatgtatatgatgtaaaaaatatagcatttataaataccaagaaaaagttctaattgaatgaaacacaacctttagcagtgcatatttctgggtattggcctgggatggaagaggctagcagggacactcagtatttccttctgaaaaattaaaattttattctactgagatcactcatgtattacatatatgaattttaatacaaaatgataagcaacattaaatacattttttctcattaatgttttcagaattataaaatttaaatcatctcagtatagcgtgggaccattacagaagaaatgctcggtggtaaaaatcagtcacctgtgtcaaggcattttcagacagggaacaatatttagcaagcaataaagtacaatcttggcaataatttctatccctatactctacactttcttaaatctgcaaagtttaaaatcttagcaagtttttaaggtattcagggcagtggaattatgtggaagcatttctctcataaatctgttttaaaattttacaattcaatattttatgatcctatgccaaatctatatggcagatactttctacatttcattcttcttgacagcagtggccttttacccttgttttcaaaagtagaatgtaaccacaccaggaaattaaaaacagcattatttagtgagattctagttattatttttctactcaatataggtaatgcctatgcttaacatgctccttggcactattctgtaattattgaagtttcccaccccctgtaaaataaaagaatacttttaattaatctatatattcagtattgttccaatcagttttatttaaagcaaaatgaataaaaatattttttcaaagtctcaagtgataaatttagaagcaagactgaaggaggaaagaagtatttcttttcattgagtgcagcatatttctaagatttgtctgtaaaataattggaataatagaaaaaatccatcaagtctgtcaaaatgacagcaaatttggaaaaaagtgaggatgggcaacatttatataaaatctattagcgaagcagcattggttagaaaggtggtaaaatggctatggttaaagaccaggataagtggcttttcttctatacaaattattgtttttgagttctttcatattgccaagcataaaaattcacctaatttattcaataaatattcattgaacatatactgtattctagatacaaaataaagtgttgtgaaaataagatgtataatgttgtatggctgcttgtattatgagaacatgattgtgaaacttagtttctttgagatttcaaaaatccagaaacactattataattcaagctgagtatagactacaagttctctagagaaaagaaaatctaagttgatcatattatttcaatgtattctgtctaggaaatgtcacattttatgcggccctggctattttattttctactttatttttctctctgtaaatattttcttgtgttcacttctgttacaagttcacttctgtctaaagcctcattttagtatatggccaaaatggttacatgtttctctcataccagtgtgtacactcttcacaatatgactcctgcaatcaagaggaatttatatctctatgtctcaaatttatttatgtattgttttattttattttaactgacatataataattgcatatatgtatggggtagaatattatgttttgatacatgtatgtattgtggaatgatcaagccaggctaaatttagtttgtaccgtgcaaattggtttggccaaagtgacattagccaaggtgacacagcagaggctttcaaagtggttgctcatcagtgcttggccagtcttgctgttgacaacgttggactatcacgtaatgaagcccaaaacagcctcatggaagatgagagacatggaaacatcggcccaactgagctaagcttctcacctgttccaagagagactggtcccctgctgacctacaagctgactgcagtcccatgagttatcccacatgagagcagagagaaaatatacagccactcaaagaatcatgaggaattatatattgttcttgttttgagtcattaaatttggcgtggattttatgcagaaaaaaatacaattactttgattattgcatgtatcatcaattagggtttttcttttgcattcaaaataaatctaacctaagccaaacttgctcaagaagttagaaaatattttgcttcacctaagtctgaaatctagagacacagtttcaggtgtttatgtaaattgatcaaggtttcaaatgatactgatgaagagagcctgatttttctcttttctcagttctgcactctgtcattatatattacttttgaattaaatcattgcctgtcttaaaatgggtgtatttttatgattcctaggaaattcttcttgggttttattgacctcaaatacactaattgtctttactctagatcacatgttacaattcttagctggcttactgcccccatctgatatataaaattactcagaatgataacaagtattttgtggaatgaagggcgactaaattctacatgtcaagaacaccaggtattcactatatgataagttagttgactccctaatgaacgtttatcagcattatgataaactacatgagtatctgaattttagtgtcattttctcccagaagtcttcctaattccctgtaccaggtttagggcctcaagttatatgttcctgtttcttttaacgtttgtttgtttaaataaacttagtcaattgtttttcgtccattgccagtagacccatgagggcaaaggacatatttttcttgtttactattgtgacttcagggtctagcaatgtgattgccaaataaatccttattcaatgaataaagagtaaatttaactgtttccaaatttcaggctctgttgaacacaagaaggttcaatctaggtttatgtttagggttatttattcaattatttgtattatattaaaagatgtaaatttagtctagaaacataaaggccataagttattgtggagaaaaaatattgttttgaatccaacactgttgttgagtattcatttgcatactctaattacctaccaacttcacttgacaatgttaatattttaatgttataattcacataattttgatgtggttttgttgtcagaaaatatggtgagcatattcatctgttgaaacctagtctacaatgtaatattatttggtgatggggcctttgggaggttattagagtaagattaggtcatgagggtggggctttcatggtgaaattaatacccttgtgaaaaagaggaggagtcacaagatctgtatatcgcattcccagtgtagacaccaaggaaaggctatgtgagaaaataatgagaagatagacatctaccaaccaggaagagagccctcaccaaaaattgaaattcactgagggagttgaatagataggcaccttgatcttgaacgtcccggactcctgaactgtgataaataagtgcttgccgtttaagccacccagtttatggtattttgtcatagcagctagaactggctaagacagcattttaatctaattatgatcatattgtagtgtacaaggtaaattgtttatataattgttagactagttttggtagtgatgaatgtcactcctcaaaattcgtatgtaattgcaagtaatactaatttcttgtgttttaaaattgttctctctatagatttttttcctatgtatactctgaaattggagttcttaatttcaatgcatttttgttgtttgtttattttaatccattataacaattttatttaggggcttcatatagtaagccctgctatatttattcaggaatttaaacacatgtaattttgtttcaatgattatagtaataacaataggtgattttttccagatttctgtttgctctcatatattaatatttacacctaagcattttttgagaacctacaaaagtgttacttcttccaaaaacctctgtacttcagaccactctgaatgcccttccctgaatctataagcttcagggaatttcattattataatagttttgtacccattgaaatgatctatatacaggttcttttcattcagtaggctataagctccttgatgagtgaggcaaaatattgttgagctttttatttctagttattaacacaggatctttaatgtagtagatgtttaaggaatactttgaactcgatcagctttaggtattagacaataatttctaatttataatataagaaataatttaaaatcttaatagaataaggattatgcagagacacagatatacgttctttatgcagatataaaagccaaatattattctgttataagaagagagtaaagcaggtcgatgctgttgtaagcccacttgacaacatgtactttttatataaaactaagttgggtgtttttaagcttatccctggccaagagccagattgaaggaaaatgtaccatttaactgaagatatggtcttatttaaatctaaaggccgttattttatgtattcttttaaaactttgaacccaaaatcctgtaaaatatcaagatcttaataatatatctgtagggtattgataatttgcaacatcaaaacttctgctgagtagattttgagtcatatatttaaaatacctatactattttataaattagaacatttaaaacatttgaaaatattaaaaatgttaaaaagaatttcaaagtcagtaggacaacccttgctagacttcccctcctgcaatgcaccatcagtctggaaaattgaaaaaagtcaaggtttgctaaatagctgttgcagaacacaattcttaattaagtcatgcttttggagttataaactttaatatactttttcatggcattctatattttacaatagctgctcctctcagaatatatatcctctgacaacattgggcatattagtcactaatacatagcttcatatttggaaaaagaaaaaaattataaggaaaatctccacatatcctacaacaaagagttacatcagagagcatgttaatactcataataagcttagagttctaccaagtatatttcttatgtgccttcaaacatagttgtgcttctgcatcagtagaatattatgctagaaactctgttatgggctcaaagaggaaccccattattacaaaaggagttctataggtaaagctagcatattgcaatgtaaccctgtctacagcgccagaaatgtgtattgagagctccattaggtgcacaggaacacagcagtgacacatttaaataccaagtgctgcagaaaagtgccactagcttttccaagggactgaaattgggcagcccagatttaaactgtggttttaatttgacttatgattctcttgccctctagtgggtctagaagttgaaaatagatgtctgtattactatatattatctgtgattcttgtagagattgaactggagaagaaaaatccttagacttcagtccctgcaaagccctcattgacttaagaggaatttatcaatgtaaagggattggtttattactgctttaaacccctcatgtatcacaaagggatttgctaaatactttcatagggactgctgtgtgttgccaaggggcttcagaaaagcactgaaccttttggtgattgaaatgtacagtcctgctgcaatgaagtaacataattggaatcaggactagatgtttttataggagctgattatgtgcagttccaaaagtatcattactttagcctgtcttatccttgagggcataagaacacttaaaaaagggctttaaatatgatggctgctcagtaggtgagcaagtctttggtgagaggtgcattagctataatttataaagtgtagttggtggcatttaacgttctaattatatgtaataagatacgttaaatggtaatatattgtgtgtgctatccaccttttacaaaagttctaatccatttatactactgtgatctattagagaagcacagattcttcttcatggtatattaaccatatgaaatattagggtaattgaagcctgaatccaagtaattataaatctatttattgaaaaaaatcattgatatgcctggcatgaacaaacagctaaatatgtcaggtagccacagagcagcaagtgatataaattttaaaatccaacaatttaagtttcaaattagaagttttgtcattaatgttctcataaaattatattgtgttaaagatctgtgtaatacctaactccattaatattttgagtattattttttaattggcaatctagaattcatgttaaatatgagtttgcttattaattacaagtaaatacaataactaaaaaataaaattctgctatgacctaatgatcacttttcttccccacaagatgcctaacattgaaaacttttgaaaatagcccataaatgaatctttctagcgtagcttccaacaattgtattttctaataatatcacttttttaaaaaaggtggatgggtgattaaaataaatgaaatcactggatttcatttagactaacactgtaatctatgagtagatgaatgcttacttatgaaacaggatgttaaaacaggctaataatttatattcatagacaactgtgagaattacagaaaatatgttaaggattatttttaattagaaacaataaatcaagtcaaatttacaagatattgtctatttgagactgtgacgtaatgactgggtgaaaacatctgaagatatgctttttacagacaccaaaccagaccagtctctgtttgaagacatacatgattacttttgaaatatttttagatggtcataacttcataataagtagtttttttgcaacttacttgcattgcttatgtttatagcaaccactatgtcctcctccagaacattatctttcaaacttgaaataatcataatcataattaatataatgacaatggatgtaggagaaatacaaacctaatttttattctcaatgatgattatggatagaataactaaacccacatgtgtattacctttccccatagacatattttacactttggacacctaaagtccagctaaaaagaagtaattgcctacgtcccctatgacggaaatccaaaatatataataaatgcatttagctcatgaacgatttttaaatttctgtttgatttgttgctggagatctcagttactctctttcttgttaacacatccacacccaacctccaatacagctgtttacatgaagcaagagattgggaagcctgagaatgaatacctgattctagctgggcaaataattttgtgtttctttgaggagtttggaatgctgatagactgaattaggtaggcataaacaacagtttcaagtgtccatatatttggcactattgttgctgacaatgacagcttaaacaatggtcaaatgaaaattgtgaaaaacaaaaaaatgaaataccacgcctaagtagccactcttcagagaggaaaatttaaatgcatagagagatgaaaaatcttgcagccctgcaaataaatgaaggtgctctgcaaatgtacatttctaatgtggccacattatattccttgtaattaattccttcatattttttattcctatttcacttaaactcatttgaatgggcattattttataataaaaacatccttgattatgattctgtattaacaaagataatcataccaaaatttgtcatttttttagtactcacaacagaattattcttttctagagaaattaaagctataggggctttttactttcaacattattaaactaatattttgttttaattttaaatgagaagttaattgatattttgcttgtggagtatgctgtagaattattttagatacaataaactattatgatgtttaattttgtcatttgcaatataattatattcatttgtatcattgagttttcagtgtagtcagattaagtaatacagaagtttatttctctcacatacaattttccaagtagacaagtggtccagggcagctgtatttcatgtctttatctggatactcaggttggcaataacttccgctcacctcaaaaagctttttttctactgtttgtccaatgtagtagttacaaaactgtccattccacaaccagtagaaaggaataaaggggaaattaatgacagagctttattctatggaaatatcatgaaggtgcatgcatgccatctgctcatattgctatagtagggctttatccgaatgctcatacctagctgtataaggagtttttttagctttagccttcagacctgctaaaatttggatgtggacggtttattagtaaaaggaaaaaagacataactattggtgagaaattagaatctctgccaatgaacaatcctctcacttattttgtatgtatctttcttgtataacaatagtaatacttagaaatcataggttgatggaggtagagactttgtcaattatcaatggaatgagttttcactcatttaaagattctattcaggatatatatatatgcataaaacttatttggaagaagaaatatattttaatacaacaaaatatgtagtattaaataaaattaaatgtggattaaattaaatatcaattttaaaggacatttttctcattacaaagtttttcttattagaaataacttattagaaatattgcaagtgctaataagaaattgaataagaaatgtggtttcagaagggaaaaataaaaacaagcaaatgttacacaaagtagaatacattgccatttttgccataacgttctaagaaaaattgtgatgaggtaagaaagcactaaacaaaaaagtctatattcttaaaatcactacacttccacaattttaatcactgatgaacaagccttatggcttaggagaaactggagaaagtaaaaatgaaaaggtgtttcatggattagaaaggtattgaccttttgattctccgtttaatttacactgattgcatcagacaaggagggtaaagtctacaaattatagctaatgtgagaaagttagaaataacttaatatagaagttagaaactaatagaaaataagtttgtggggtttttttttttcctgacaacaatcgaaatcagctttcttatcaaagtggtagaaaaatagaatgatataaaaggcattaatatagggaaacatgcacgatcagcaaccacgtcttctttcattccaagaaaaagttttacttcaaaacatcagaggtttaaaagaaaaatcaaattttctatgtggattttcgggacaatatccaaccagaattacctcttcaagttagtgtgtttaatatccattcaacctggcctctttatggaatctttctttagtttagctgtaagaaaataggcttagaatcaaaagtcccagaatctcaacaaacaatgtcatagttatatgatttagggcaaggccttcttttccctgtacctttttttttttttctcttaaagttatatatgaaaactctttgaatttttctctgggacgcttattaaagaaactgcatcatattgctgttgtgtattgcggtgaagataggaaaatgcgggggataaacaggaagcatctttcaagatcatcaattactagaactttttgtggaaggaaggaccattattgatatatgaaaataaataaattatagaacatgagtaaaaatttgcattaaggtgaggtaataaatatgtgattgtgttcatttttgaatcttttgctcttgacttatacgtgtcttgaatactatgcagttctttttttttatactttaagttctagggtacatgtgcacagcatgcaggtttgttgcataggtatatatgtgccatgttggtttgctgcacccatcagctagtcatttacattcagtatttctctaatgttgtccctccccctgtcccccagcccccaatcggcccgggtgtgtgatgttccctgccctgttgtggaaggcagtgtggtaattcctcaaggatctagaacaagaaatactatgcggttcttaattgcttcttttccctgttccccttcaactccattcaactctgaaaactttgttgaataatgtgtgtttcactgtacatttcatgcatagagaaaagtcactggacactacaagtattttgatatttctttttgccttctaattttctccctcatcaatgtatttcaccagcactcagtcctgggctttcttatcattctttcctttacacaaatactatgcaacacaatttagctttatttccacaacttgaatgccatattcaatgaaaaaaaattttatttgtccagccaaatgtattttttgtctattattcctcaagcatgctgccactgaagtaaaagaatgtatggctcagttcatcctaatacaaaatattacataacctgcttttaataaactatgtatgcttacattctccctctgcatttaaaaagattggctattagaacaaatcctagaaccatgcttcttcgtttcaaatcctgtctgtcacttatcattacacagtggagtaaaataagtgtcccctgttattactggtacttgaattaaaaagttttagaagcagagaatggcagaaaagctcacacgaggagggttgaatttgaattctgggtctgatgctcacgagttgtgtgagttggttgagtttgcctgataagtttatctagaatccatactgatgggacaggcaaatcattactttgcctgataagtttatcaaattaattgactatcaaattaattaattatcaaattaattgactttctcataagtagagcttcagtaaaggcttaggactacatttgaaattatgttattttttaaaatttaagctgcctaaaaatatgttagaaaaatttagtaccatagtaaaaagtaataattgatctttccgtggtaaatcatagcatattatgttactgataaatttatttgtgtatgtatatatgtatatatacttttggaaataagttgaaagagtatttcaacatgaagaaaatgagtatatttaacaataaaaacattttgaaaaaaacaagtatacacctaatttgtgtattttagagggtttatgatcaatatcaaaaaatggtaaatcagcttgtcaacaaagaagagatactggagacatggtaggctaacaagtatgactccacttctcaaacccctatgctttatttctgaatcaatattcttggctgactcagaaaatgtattaaaacaatccatatgaggaccaggtttctgaactggaatatttcaaacatgtgtgctggaacttttcacagcatttaccatttccttgatttactctccaaaattgatataacagttgcagaaaacatcttaaggagtacactgagtgtgaaaaatgcttcgtgagctggaaatattctgaaaccttgtgttttttttgtggagtaatagaacacaaacatcttttggtactaagataaatatgctctcagccaagtgtgtctttgcttttgaaatctgatacctgagaatttaactaacacatttctaattaattgacttcctcataaatagagcttcagtagaggtttaggattacatttgaaattatgtttttcttaatttttgtttaaatttagctacttgaaatatgttcaaacattttgattctaacaattttgaaagcccataataccagaaatgtcacttacatgggtataagaactatgtgtgcattttgtttatatgtgaattgacttctaagaagaatcacatcaaccaacttttgcatcctaaaagtgagaagcagaaagttagaattcacttgccatatcttccattatattctaatttcaaaaaattaccagaaaagagggcaagcaaatattaaataaaagcaaaatctggcatacaagtcagtaagtggaaaagtctaaaaggaatctgtaagaaaaaacatataaagctttgagtgaaaacaatgtaagtggggcaaaaagtaatgggctttttcttgtatcataattcttatgctgaaatccttcattatagaatgtcctcatgaccatagggagaaatgctctttcttcagtaggatatatttaaaaagaggaagtaaagaagggaatgaaagaagtaaaaaaggccttaagagccttagatagcactctcaagaatttaacttcagattatagaaaaaaagaaatacaggaaaattagaaaagtaaaagcagaaattaggtgataagaaaaccggataactatagcattcaaaagtaacagtgttttatttcattaaaatatactgaattcataaatttctggcaagtctaatcaacacagaaaaaagttaaagaaacttggaatgaaaacaattataactagcatgggagcaattaaaaatatgagaatgttatgagcaatactatactagtaaatatgctggaggattttattaaaaatgtggctgaaaagcataaatcttagaagcattctaatgcttaaaccagcaaagcaaattaaaatacagtgaaatattttcactgaaaaggcaccatattcaagatgttctttgaaaattaaagcacacaataacctaaaaacagtggttccccaggcttatagattactatgattgcagaattttataaattattcagtactttttaaatattctataaagaacatagcctactttaataatcatgaagaaagcttattaagaattatttctgcctttaaaagttggaaagcaacatacttaggtgaattaatgatcacaacaattaatgcacccaaagttaaatgctattaggtcaaatatgagatatatgcatgcagatagatatagttaacttttatgaaggcatttatacaaaatgtactgttagcatcaggtgttaaatcaaatataacttggaccaattcataaattcagtctctacatgctcagaaaacaattattttataaagcaatcaattgaatagcagaggtttaagtaagaatttctcaatggcaaaatcagatggatctgacaaagtgtttagcaaaaaacatctttgaagatactttgtttaaaacacaaaacttccattaagtttcaagagagacaagcatttaaggacattcttatcctcttgtctatttgaatcattatttactagaataatcattactaggaaatatgcctgattcattttcttcacatgcttactatatgaggcctgacatatcacagtaattactgtcaagaggattactattaaaagaattattttctctgtaaagtgttttcacttaaaacaaaaagaataaaagtagtcattaggtgcctattatggaatgatctgctctgaaacagcctcacaaactctctcttctactttatgagcttcagatttcactgatcaaatgtcattttttcaaaaagtattttttttaccacttgtgttaaattgtattgttgttcacaattattcactcctccgggaaaattatactttcttgtccagttgactttaggtttggccatgtgacttgtgttttccaatagtatgtgatgcaaaggcacttgtgttcttctatgcataaggcttaagcatcttcacattgttgccgagttcacatcttccctctgccaggatgccttctaatattctgaataaaagccgtcctgtcaacctgaacaccagagggaagacaacatggaaaagtgccatgtttgacctatgattaatgtgtaatattagcaataattaaatgtttattgtcttaaacttctgagatttggggtttgattgttatagtataacctagcttattttcagggattattaccttatataaaacagcagatacgcttcctctaatgtgtttcattttttatagcacttttttttcacttaacatgtatatttatatatttattatctttcttcatccatgggaatctaagctccatattttcatttgtgaatccccagtgtctagttcagttattctagtaattattattcagatggaagttgcaggaagaacatctcaaactaaggtggaaattctcccaaaatgccagagaagagatacaagctgctgaattagatcaacttcaattaatttttttagctggagggaaaagaaatgaatcaaaatgggaacgacagtaaattggaggactagcttactgcacttgtgtagtcttgatccaatcaggacagggaaactataagtaattcgaacagggcaagtttaatatatagaaacattaaatattaaatagggttggagtaatgaagggtaggatagtaagaggaaaactaaataacaaatgtaagaagcagccagaagtacaaaacaataacaaaaagaactagggttgagataggaagatcagaaaagagacttagctcctctctttttccccatccatggctgacatttagaactcattggaggttatggttctgactccctgcctggcagagaagtcactgtggttctgcacctgtggaacttgctgaaaatatgtcctttaacagaaatatgttgactaaatagtgtcttactgtggcattctactacaaaaccatccaagaaggtttgctgggggaattaaatgctggtctctataaactgcaagagcagggtgattaaaaaaaaaaaaaagctacctacattagcatgtcagaacgaggaagcaaaaactctttcctcttccagtgtctgtccagcaccctctatttacacagcttgaagtcatgataacaaaataaaataacttgtagatcttagatttactttaacagatcagacaatgcattatgaagttggagcctaaaagcagtaagttgataactgacataccggacaagagaccttgatgatcattccaaagaagtgaaaagggagtgtaatacttttgatagatgtagagccattaacaaagtagattgacgggatttgataacagattgtgtatgtgattgaagaagaaggagaagtcaagaacccctagattgtactgtggatgattgatgccttggaatgtggaattcagaaagaaagcaatctccttctttgatactacaaaaacaaacaaacaaaaagattcaaagagattttcagggaatgaagttagtgagtaacatttaattcaatacatcaaattaaagatatgcattaaatatctatatggaagtgtcctctgggtaattgaatataaagatctggagttcaggaaagagatctaacctgggatacagatttttaaattttctacaacataattattaaatatttcatatagatgctagcagagaattgctaggtaacataatagaaactggatgatattagcaaaagtgcagtgaaggctgctaaggacaggtaccctagaggacactaatatttaacggtacccttttattcccttggcttctgtcagttaggatgtttaattccatttatactcttagcagggtcagcccttatgtagcacagggagggtttgttcctagttgggacattctatataccatctttttctgatttatagcaaaccataacatgcatgccttatccatatgtagaccatgaattttaaaagcaatttctcatacaatgagtgaatgatgtaagctgtcaggaagcaacatcatctcaataaatcaagagtgacatctgcatggtgattcatagccctgggtagaataaactggctctctaagggtgaagtttcttgggtaaacattcttaaatgagttagtacaccctctggggaagtcagagagctatggttaaaaagtttatgggtaagaagacctacagtctccccttgatagcttgggttctttctatattaccatcactgtagtcacagttgtgttgatatttataaaggaaaaaaatgtaaagaaaacaaaaagaaaggaaaaggaaaaagccaaataaaaaaatcagtataaaaaagattagattttaaaaaatcacaattttcaaagtaaaataaaaaagaaatattaaagcaaataattttatgagtaaacaaataaaaatatataatccaagataaaagttaaagcaatgagatttaaagtaaatattacaataaataagatacatatttaaaatgtaaaaaaatcatcttaatgtcataaggtaaaatataaatatgaacctatcaaattaataaccaaataactacaaaatataaaactgtatgttttttaaagctagtaaaacataaaattaattttttaatgagaatagaaaacattagttgatgaaataaatactaaggacgtagaaggtagtccaaggtgagttaataaagtatctttgaatgggaggttgtctgggtacaactgaagcaatcaaacataagaagggactgggcatgatgctcatgtctgtaatcccagcactttgagaggctgaggttggtggatcacttgaggtcaggttcgagaccagccaacatagtgaaaccttgtctctactaaaaatgcaaaaattagccgggcgtggtggtgtgtgcctgtagttccagctactcaggaggctgaggcatgagaattgcttgaacctgggaggtgtaggttgtagtgagccgagattgtcactgtgctccagccagggcaacagaggaagactccatctaaaaaaatcttaataataaataaaccaaaaacagaagcagggcagggatatgtactcttctgtatatttagtttctaatgtgcagtccaccacattggactaacctaccctaattacactgaagaatggcatctaatctacttttaattctagccttcattttgagtcaggaagacatgaagacccctactcccagtgacctactaatacttaggcattaatgagcccaaggctctcagaaacgtcagcatgctcagaaaatcagagcaatatgagattaactcatgtatcccataagtcattgttttataccgaatacaatcacaaaattatatttggaggaaaaaagaattaaaacttgaatttaaaaatctaaaatcttagcacatagtcttggcatggcttggggtgaaaaattcatatgtgtttattatctatttatctcagaataacttgaagaataatctccctatgaagattatagacacagaagtttaggcaatgacctatgtgtgttatcaacctttggttcatatttctgccattacttaataaatcctaggagcatttgtaatatagaatgaaacaaataattttgtaattacaaagttgcaggtttgaatctcagttctattccttactgattgtgattttttttcatgtctcagatcctcaaacctctaatatgtaaatgataacaggctgcaacttgtagggctattcagaagattaaaaatggatacaaaacatctggcatagtgtatgacagagtggatggtagctctcatttgagttgttatacttgtagctactgagtttgcactgctctaaatcagcattactctttaatcataaactaatttgatcactagtaaggttttgaaaggccacaagtaagccaattaacttcattaattcgtgtcaaaaaatgaacactattactctttctagaaatttcagttactttcccttcaaatcacctgaaagtcattagttaataaaatacatatttgttaattgcagttaaagtaatttccatgctgactaacccattaatccaagtgtctttgacattagtaaattcttattcagtagctagttttgtcagaattaattgattagatgaccattcacataaaaataagggccaggaactgtggcttactgttgtaatctcagcactttgaaagaaagtggaaggtggattgcttgagcccaggagtgaccagcctgggtaacatggcaaaactctgtctctacagaaaatacgaaaaattagttggacacagtagtgcatgtctgtagtcccagacacttaggagggtgaggtgggaggattacctgagccctggagttacaggctgcagtgagccgtgagcacactagcctgagtgaaaaagtgatacctcctctgtctcaaaaaaaaaaaaaaaaaaaaaagaggaaataaagaaagaaaccaaaagaaaaagtaaaagaaagaaaagaaagaaagaaatgaaggggagatggtaactcaaacatgacagtgccagagtacgtgtgaaacttagtcatttatcacaataggatttgcctccaaggtaagaaaagttgttttaagtgttattgatttttacttgaaaaaggtgtcctactgatttttgccatctagacccttaactatggcttttagtaaactattcttgtctatattgacaaccatagaaaactcaggaacagaaatgtgatggtcactggtggagaaaggggaaagtgaggtttcaaaaaatactacctaatagccccctcccctatgcaccatgtttgatattatttcagttctacttacttctgatggggaaatacaaggtttttagtttttttgagtgaagctgtgtggtgagttaaacagaaaaatctatgcaactcaatttgctatttcaaagctcctatgcttgtgggcaaagaattcttggatttctgccaacactgaagttcaaattatttggaggggtaagttgcttgagtttctgtatttcttttaatcaggctttgtttttcacagctgtcattagtcagttctattttattaccttttgggacttggcattcaaacatttggaaatgcatttattcagtcagtataaaaaacaaacaataacaacaaactgctgggattctgaacactgtttatcatctggcattgcacagtcaattttttttttttttgtacttcaatgaactacttctacactgctactcaggtgtaacatccggagacaatgtctttatttccctttctcattttttctttctcttttatactactttctctctcactctgtcctccccttcctttcttcttccttactctctcctttcttttcctttccttcttcccctttgcaggattccttctgtctcttttcatttaaatttgaaagctcaaaaaaatgacttaatttgaaatttcaatatttgtgcaaaagggatttgtcagaaaatagaatttattattttatttgtatcaaattttgagcaaaacaaagtgaaattgcaaagacaattctgtaaatgtgtgaatatatactatatcaatgatttatgattttagtttgtgtagaagcatcataagttagggaccatctgtagttaagaatgctatattgattttttttccagctccatataaaaatttgatttccagacgttgattactgcctgaaagaagaaaaggttaaagagacaaaaaaaaggtgcctattatctggacaagttattaacctaaagaagattaaaaaatcttattattcaaattactacaaatctgtagttatgtgttctaacgaatcccattaaatatatttactatagaaaaaaacaattccggtttctgctttgacattttagttaactgtaaatgccaacattaatataaactaacttttttttggatagaatcagacacattattcaactatcataggtcatctaattagttgtgtcataatatctgaataaggttattacatcatttcatgtatcagtatccctcattttatgcttgatgatcattgaagcaatgtaagttgccttcagtcacgtagagtagaataatcaataatctagccccctccccccaccaccttgttctatctggtccatgttgtactttaactttattaaaattagacaaactgtctttaagaagatgatatttcagttaacactcaagcagcgaagttaacaataggatcagcccacagcataagtagtgtaatcgacataggggatacagtattcagtggaaggccagccccaagtgaggtggaaaacattaatgggtttgaaaagcagtccttttcttctctacaattttcttctgactgattctgggaaaatgctgagacaattgaaacccattatagacacatgattgtgttggaaaagttatacaactttttttcttttttttttgagacggagccttgctctgtcacctcggctggagtgcagtggcgtgatctcggctcactgcaagttccgcttcctgggttcagggcattctcctgcctcagcctccccagcagctgggactacaggtgcccgccaccatgcccagctaatttttttgtatttttagtagagatggggtttcaccgtgttagccaggatgttctcctgacctcgtgatccacccacctcggcctcccaaagtacggggattacaggcgtgagccaccgctcccagccggaaaagttatacaacttttatacaaaatatacaatatttttaaattatacaatttaatgcaatttcgattcttcttgtttggaatcataatgaggagaggatttaagagtgtcaaaaagagtaatgttaaagaaactgatcgttttcctcaggcaaaattggagatgactaattatactgcctaaagttgagactatttttgcttgcatctttatctaaaagaaaactattgaaatagtttcaagaagcacaaaaataacagaaaaataaaccattatatatgtggggttttttaagcctccataatatttcaattcaagaaaataactacattttttaaaggcatattgttcaaaattgtcttcctttttcacttggccaatgaaactggaaaagtagtaatcaaaactgcaattcttaaaacaagcttgatgcaattttgattaaagcacttaaaaaatatgaggcgtgcttcttcatactgtcctctatttttgcagacaatgtcacaaaggtaccattagattcgtagctggttacaaacctctaatttttagctattctacttaagacctgcactctggcaccattaccctaagacttttctatagctctaagatcaccattgtcatttaagcctcataactaagaatgaactttgtttaatcctcaaccatgtaactcctcttctaatgtaatctagtcctccattcagccttaaaatattgttgatgtgtcatactgcattaaaaaaaaattctatgtgtccacaacactctttccttaacatcttctggcatttcatcacttgctcttttgaaaaaaaatgcagaaaaataggatctaagtttgctgagaattattactttattaatcttttttttcacaaaatgtcatctgctctgatgtgagtcacaaaaaaattatttcatgaaaacaagaagaatcataacaaagaattcccttgtttccccacaaatgtttttgccaattagaaacatcaacatagctttgtgctttaagaatacctttgagaaaaagatttcaagtttttttcctgaggtattatgagtttagcacaccgaccaatctttctgacatacttcaaatcagatgtccttaaacagtgaagcagcagtttttccctgaaactgatatttggtaaacatttatcaatctaataagtagtaaacagatcataccataaagatgaaaacatctttattcaaatttacttttatagtactgaagcccaatgctgtcatcagaatcaatagaaacttgtgctgaatgattggttacttagttggaagggattatacaaggtatgtattttacaagcactttgaccatgtgacatgcataaattgctctataccactgctgctgcctatttcttatatgaaactttcatggtacaaaacagatcagggcatttacatatagtctataaaatattcatggaagaaattttgttgcaaaatataaggtaaaatattaagaggaggaggaagtgtgaagactgagaataaaatcaggtagattaactaagaatgaaatcactgtgaagacacagaaaagtcttgcagtaggagaagaggatttggaacatgcttgtcacctagcagacacatgctagattaggcagaattcacacattagccaagtacaaatgcaggctaacatgtaaacgtttcagttttaatttcgagacagtaggacaaatggtcagaaatacagacctagatggaaaatcctgcaaatcactagaattcgtactcctattatctgaacaagcaagcaaatcagactgtgacttaagcaaaggaaagatttcaatgtgtaaatagcatcagtttcataagccattcagtctctgttactattaaacataatggcaaaaaccgcatttacttttgcactgacttaatactactcaaatctttccttgcaatgggaatgaaaccacagaccatatgtaaacaaatgagtatggctatattccaatacaaatgtatttatgaatactaaaatttgaatttttgcatgatccaaaatatgattttcttatgattatatttccaacatttaaaaactgtgtaaaagtctttcttagtttgcaggttggacaaacaatatatgagttgactttgacctgtggattgtagtttagtaacccatagtctaaaatataaaatatgtgtagcaagtgaggctgcttttctgatgctagaaatatgtggaagcaaggttgattgtttgcacatggattttctggtctgaaatttgtttctaagaataaatagcatcagcaacttgctatattctaattcaattcttttgacacaatagcctatggcttaatttagtgacaaataaaagagcttaaattacattgatagattgtgcataatattacttctatatctttgtatcatgatccaagtactattataaagctatcttaattttgttcccaagatggcatattaggggcttttaacatgcctcagccacttggaaatagcaagatagcacataaagatcaactctgtgagctttaattcaagaaggaaatcaggaatctaccagaatcatgatggacaccccagatttcaggaaggaagatgctggcaaacagcccctgtgatggcgtctggcagataaaagttagtgaagtcccagtacatgagagaggaagagagcatccccctgtgattcacctttccacctgggatttgggcaatccacgaggaggaagagctctttgtttctcccaagccctgaaggtaacttgggagagggatggagacattataaggcaaagacactgggaacagctgcagacattttcccagaccgtggaccaagagcagcacaccatttttaatctgtgcacatacactgtcagccattattttgtgtgactcggaagagtggctgcacaggcattttagtttcaagccagagattagagtgcctgctctggagcaggataggggcctccacagccagaactgtggaaggtgcctcagcagtagatggtggaattgtgctctcccgtcacaagcctggagcaggagaagagctgctacagctgcagtttctcctgggtggtggacttgctgccagatccagcttagcgaattagagctagtctgtgtgtgccattgcttggtgctcaaggctgctccccttagactgtgtttaagcagggccctctctgctccacccccagacagaaatccaggcatttggagcacctactcttctggaccagcagcctgagctgcctcaccctttctaacatagatcatggcacagatcttcacacacaggcagaactccaggtatttggagcacttgcttgcccggaccaacaacccgagccacaccacctttcctgtgcagagattgtggtacaggaagacactttctgctctatgcccaggtagatctccaggcattcagaaaacccattcatctggttcaaccacttgagttgccccacccttcctggacccagatcttagtgcaacagggccttctctgctgcatgcctaggaagattctcaggcatttgaagcacttgctcacctggaacagcagaatgaacagccccacctttcctgtgcagagatccaggtgcagggggccctctctgtcataagcccagtcatatctccaggcattcagagcacctgtttgcctcgttcagcagcctgagttgccacccctctcctgtgcagaaatgttggtgcagagggtccctccctgctccatgtccaggcagatctccaagcatttggaggacccattctcctggattagggttttaggctgtcccccatccccatgcagagaattgggtcagggagttttcccaactccatgactaaacacacctctgggcacttagtggccatccactggattattcattggagctggtgctcatgtctgccactgggggacctgtaggcagacctggccagtttggccctgcctatctttgccccagcacctgcttcttgggttgagggacaggggtgggcaagcagggagataagaccactttgcactccacagaatagcccattgcctaggcagcaaagaactgcttacagtaaacaaagatcaagaatatgcccagccatgttggccacagctggctcttacctataagtttcatctactggtttgtaggttgaactacactgcctaacacaaaatttggtatcagatgtgcataaggacatggaatcaaagccagaaagccctgcccagcattatctagggtgacaacccctaaggaggggagagggcaagggaaagggaaagaaaaaagaaaatcaataaaattattggggaaaaaagaaaaagaaaaaaaaacacctgaaagaaaataaatacaaaaattagaagttctagtgtttccaaatgagaatgaaccaacacaagaattgtcatcattaaaaaactgagtgtagtgacatcaccaaaggatggccctagctctccagtaatggtccataaccaaaatggaaaatcagaaatgaaagatgaaaaattcaacaaatggatttcaaggaagctcaatgaattccaactcaagtttgaaaatcaacacaaagaaagttttaaaacaatccaggaaatgaaggaagagatacacatcctaagaagaaatcaatcagaacttctggaatttaaaacaaacaaacaaacaaataaacaaaaaaactcatttaagtaatttcaaaataaaattgaaagttttatcagtagactaaaccaagcaaaagaaagaatttcagagcttgaggacctgtgtctcaaactagtcagacaaaaataaagaaaaaaagaattaaaaaaaatgaacaaatctttgagaaatatgggattatatacaccaccaatcctataagttgttcgcattcatgagagagaacctagaaaaactacttgagggaaaaattcaagaaaatttctctaatcttgctagagacttaagtatccaaataaaagaaatcctgagaacacctgaaagatactataaaaaatgagcatcaccaaggcatatggtcaccagactgtccaaggccaatgctaaagaaaaaatcttaacccttttcccatttttccagagtgctccccagtggcacttgcagctgcagcatttgcccctagataactttgcaacaaaatatctcgcttttatgattattttcgcatcactctatcaacgaatgaaacaaaagacttcattctatttataccattctatttttttgtcaacttcagaaacaaaagacttcattctatttataccattctattttcttgtagtggtatttccatttacaaaatatagtcattctcaattgctgaaaatgtcaaatgctagaaaatgtagcattgctacgcatgatgttaacatcgttcttgaatggtttttggacaaagatttatttaatgagttttctgaaataggcgattctgatgattcagacaattctcatgttagttatgtttagaaataactccaagaacagtttttatactctattttcacatttaaaatcagtcagatttgctttagcctcagagtctgtttatataaaattaaatgagtgctggcagcgagctgcacttttttttctaaatgggaaaagggttaaaggcagctagagaaaaaggtcaagtcacatacaaagggaaccccatgaagtttataatgaatttctcagcagaaatcttacatgccaggagagagtgggggcctattttcagcattcttaatgaaaggatacttcaaccaatgatttcaagataacacagagaagaaaagtgaggcccaattatctgttgcctataagaaacacatttgatctataaagatacccatagactgaaaacaatgggatgaaaaaaggtagtctatactaagggagaccaaaaagagcaggagtagctatatttatatcagacaaaacacctttcatgacaaaaactgtaagaagagagaaaggaggtcattataaaattattaagtggagaactcagcgagaggatgtgacaattgtaaatgtatatgcactcaaaaatggagcaccaagatatatgaaagaaatattattggagataaagagctaaatctcaatacaataaaagcaggagactttaacatcccactttcagtattggacagatgatgtaggcagaaaatcaaccaaaaaatggaaattaacttgtataaaaaataataaatattttgagaacatttcatccaatggctgcagaatacacatttttctagtgagcacatgggtcattttccagaatagatcatatgttaggtggtaaaagaagtgttaaaacattcagaaccttgaaataatatcaagaaacttctctgaccacaatggaacaaaactagaaattaaaatcacaaggaattttgaaaactatacaagtatatggaaattaaactagatgctcttgaatgaccagtgggacaatgaaggaattaggaagaaaattgagaacattttgaaacaaatgataatggaaacacacataccaaaatcaataggatacagagaaagcagtattaacagggaaatttagggctatacgtgtctgcaacaaaaaagaaggaaaaacttctaataaaaaccctaacaatgcatcatcctaaagaataagaaaatcaaacccaaaattagtagaataaaagaattaattgaagatcagagcacaaataaatgaaattgaagtgaagaaaacaatgcaaaacaccaacaaaatgaaatgagtttttttgaaaagataaacgaaattgacaaacctttacccattcaaagaaaaaacaagaggatccaaataaacaaaatcagagatgaaaaaggagacaatacatctgatactacagaaattcaaaggaccattagtggatactatgagcgactatataccaataaattaaaaccaaatactgcttgttctcatgtataagtgtaaactaaacattgggtactcgaggacataaaaatggcaacaatagaaactagaaagtaatagggaggttggcaggcagggaaaatgttgaaaagctgttaaatactatgcttactacctgggtaatggagtcatttttaccgcagacttcagcatcatgcaatgtacccggtaacaaacctatatatgtaccctctgaatctaaaagttgaaaaaaatatattatttagatttaaaaagaaagaaaaataaagcaatcttaggttcttgggggatatattaaaataattagcttttcttatctaaaagacacatagatgtaatatatatctaaatatagcaacatgtctaatttatctcataatagttccttgaatttcaggattcagtgccaaagtgataactatgatatctaattttaaaaattacgttcacattttcaaggtactattgacagggcttacgggaaccgttctatagaaaaacgctgtctggagacaaatcagagttttgctatttattactgtataattttgggcaagttacctaaaccctcagtttattcatctttaaaatggagatattccatagggtaactttgagttaagctatgtaaattaaatacttagaatatatactaacacaaagtaagccttttagagttgttttgtttatcattgtgagaaagcacccgtatcatatatcattccctcattctcacaactccctgagtaagcataacacacatgcgcaagcgcacacacacacatgcacacacacatacaaccacacacacaaccacataattaaagatataagaagaaaatacatagtaatatgcattttaatatatgcataacataataatattttattatgataataactaatcgcgtaattttgctactcatgttaggtgattaatataaacttgctttagataaactttaacacatcttgatcaactttcaatatattcaatatgttcaataacttatttcctagttataatcctcatttcaaacataaaatacatcttatttcaaaatacacaagtacaacaagaggcaaagttatgtcttacactaaatagatacttaaatgactgtttgacgtatatggatctgagaaaaaaaaacattatcaattagctacctttaattatatgaacattttttatgaagggaataaaataatggtattcaattgaaaggttactcttcatcttatttaaatcactctgtacctctaattgaacattataaatgataaatgatggcattgcactaaagtgtaatatattctatctccttgcctttattacatttaaagaataaattataaaataaacgtttacaagtttagcatcataaaaaacccaaattttgagacaattaaacaaccacaaaaccaaaactacagtcaaatatccagagagattatgtataaaatgctaaatatacaaatacaaaaattgatgagctattaactttttaatttttcacttacagatcaaaatatgtactttttcaatgatctagattatattttctaatattatcaaattacacatggcttatgattttcaaaactttttataacattttttcttccagaaattcttgggtaaagataaaatacatttcaaatttttactatgcattttcttcctatttacatgtgcaccataagatagtttttcagtaaatcaatacagactttttcagggatcatatcacgcctgtaatcccagcactttgtgagggcgagatgggagaatcaccagaggtcgagagttcgagacctgcctggccagtatggtgaaaccccgtctttactaaaaatacaagaaactatccaagtatggtgtcaggcacgtgtaatcccagccacttgggaggctgaggcaggagaaactcttgaacctgggaggcggagttgcagtgagccgagatcatgccattgcactctagcctgggcaacaagagctcaactctgtctcaaaaaaataaaaataataataattttaaagctaaatataattctggtctaatcatccaatgcaagtagtacacacatgtttattttatagattgtaataacaagtaattaagactagtaaatagtaaccacttttatttgaacataaaatatacactgaatattactgaatctcttgtttatttaattcgtatcagttgaagtatttactctgcatatgatttggtccaggctctttgcattctttttaggacagggatatatataaatattttccccaaacacaattaacctcattttaccttcattataacatatacttcattcgtttttttgtccttaagtgagaaaacttacaacactcagaaaaattatatcatgtcttcaagattgtgctgcaaatacatgtcatcgtcaaaatttgaatgcaggttttaatgctagcctagttctcttcctagtacccaagagatgacccccagtaaaagggaatgcacttactgattgttccaaaagtggaaactgatttttggtcccatggaaacatttattttaatcatatgttgatagaaatcttctagaagactactctctcttcgtaaaaagaggccactacagggaattgactcttatcgtgatgactcccagccttcatcatgaacatccattttcacatcctgtggtgatgcagtgcctgtcaagctgtcagctgtcatgtctgtgatcatcccgtttgcctctaacagcctctgctctgattcctctcaatcatttagggtcagggaaccagatgaccaaggcttttaaagattgtatgtaaagattgtctgttttttcaactgtaaaatgaggttgctataccagaccagtggttctcaactctggctgcatatttgaagcactgtgctcacacaccattctaggatacaattggtctgaaatggggctttgccactgatctttttttaaatgatcctgaagtgttttgctttttatttccattgatacaaaatagatgtacatatgttggggatgcatgtaatatttttatacattcatataatatgtcataatgagatgaggataatggagatatccatcaccttaaatatttgtcttttgttcatactgggaaaatttgaattatttgcatctagctaatgtgaaatacacaatagactattttaaaatatagtcaccctaaccagtctatcaaattaggtcttagttctatctaactttatttttctactcattaatcacaaagataaaaaagcaaaaaaaaaaaacattcatttcaatgaagtttataaataaatacgaaaaaattaaccactgaacagacagttgtaacccatatgatagagacatatgtaaattcattgttatagcagcacagataggggcaaccaaaccaacctgtgggagaaggtgatatgatttctagaggaagtgaggattgagttttgtcctgaaaactcctctaggtgaaagaggaaagaataccaatcaggagaaaatatatgcaaagttaaaaagatgtaacaatgtaggatatttagggaaatttcaagtacgcagttcaatatgagtgccctgtagagaacatggtggaaagcatggaaagcttaattttaaataattagctttgagcgaattcacagggggaaaccttctttatttcctgccaaggattttacattttttctctaaaggcaataggtaggaattaaataatctgaattagcaaaacaaaaacatacacataatctacattccacactcaggatagaaacattagaacataattgtcctttagcaatacatatacttgtggattttaaggaaatactgatgctatatcttgtttggagatgaacagtcagtttagaagtcactgcaataattaagagtaattagtaattggctatctttttaggtaacctgtgtagatgagtttgtcattcacaaactctaatgccaggagttaggaggattaaaaaagtaactttcattttgacttgtcagtgctatggtacccaggagacagttaattgaacattctccatatctacataagaaagatctgagccagaagagaacaaggcagagcatataagtatggtgaaataagtttataagatatttaaaactatgattcataaaatgatgatagaaattgagattcaagaacagaactctcagaaacataaatatttaaaaggtagatggaaaaacagccatcagtcttttaaatatttctagacatcctcctattgaaggacctgtgtagtcaggagtgtccagtgttgtagaactgtgaaaggactgttcacatttaagtggcggaggttagaagccagattgcagagtgttgagatgtgaggaggtatttttcttctttagaaaaaaaaatccctacatgcacctagttgcaacttttttaaccaatacttaattacctaatttattatttgagaaaccacgtgggaaatcataaaggccttcctgaattaagtaaaatgttaccttatttcatattaattaaccccatccctcttcagttacagaaatttcaaccatatttgatgttctttcaccaatctcttgatggctattagactgcaaattcccaaattaggagttagtactaacttcatctttcactttggtaacatttcaaccaatggctatagagctatgtacacaatggctactcaaaaatgtgcttgctagatttactcttctgcttagttaagcaatcagggaatgaggttacatcttcttaatttcatgccattcagaatcatcattttaaacatcattgataatgtaagcatttggaaacagaaacttttaaaacattaatatttttctttacagagaatttactgaggaatgttgaaagttaatacagatctcagtattcaaagggaatagaaaaataaatattctttaattaattattcttaaataatcaatcttctataaatataccatggtaaaacgagttaatgggtttcacataaaatccatttgagactaaatagctgagggaaatgttggtcaaatgtaaaaatatgaaataggatggtgcaatacaaatgcagttattaatttagccatgttaattttcaattaacctttcttcatacttcagaaagcaaacgactaaaactgttaaacgaaagactattggtcttctttttcctaacctctaaagatagacattctctagtgttcagctcttggatctttttcttctacctttacactcgcttcctagaaaataacatccagtcccatggcttaaacaccaaatgtatgctgatgagtctcaaatttatatttccagttctgaacgcaccctgatttccagatttgctgatacaaccaccaacttcatttctctatttggatatctctgatgagaatctcaaatatccagagctgaaaccctaattttcacccctcaccaaagtggggagcaaagcaaaacaataaacaagctgttcctccatttagtttagccgtttcagtcaatggcgccaccatcctacatgagcctaagacttatcctttattcctcaacttaccttattccacccctacatgtgatggctcagtaggccttttgatttgtcatttctaccttcatcgcctattttggttgcactattcataacctacctactgtaagaacttccaaaccactctgtttcctcttttttttttattttattattattatactttaagttttagggtacatgtgcacaatgtgcaggttagttacatatgtatacatgtgccatgctggtgtgctgcacccattaactcgtcatttagcattaggtatatctcctaaagctatccctcccccctccccccaccacacaacagtccccagagtatgatgttccccttcctgtgtccatgtgttctcattgttcaattcccacctatgagtgagaatatgtggtgtttggttttttgttcttgcgatagtttactgagaatgatgatttccaatttcatccatgtccctacaaaggatgtgaactcatcattttttatggctgcatagtattccatggtgtatatgtgccacattttcttaatccagtctatcattgttggatatttgggttggttccaagtctttgctattgttaatagtgctgcagtaaacatacgtgtgcatgtgtctttatagcagcatgatttatagtcctttgggtatatacccagtaatgggatggctgggtcaaatggtatttctagctctagatccctgaggaatcgccacactgacttccacaatggttgaactagtttacagtcccaccaacagtgtaaaagtgttcctatgtctccacatcctctccagtacctgttgtttcctgactttttaatgatcgccattctaactggtgtgagatggtatctcattgtggttttgatttgcatttttctgatagccagtgatggtgagcattttttcatgtgttttttggctgcataaatgtcttcttttgagaagtgtctgttcatatccttcacccactttttgatgggtttgtttttttcttgtaaatttgtttgagttcattgtagattcttttcttaacacactaaccatcaagatcttctttaagatacagaccagatcatagatcatgtcttcttgttcaaaatcctatagtggttttctgtcacacttagcatcaaaggcaaactcttaaccatgagctacagtgtactattttgtggccttttcatggttcttgaaatatgacaagattgttctttctttagggactgcaatagtttgaatgtgcaccccaaaatttatatgttaaaatcctgtcccccaagatgataatattaggaggtggggccatttggaggtgattaagtcatgagcagagccttcaggaatgtgattagtgtccttataaaagagatctcagagagctatctagctccttctaccatgtgaggacacagcaaaaagctacttttctgttatataaaccaagaagtggaacctctaaagatgtcaaattagctgtagtcttcatcttgatcttctcagcctccacaactgtaaggaatacatttctgctgtttataagctaccagtttagagtattttgttatcgtagccagaaaggtccaagactagtttggatctgccatataaagagaagtcagtacctattctctaggatggtctttggcaattaatgtttccttgccttagagtatcctcacctcattcacggccttgataaaatgtcactgatcacacaggtcttccctcttgctacctctttctatccccttttctggttgtgtaatttccttgtgtatgtttattttgcctcctaaaacatagtctccaataaacagagaatttggccaaatccccactatgttaaagattatttgacacacagtagatgatctattcatattatgagatgaatgaacccataattttaaatgcatgcagacacattgtatttgaagattgctaatatacttttagtaacatctaggtggttgaattatagtatgtaaactaactgaaaattttacaatttattttattttacattcacaggttatctcataagattatcataatctaggcagatttatatatcctcactttacaaatgaggagaatggggctaagagagagaaaaaaatgacttttcccaggtcccacatgtattgaattgttagagtctgggggaatcccagatctgatggacttcttcctacagagctaagcttcaggactaatgtgcagttgtttcgtttaatgtagtctaaaagatacatagagcataaattctggccatagggttgcatagtttcacagacacgactgcatttttaaaaagtaaattcttcaaataaattatcttctaagtaaacaaaggcttagacataaaatagcaattaacctatctaatttttccgatgtggaagaaattgcattccttgttacagtgctccgaaggtaaatccataaccatgcacttgagccagaataagattgatattactgaatgtgataggaaaatcattatatataatttataaatttaggcttctatattatgtttcttctcatttcttctttctatagttgtgaatttagagctgtttgaatccaataatcaggaacaaacaaaaagaaaacaatcttatttattataaatttgcaagcatttttttctggtatgtgatacatcatgctcatgggactattgtgcattctgtttccaagatgatggtaatttatttcaaaacctccttagcatacttacttaaataaaaattatgagaaaggatctattactcgtggaaaataaaatatatattacttagtaatttctgtgatatatgtgattctctctatgtatggatgctatatttattatccatgtaatcctctagcatcatatatttaagaatttagatttcattgtgaattcaatagaaatagcctctgaagtaaccatgttaggactaactaatttgctgatgaggtgatttttaaaaatacacaccatatataataaattataaaactttatttaaaggaggctggtctcttatgacaattactttataggctataacatttgcaaccatggtggactatgagattttccctcttcatagtatatttgtattgaaagcttacctacattgttccttcacaattcaattaatcagattttcttttaattataaatgatggttaaagataatgccaataaatttcatccacccactcactcacttattcatcaagcagttttatagttattgagtactatgctagttgcttagagcaaaaagaaaaaaaaagaataggaaattttcaatcttctaaagaaatctatatcctaatgatacaagcaaagaaattagcaattatcatgtagttttctatacacctaacagctactggtattggagttatattacagtttgtttttattataatttttattataaattaatacattgcagttctgatatacatagaaaattttcacaaggttaacataagctcaaacatgaaatatctattccccattagattggaagtaaaagctaatttctgagctttcagagagatttctagaacctggaaagtagaaatttactgaacaaaaatgacttgaaacccaggcagctttctctgccaacactggtattccaattcaccttctcttagtgcacaattaacctatagagacaatatagctttgaaagacagcatgcacaaaatggccattagagcaccccaaagtaatctccagtggattgtgaacagatttttgcatcttaatttaaatctgaatgcaggtgcatggttgtgtgaaacagaatgaaaaatcttgatagtttcatatatagttctaacaattctgaaacaaccattatgagcaagttttgtaggcatgtttacttattaattttacattttaatagcagtaaaaccaggcagtagataggagttaatatttattaaatagtataaaatttaattttattagatgcaatattttattgaatcttaacaaaattcttggttgaggttcagagtgaagaggtaacatgtttaagaaataagctaagcagtttactaattacacaataattccaatgaaaggcatgtttcttactcttcttaataaaccatatgtagtttttatcttctctgaaccatttaataagatctatatttaaatgtagtcttgatcctttgcattggtaggtggtattatttggctatagctatgcatatcataattaaacactggtaatttaagctcctttaattttcatcaactaccatgacaactaaatgtggaagcccaaactagggaaaaaaagtttcttgtcacattataacctgcaatactatgcatttatttcattaagaaatttctgagcttgctattaaatgaactagtacaaaatgcacttgcagacaccacagagaataaatgattccacagcccatggccttcaaggacaaatatttagtaaatatattttataacaaagtaacctccagttaaaaactttgatttggattcactcttctctctaactacaattttaggagatataaagaatgatgtgcttgtctgaacaacactatcaccatctcctgtatttaaaacattgtttttatctatttccctttattatgtaggtatgtcaacttagactgctccagttttcttctgaaactttataaagtgacagatatttcactggattgaaataacaatatgaagttcaataaactaggatcctgagcaggatgtctttggatttgaagcctgactctggcactgctagctttgtgacttaggagaaacatatgatatccctgtgcctcagtttctctatgaaattgacataaaatacctcatagggtggggttaaaagtattaaatgactaaaaatatgaagaaacggaactctatttggcacaaaagaaagattcaataaaaggaaatttatttaactatctatcatctatctatctacctacctatctataatctatctttttatctatcatctatttacttttgttttttaaatcataaaacagattccaagaaataagtcaaaacttctgaactttacatagttaatgagcatcctcatgtcttcatctctgggtttgcttagtttaaattttattgtctatcctttcaactacttcttcccatcttacctaaaatattgccctgccatttgacaaatacttgttcaatccaaactaaattatgtttggatatgaatgaggctggaaaaaaactcactactatgaaaaaaaaaccaaaaaaatcctcaccatgactcaccactatgctaatttgtcttatgttaaaaacagacatagagtgaacccacagccctgacaaaatcttcctatatttctttagttaactcactctcccaatcccttgagaatttctccccacgtttttttctcctaaagcttaaaatcattttccttttcttctcatgataaacgtttgtgtcctcaacagatcacaagaactcagcaccagtaacctctgcatctgcactcatatgctgccttccttcttgttgcagctgatgagctgtctgctgtcttatctaatttcaacatgctcttgtgccctgtattggatatcctctccctagttgtgaatgacctcatgcaacgattcccctttctttctcatatcatctgctttttcctttgagtggaattatttttaaacaatttcctaatttctttctatctacacccaattattcattacccttttcaggaaattactcaaaaatgttgtctgggccaggctgggtggctcacgcctgtaaccccagcactttgggaggccgaggcgggcagatcacttgaggtcatgcattacctccccttgctcctcaccccttaacaggccctgatgtgtgatgttcccctccctgtgtccatgtgttctcattgttcaaccccacttatgagtgaaaacatgtggtgtttggttttctgttcctgtgttaatttgctgagaatgatggtttccagcttcatccatgtccctgcaaaagacataaactcattaatttttatggcagcatagtattccatggtatatatgtgccacattttctttatccagtctatcattgatgggcatttgggttggtttcaagtctttgctcaggtaaatagtgctggaataaacatatgtgtgtatgtgtctttataacagaatgatttataatcccttgggtatatacccagtaatgggattggtatgtcaaatggtatttctggttgtagatccttgaggaattgccacactgtcttccacaatggttgaactaatttacacttccaccaacagtgtaaaagcattcatatttctccacatcctctccaggatctgttgtttcctgactttttaatgatcgccattctaactggcatgagatggtatctcattgtggttctgattttcatttctctaatgaccgatgatgatgagctttttttttttcatatgtttgttggccacataaatggcttcttttgagaagtgtctgttcatatcattcaccaactttttgatgggttttttgtttttttctggtgaatttgtttaagttccttttagattctggatatgagctctttgtcagatggatagattgcaaaaattttctcctattctgtatgttgcctgttcaccctgaggatagtatattttgctgtgcagaagctttttagtttaataagatcccatttgtcaatttcggcttttgttgcaattgcttttggtgttttagtcctgaagtctttgcacatatctatgtcctgaatggtattgcctaggttttcttctgtggtttttatggtcctagatcttatgcttaagtctttaatccatcttgagttaatttttacatgaggtgtaaagaaggggtccaggttcagatttctgcatatggctagccagttttcccaacaccatttattaaatagggaatcctttccccatttcttgtttttatcaggtttgtcaaagttcagatggttgtagaggtgtgatgttatttctgaggcctccgttctgttccattggtctatatatctgttttggtaccagtgccatgctattttggtaactgtagccttgtagtatagtttgaagtcagacagtgcctccaaatttgttctttttgcttaggattgccttggctacacaggctcttttttggttccatatgaaatttaaggtagttgtttctaattctgtgaagaaagtcaatggtagcttgatggggataacattgaatctataaatgactttgggcagcatggccattttcacaatattgattctttctctccatgagcatgaaaggtttttccatttgtttgtgccctctcttatttctttgagcagtggtttgtagttctccttgaaaaggttcttcacaccgcttgtaagttgtattcttaggtattttattctctttgtagcaattgtgaatgggagttcactcattatttggctctctgtttttctattattggtgtataggaatgcttgtgattttttttttttttttggagacagagtcttgctctgttgcccaggctggagcgcagtggcacactctcagctcactgcaagctctgcctcccaggttcacgccattctcctgcctcagcctcctgagtatctgggactacaggcacctgccaccatgcctggctaattttattttaattttttttttttgtatttttagtagagaacatgtttcaccgtgttagtcaggatggtctcgatctcctgacctcatgatctgcccgtctcagcctcccaaagtgctgggattacaggggtgagccactgcacccggctgaatgcttgtgatttttgcacattgattttgtattctgagactttgctgaagttgcttatcagcttaaggagtttgggggctgagacaatggggttttctgcaaacagagacagtttaacttcctctcttcctatttgaatatcctttatttctttctcttgcctgattgcctgggaagaacttccaatactatgttgaataggagtaaggaagagggcatccttatcttgtgccagttttcaaagtgactccttccagtttttgcccattcactatgatatttgctctgggtttgtcataaatagctcttattgttttgagatgtgctccatcaatacctagtttttgagtgtttttagcatgaagtgttgttgaattttatcaaaggccttttctgcatctattgagataatcatgtgttttttgtcattggttctgtgtccgtgatggactatgtttattgattttcatatgttgaaccagccttgcatcccagggatgaagtcaacttgatcatggtggataagctttgtgatgtgctgctggattcagtttgccaatattttattgagaattttcacattgatcttcatcggagatactggcctgaatttttctctttttgttatgtctctgccaggttttggcatcatgatgatactgtcctcatacaatgtgttagggaggagtccctctttttctgttgttgagaatattttcagaaggatggtaccagctcctctttgtacctctggtagaatttggctgtgaatccgtctggtcctgggctttttgttgttgttgttgttggtaggctattaattactgcctcagtgtcagaacttgttattgccctattcagggatttgacttcttcctggtttagtctttggatgatgcatgtgtccaggaatttatccatttcttctagattttatagtttatttgtgtagaggtgtttacagtattctttgatggtcttttgtatttctgtgggatcagtgttgatatcccctttttcattttttattttctattcttctttcttttcttctttatttgtctggctagtggtccacctactttgttagtcttttcaaaaaaccagctcctggattcattgattttttgaagggtttttcgtgtctctatctccttcagttctgctgtgatcttcgttatttcttgtcttctgctagcttttgaatttctttgctcttgcttctctagttcttttaagtgtgatgttagggtgtcaattttagatctttcccactttctcatgtgggcagttagtgctatcaatttccctcttaacactgctttagctgtttcccagaaattctggtatgttgtgtctttgttctcattggtttcaaacaacttatttatttctgactttattttgttatttacgcagtagtcattcaggagcaggttgttcagtttccatgtagttgtgcagttttaagtgagtttcttaatactgagttctcatttgattgcactgtggtctgagagactgttatgatttctgttcttttgcatttgttgagaagtgttttacttcgaattatgtggtcaattttagaatgggtgtgatgtggtgcggagaagaatgtatattccgttgatttggggtggagtgttctgtagatttctattaggtctgtttggtccagtgctgagttcaaatcctgaagatccttgttaattttctgtattgttgatctgtctaatattgacactgggatgttaaagtctcccactattattgtgtgggagtttacgtctgtttgcaggtctctaagaacttggtttatgaatctgggtgctcctgtactgggtgcatatttatttaggatagttagttcttctttttgcattgatccctttaccactatgtaatgctcttgtcttttttgatctttgttggttgaaagtccattttatcagagactaggaatgcaacccctgcttttttttttttttttttttttttgctttccatttgcttggtaaatattcctccatccctttatcttgagcttatgtgtgtctttgcacatgaaatgggtctcctgaatacagcacaccgatgggtcttgtctctttatccaatttgccagtctgtgtcttttaattggggcatttagctcatttacatttaaggtcaatattgttatgggttaatttgatcctgtcattatgatgccagctggtgattttgcacattagttgatgtagcttcttcatagtgttgatggtctttacaatttggtacatttttgcagtggctggtaccagtttttcctttccatatttagggtttctttcaggagatcctgtaagctaggcctggtggcaacaaaatccctcagcagttgcttgtctgtgaagattttatttctcctttgtgtttgaagctgagtttggctggatatgaaattctgggttgaaaattcttttcttcaagaatgttgtattttggcccccactctcttctagcttgcagggtttctacagagagatctgctgttattctaatgggctcccctttatgggtaacctgacctttctctctggttgcccttaacattttttccttcagttcaaccttagtgaatctgacaattatgtgtctgggggttattcttctcaaggagtatcttagcggtgctctctatatttcctgaatttgaatgttggcctgccttgctaggttggggaagttctcctggataatatcctgaagtgtgtttgccaacttggttccattctccttgtcactttcaggtacaccaatcaaacataggtttggtcttttcacatagttccatactttttggaggctttggtcattctttttcatttctctctaatcttgtcttcacaccttattttgttaagttgatcttcaatctctgatatcctttatttcacttgatcgattcatctgttgatacctgtgtatacttcacgaagttctcatgctgtgtttctcagctccgtcaagtcatttatattcttctgtaaactggttattctagttagcagttcctgtaaccttttgtcaaggttcttagcttccttgccctgggttagaacacgctcctttagcttggaggattttgttattacccaccttctgaagactactctgtcaatttatcaaattcattctccatccagtttttttccctggctggcgaagagttgtgattctttggagaaggggcattcttgttttttcctcatctatgtttatttatctacctttgatatttgaggatggtgatctttggatggggtttttgcatgggcgtcctttttgttgatgttgatattattgctttctgtttgttagttttccttctaacagtcaggcttctcttgtgcaggtctgttggagtttgctggacatccattgcagaccctttttgcctgggtatcaccagcaggggctgcagaacagcaaagatcgctgccttcttcttcctctgaaagctttgtcccagaggggcacccgccagatgccagccagagctctcctgtaggaggtgtctgtcgaccctggctgggatgtgtctcccagtcaggaggcacaggggtcagggacccacttgagcaggcagtctgtcccatagcagagctcaaccactgtgctgggagatccacttctctcttcagagctggcaggcaggaatgtttaagtctgctgaagcttagcccacaacaacccctctccccaggtgctctgtcccagggggatgggagttttatctacaagcccctgattgaggctgctgcctttctttcagagatgccatgcccagagaagaggactctagagaggcagtctggctacagcagctttgcctcactgtggtaggttccacccaattcgaacttcccagtggctttgtttacactattaggggaaaaccgcctactgaagcctcagtaatggctgatgcccctccccctaccaagcaccagagtcccaggtcgacttcagactgctgtgctggcagcgggaatttcaagccagtagatcttagcttgcttggttcaatggaagtgggatccactaagcaagaccacttggctccctggcttcagtcctctctccagggcagtgaatgattctgtctcactggcaatccaggcaccactggggtacgaaaaagactcctgcagctagctggatgtctgaccaaacagccgccagttttgtgcttgaaacccagggccctggtggtgtaggcacccgagagaatctcctggtctgctggtggcgaaaaccatgggaaaagcatagtgtctgggccagatagcaacgtccttcaaggcacagtccctcaagggttcccttggctaggggagggagttccctgaccccttgcacttcctgagtgaggcgacatcccaccctgcttctgcttgccctctgtgggctgcagaagtcccagtgagatgagccgggtaccttagttggaaatgcagaaatcacccgccttctgctttggtctcactaggaactgcagaccggagctgttcctatttggccatcttgccctggaaagaccaatctcaacttttaatgttgatgttctcaggactcaatattttcatcactttccttttctagctttaatggtccgtcatcttatgtagtgcaatagctttatattacagtttagactaatgactctgaaattcatatttttaacctgtttgcataagttttagacttgtatatttctgtccacattatatctcaaatttgatattctttaccataaaccttgatctcatcaacttctgcacctgctctttgtttactatttttactggaataaatggcacgatagtttactcagttattcaacacctaaacttttgaggcttccttgatatttctcctatgatctgtctatattcaatccatctttaagtcttactacttccgtttactggcaataaaggactagtatgttttggaacaattatcttgagaacaactagaatatttgataaaataatgtatgtttaaagcatagtggagccagcagtgagaatttgcagagtcaagattcagtataagagagaaaccaaaagcaatactcccaagagaaataatctcagagtataaaagttcttttccctttgagctgtggattccaaaagcaccaggtgatattttgagatgtatgaacagagcttgagcaatgtcactaagctgaagacacaaaaattgttgacgagatagagagaagaaaaagacaacctggtaaatatcttaagctttgagttggaatccaaagggctataccctacaaatgtgagcgaaatggaatagccagttcacactgagactgaagaccagttaccaaccagctcaattctaaattgaattaagatagacattctatatactagccatcaccagatgcaaaataaatcatctattaggaaatataatattatacagatttttcaattatttccacttttcacatatttatatctggcattcagtattatatataagacatacaacgtatccaaacacacacccacataaaaatatatacaatataaacatatttataggaaatctaaatgatagaaatatatttataggaaatctagataatagagtgattatatatattttaaaatatctgcattaaagtatttacaagacaaaatgaaatttcaattgatagttctacttctgagtatatacagataattatgtgacaattaagaactgataaatataattactttaattaagatattggtgaattggttgaatatcatattagtcacagttgaagaggaaattgttacactaaaagatgagtcagatcaaaagatttcaacaaaagcatgaagagaaattttttaaaaaatggaaatgcagaaaagattattaaaggtatgtgatcatggtaacaagctgaaacatatttgcaagtgcagtttcaagaaaagaggaaagagagaatgggacataagcaatacttaaagacagactatttgaaaatctttaaatgtgaaaaatacattaagcctatgatgcaaacagtgtaattacaaaaaatatcacagtacgtacatagtataattacatgttatcacatgtatacacacatagaattatattgaaattatcaaaaccaccaactacttagaaagaaatgtaatacaaaatgtgtaaggtgtctactcaaaaaacaatcattattgataaatttaacacataaataaatggaaaatgtaaactcaaagactcaattttgtaaagagtttatttctctccaatttgtttaaaattcaacacaatgctaataaaacccaagctcaatttgatgggaaatttaatacttatggagatgaaaatagtcacagaggtatatgaccatcctgaagaagaacaaaatgagattaccattctacataccaagatttactattaagccacaataataaggagaataatagtggtgtaaggatttttaaaagtagaatagagtatacagaatcagatccacctatacagtcttggtttatgaaaaggtagccctacttgaccctgagaagaggatagtctttttgatgaagagtgctggattggttgtctacctgagacgagtgtaccacacaaattgtttgttacggaatgtgcttgggatcatgtatggcatggaagaatatcaagcagaggggaatatgaagttgtgattcaggcccaacaaccgttttgaatgatcccatggaccttctgtaactagagtggcctgacggagtggtccttcactgggctaaggtagccaaacctctatactactgattggatcgccattagatatgagccacccttggaagagagagataatttagggtgagttgacactcttcagctgagttaatatctgaagggattgatagctgaaggccatattcagatagcaccctcagcaggtgcagcagtttctgaaggcagacctggaaggtgcgttagagtatctacttcactccattttattctaaaaatatgatttattattatgtcatgtatacactgattaattcattcattgaccagtaacttgataacggcaaggaattcttctcttggttattttttctctaataatatattttacaaaaactagtgttccacaaatatttttaaacaaatgagggtggaaaattggaggccaaactatgaagtgtattgtaattattgataaaaatgtgtcagtatctagttaattctgatatttttgatatcagtcttatctaaatttaatattcagctctgataagtattagctaattagctttgggctcctaagttattcttttttggtgcaaatacttcatttggtatatgatagagaataaacaagttattcttgaaaaacaattagatgacagttgtaatttttagaagcaaagaaaatgtaacaattaagattaaagaaatataattagttttattttactgtcattctctagctagtcacatttaactaaaaattctaagtaatggagagaaattttcaatttggattatttcaataataaaatatttttatttatgtctcattaggagatataattgtatgcctcatgtctagcatacaatgcctagaagtcttcttcattctgttttgaaaactcatcagttagtttttcttttgccaacaaatactgttgtctaaatgtctgagagctttcgccaataatgacattcattacccgtcagcttcttttataaaacttgaactttaaaaatacatgttttattactattataaatccaaagcaaaataaggaggaatacacttttaacatgtagcttctaaattattctgccacatgtactgtttaggaatgaattatgataaatttccaaatacattatcatgaccaaaactctaactgatgtgtctttccagctctttcttagtgaatcttaactcaaatatttcagatcttcttttctctgccctagttaccacctctacatcaattaccctttgtaagctagtcgtttttcttcttctattgtactttctgtaaatggcttttttatatgtccaaaataaattctaaacatgacaaaatgtgaaaggctatcattaaatctgtttcccttaaaataactttttaaattaagttttaattttacaataattttgtgattattatgtctatcttgacattagagaaccagagctgcaaaaatatttagaatgagctattagagtacaggaattgaattttcttgtaacaattgcagaattagtacattactagtatttatataatttgatgtattttttccttgattgatgtaattcaaatgagatatatctttcagaattatttgaaaataataaaaatatgtcatgtcagggtcactttagaagtgaccgcaatcttctcattacagtaggatttgaattatcaaggttatttatacatcagaaagaaattgttgtatataagcagaataatgaaactagactcctgtctttcaccatgtacaaaaatcaaatagaaatggattaaagattaaagactgaaatctaagacctcagactttgaaactacaacgagaaaacctctgggcagctctctggaacattggtctgggcaaaaaatttcccgagtaatgcctccaaatcacaggcaatcaaagcaaaaatggacaaatgggatcacatcaaattaaaaggcttctaagcagcaaacgaaacaattaacaaagtgaagaggcaactcacagaatggtgggaaatatttgcaaactacctatctgacaaaggattaataaacagaatatataagcagctcaagcaactctacaggaaaaaatcaagtagtctgattaaaaactgggcagaagatttgaacagacatttctcaaaagaagacatgcaaatggcaaacatacatatgaaaaggtgtttaacatcattgattatcagcaaaatgcaaaccaaaactacagtaagttatcatctcatcccggttaaaatggcttttgtccaaaagacaggcaataaaaaatgctgtcgaggaaatagataaaaaggaacccttgtacactgttggtaaaaaggtaaattattacaacaactatagagaacagtttggagattcctcaaaaaactaaaagtagagctaacatatgatccagcaatcccactgctgagtatatactctaaagaagggaagtcagaatatggagagatatctgcactccaatatttgttgttgcactgttcacaatagcaaaaatttcaaagtaacctaaatgtccatcaacgtatgaatgaataaagaaaatgtggtgcatgtacgcaatggagtactattcatccataagaaagaatgagattctgtcatttgcaacaacatggatgaaaaaactgagaatcattatgttaagtgaaaaggccaggcacagaaagacaaacatcacatgttctcacttatttgtgggatctaaaaatcaaaacaatcgaactcatcgacacagagagtagaatgatggttaccagaggctaggaagggtagttagggggtgggagagtgaaggtgggtatagttaataggtacaaaaaaatagaaaaaatgaataaaatctagtatttgatagcacaacagggtgactatcatcaataagaatttaattgtacattttaaaatagctgaaagaatataggccgggcgtggtggctcatgcttgtaatctcagcactttgggaggctgaagagggcagatcatgaggtcaggagatcaagaccatcctggccaacatggtgaaaccccgtttctactaaaaatacaaaaaaattagctgggcgtggtggtgcgcacctgtattcccaactactggggaggctaaggcaggagagttgcttgaacctggaaggcagaggttgcagtgagccgagatcacaccactgcattccagccttccagcctggcaacagagtgagactcagaaaaaaaaaaagtataattggattgtttgtagcacaaagaataaatacctgaggtaatggatacctcattttatgtagtgtgattattacacattgcatgcctgtatcaaaatatctcatgaacacctaccacatacccacaaaaattaaaaactaaaaaaaagtggttagtcaaaagatgagaatagctaaccaatttctttacaataaataaataattaagtaaaagtcagaacagtcatctcaagcacagtttcacttaagtacgctttaagcaaaggcctttgagaaatatgattctgttggcaagtccatccgtttttggaggtggatgcaaaatattcattgaacgaattctgcaaatgccagtgccattttttatgaccatctcatttggaggaaaggaatgcaacaggttattttagtttttgcattaatcttaaatttactttctatattccaaagctgtgatatccatacaagcttcagattttgatttagcttcccttatgtgtctgtctagatcaaaataacactggtcatgtggcattatgattaattagcatcattctcatgagtttttttttaatatgagcccactaaacaaaaagaaatctgcttttagtgtgaagacaaaatcagatttcaaatctataagtaagaaagctatattctgaactatggaaaatcaccagacaaataaacattagaagacaacccgttcctaacaagtgctctccctctgtctttctctctctgattcattatctaacttcctcaaattttatagtgtgtagttgataaacccttattttatagaactgaaatatgcatagataaatgtagtaaatcctatatctgataaggaatatttcctttggttgtcaattcagtcagtcctttcataagcttcatgagttctacataggtgattggtaatccaaagatcatgaccttatgtataatataggtatatatacataaaatttcctaaatatattcgctaaagtagagattacatgcaatatttctccctgtttgtagtctcataaactcacacagttgctttgtgatctggccattttaccattcatatatgctgagtgtttctgcaatcttgactaattgatgatattaaagtggaacagctagggaatcgtagatagctggatacagttgtaacctaaatttttctaagtctaaatttctcattttatatgtacagtatgattgagactcttgaaaataaaagatttccatgacaaaaaaaaagtcactcctagaaaaatcagaataaaatttatccaaggtgttacacaaaatgtaatcacccaaagggtctcccactcactcttaccctttagaacttattgctgtttcagatgtttttctttggaggaaccaaaactagaaaagttacatgataaattatatttaaatataaatttgttactaaaagctaaacaagaatgattctgtacttgaataatgatgaccacaatgacaactgcaataatgatgttgataaagctgatgacaatgatgatgacagtgacaaaggtaatgcaagtatattgtaataaattttaaaaaatactgaaggttatataataaaacatgaaactctcattcctgcctctaatgtctacttatcacctaaaatcacttttcagaattatctttctcctataatgtatcttgtatatcacaaatagatctgcttcattctttttaataacctcatattctcttaaatagatgtattatatttacccaatcagtactctgttcaccatatttgtgtgaattatagttcccagcatgtggcaataatgcgaaaaatatggttttataaacctgtgtatttgttatatcattttttgagtagtatgtctgtgttgtaactgaatcttgagaaatacttgcaacacatatgacaagagactcaatactttaaatgaggataagctgctacaaagaacaaagaaaatgaaaaaaaaactcaactgaaatatcgtaaaggagtattaatagattcaccaaaaaatcctaaataaatgaccaatatacaagtaaaaaatactcagcctttctcatctttaaataagtgaaaattttttaaaaaattgtgtttgtgtatgtgtgtttgtgtgtgtgtctatgtgtgtgtgtgtgtatgcatgtgtgtgaacttaacagattggcaaatacaaaaacatttgttaccacacagaattagtaaagtcttgtcacagcagctgtcttacatctctaatgttggagggcaggcaatgtaatgcaatctctttacatgacagcaatatctatatgaaattacaattagtacatttatattaaactttactgggactttaaatatgctttttggaggattaggacaaaaaactgtcaaaaaattgctggaatatgaaactcatgtcataagtatgtacagctgagctgtggggggggtgggtattctgttgatttatgtatgagtgccgcataagttcatttcaatcacattcagtttattcacttggtttcattctgaaggaatgaattcattctgatcattttgtctgtggttgagaaaattgaactctaacagattgcagtcccagaagaaattgcctagtgttagagctgcaagtaattgctaaactcccacgtgcctcaggggagaaagtatgtccttgattagaaaaacatgcaaggaaaaagaggcagtaagctcatagttaatgggcaagatagcattctgtgttaagtgctttagagcaacaaggcatattcttctccattttttactaactagaggattaatttatattgcaaaagaaatgttaaaattctaatcattcttcatcattaaataggaattctatgtcttcttattaccatacagaaggacattttaattcaaatgaggtagataaataaatacatccaagggacttatttaaattcacttaatgtatacttctaaattacatatttctgacaatactgacacaaattaaacaggatattttactatccaattatgatgaatcctacagtcagaaaatcaatatgctttagcaatataagcacttagactctttctgctgtgcaagagacaattagttccatgtctttgaagaagaaaaaatatacgtattttgatttattcacataattttagatcagattttgatgataaaccgatacataacttttgtcaatttaggtcatcagagtgtatatattaatttgaagtcacttaatataggaccagaacagagttaagtttagattgtgtgtgtttgtgtgtgcacgcgcatgagattgacccttgaacaacatgggggtaggagctgttaaccccagtgcagccaaaaaaactgcatgtaagttttgataccccataaacttaattattaatagcctactgttgactggaagcctgatatcatagaaaatggattaactcatattttatattatatcatgttatatactatattcttacaacaaaataaggtagagaaaaaaatgtcattaaggaaatcataaaaagtagaaaatttatttaccatgtggaagtggatcaccataaaggtattcatcctcattgtcttcacattgagtagactgaagaggaggagaaaaaagaggtcttgctgtgtcacaggtggcagaggcaaaagaggtggaggaggtggaatgggaggcaagagaggtaggagcacttgatgtaatcgttattgaaaaaaggatgtgtataattgggcctatgcagttcaaatctatgttgttcaggggtcaaatttagataaatagatagatagatagatagatagatagataagatagatagataatgtagatagatgatagatagatagatgatagataggtagatagataatgtagatagatagacagacagacagacagacagacagacagacagacagacagatagatagatagatagatagatagatagatagattaggctttagcataaactgatgcataatttttctggcagcctaggtcatcaagccatacatattagtttgaagtcgcttaatatattgactagaacagagttaattttagagagagagactgtgtgtgtgtgtgtgtgtaagctcagacataaacatacagaagtgaaattgttcacaaatattactacctgccccttgatacattaaagtgtaaggtacttatacagttggacttcatgtaaagcaagttaagctttttacagccttgtgattgtgccttaacctaataactctcaaaggaaatagtggatataacttaaatgaagtgcccttctaatggtattatttttcagtaaggtcaagaaaaggttacgtatgtattatagtgggtgcatatagagttacatctatatctactgaaacagaaataaaagaaatgttttggttaaattggagactaaatgaccataactttcctgtggaatgcctcaataattaaaactaagacttctttgttattctaagtattgattcttgcaaatatttttatttaaaagaccaatattgcttagtacattgtacataatacttcatgtgattcgttccaaaaacaaatacaccaggaagaaaatagtattacatttctttttcacagtaagaaaattaagctttattgatagtagagaatttcctcaatcttgtagaactggcaaatgagaaagtgaattttatcaaaatataatgtaaacttttccaagaaatataaatgcaataagaaaaaatatattaaaaagttaacaacaggatataagactactctattttttcaagatcttaaatagaaacctagccttgccatagtattctttcatgtctgctatccattttgagaatcatggaaatattaaatgctttaaaatacaaaattgatacattcaactaatgattaaataaacccaaggctttgtattacagtcatacataattttatcacacttcacttcacttgtagatgttacttttttttttacaaattgaagagtttgttgcaaccctccattgaacaattctatgatgccgtttttccaacagcatgtgctcactttatgtctctgtcacattttggtaattctcacaatatttccaacttttttgttattattatatctgttatggtgatctctgatcaatgatctttgatcttcgatgttatttttgtaatcgttttagggtgacatgagccgtacccatataagacagtaaactttgagaacaagtaaaactttattaatatttgttctcactgctccatcaaccagctgtttcccaatctctctttctcttgggcttccctagtacttgacatacaacaatattgaaattaggccaattagcaaccctataatgatctctaagggttgaagtaaaagaaagattttcacatttctcactttaagtcaaagctagacatgagtaagcttagtaaggaaaacacaccaaaacccaaaacaggctgaaaggtaggcctcttgtgacaaatagccaatatgtgaatagaaggtaaaactttttgaagggaatgaaaagggctactccaatgaatgcattaataataagaacattaaacagccttattggtgatatgaagaaagttttagtggtctgggttagaggttggctcatgaagtttaagaaaaagtcatctccataacataaaattgaaagtggaatcagcaagttctgatgtagaagctgcagcaagttatccagaagatctaagatcattgatgaagatagctacactaaacaacatatttttttctctcaaataaggtctttctctttcgcacagggaagagtacagtggcatgaccacagctcatacagcctcaaccccctgggcttaagagatcctcccacctcagtctctcagtcactcaagtagctagctgagtcttgcaagtgcatgccaccacacccacacacccagctatttttttttttttttcagagatgtagtattactatgttgttgcccaggctggtcttgaatttctgcgctcaagcagtcctcccactttggcctcccaaaatgctgggattatgggtgtgcaccatcaggcctgggccagatttttaatgtagaagaaatagccttatcttaaaagaagatgccatccaggactgtcatatctatgaaggaaaagtcaatgcctgaattcaaagcttcaaaggacaggctgggctgactctcttgttaagggctaatgcagctaacgattttaagtttaagtcattgctcatttaccattctggaaatcctatagctcttaaaaataatgctaaatgtactctgcatgtgctgtataaatggaaaacaaaacctggataacagcacacctgtttacagtgtggtttattgaatatttaaagtccaccattgagacctactgctcagaaaaagagattcctttcaaaatattactgctcattgacaatgttcctggtcacccaagagctctgatggtgatgtacaaagagattaatgttattttcatgcctgctgacacattcgctctgcagcccattgatcaagactttcaagtcttattatttaagaaatataattttaagactatatcttctatagagagagaatccactgatagatcaaggcaaagtatattgaaaaccttctagaaagaattcatttttataaatggcactaagaacatttatgatttgtgaatggaggtcaaaatataagtatgaataggagtttgaaataagttgattccaaccctcatagacaattttgagactttcaagtcggcagtggaggaagtaatcgtggatgtggtaaaaatggcaagggaactagagctagaagatttgactgaattgttgaaatctcatgatcacacgtaaatagatgaggaattgcttcttacggatgaacaaagaaagtgcttttttgagatgaaacaaactgctggtaaagatgctatgaacagtttcaaattgacaacaaaaaatttagaataaacataattgataaagctgtggcaggattggagaggattggttccaattttgaaagttctattgtgggtaaaatgctatataacatcatcacatgctatagagaaatctgttgtaaaaggaagagtaaatagatgtggcaaacttcattgttttttgattttaagaaattaccatagccactccagctttcagcagccaccaccctgatcagtcagcagacatcaacattgaggcaagaccttccaccaacaaaaaaaattcaactcactgaaggcccaaatgattggtagcatttttagcaataaagtattttttaattaaagtaggtatattggttttttaaatgtaatgctattgcacacataatagactacagtgtagtagaaaacataacttttatatacacagggaaattaaaaaatgtgtggttatctttattgtgatattcactttattgttgttgtctggagcctaacccacattatctcctatgtatgcctctacttaaaatttcaaagacaaacttatttcacatttttaatcacttagaggttttggtatataagcaatggttataactctggctaacttcataaaaagggcttaaatattcggaatctatcataagttctcaggatttatgggagacagaacaaacaggtaccaaggaagctccagaagcaacagtcctacttttattgttactttctttccatatagacacaactgttttagaccacaatttgcttaaagtaaccaaggacagtatgacttttatagcaaatatgtaatagtaataattaggacaaggaaataatcaaaataataagagctaattataattatattttactatattcaacactctaaatactctccgtgaattatttcatttactttttaaagaatgtatgaaaaggttattatcccatgaataaattatctgtattcttgggtatcaagttttaccaccttggaagaaaaaagttactcctaatttaagctatgggtcagcccgttggctatgcttggatagagaatgatagaaactgtcctctctggcttctattatgtgatacagaccttacctttgaccaaaatacaaaatgggatgagtaaatactattggaaagaggtctttttacgatggaaaaaaaaacatatacatgtttactataattaactttcaagttattttataatttttattaataaatctattgatcagaaagtagaggaaatgtctcggttaactttatgtgctcatcactgtattaataaatatctatagaataacatatgagggagaaagaaggacaaaaagtcaaggtcttgaagcacctattatttacacagggcacttcagctatttccttcagttataacaatcaacttataaggcaaatttattatccaacatttgttgacagtaaacatgattggcaacatgtagtaaaattaattttcttgcctcaagtcactatagggcagaattttgaatccagcaagtctgtatgaaggagtgtaacacatgatatattactactaagacttaaatgcttcttgtgataacaagatacacacacctgcaatgccaaccatgtcactgtcataaatatttttcatatcttgttcttcattaacattagcagcagcttgttttagttaactttccatatttttctcccaccttttcaaattataaagaattcatctttgtagccttttcttggaaaaaggtggaggcatgttatccgggccccacctatcatattcaaataagtgagacctttgttttgattctgggatttgttcagggcaagtaagcattgccttttccagaatagcctcaatgtttttaaaacattgtccctgtcagcatagacttcaaaacagacactttggtcttccaaggttttctaaactctctaattatctatctatctgtctattatctctatctatctatctatctatctatctatctatctatctatctatctatctaatttgtccacctatccatttccctcaaatgcttaaatgaaatacaattggttataatatttgctactaagaggctgggttagtcaagggaaagcacataattgagtgctaaacttcatgatgcacactactaagaattgccaaacctgaagggaaagtgaaatgttaggggaggtttcacaacagaattgaaaatttactggatctctgaaaaactggtggagtttaggatggatcccaggtaaagaaaaaaaatggatcccaggtaaagaaaatattatgaaaagcaaaaatgtaaaatttttataattaatgtataagcaaatgtgcctaaataaaaatcataaggatcagtgtaaagtataatctagaattaagcttaataaatgaaatataaacaaatttgggagactctaggaaagaaaatttagcattgatatttatgaagtacaaagttaactttagagagcttgacaaaatataagaggagatacaatgtagtgtaacaaataattaatggggatcgggagtttttaagatcatactaagtattacagaagtcatgggacagtagttccacttatgtgagctattatatccttatctgagaaaagaggatgtcatgtaacacaatctagaattccttttcaatgtatgatgctgtgattgaagttctcttaaaggaagattagtacaatagaataaatggatataagtagaggcaagagtcattcaattcatcactgtgtttgttgtaatgatcctacaacaaggtccataagtaggccttactttccattgatacacaaaatgggaagactgaatactcttagaaagaggatttgtatgatgaaaaacaaaacaaatatgtgcttgctgtgatgatcttagacaaggatagatacagaaggattaagaagaaggtaatgtaaggagaaacctacattttttgtcttactggataaattaaaatatgattttattgcaagacagggaatttgagggagagaattaatttgcatgaagattgtaaattttaacataagaatatcaattctgagaattggattttttagggctattttaattggaatgttcaacaaataataagaaaataactttcatttatttcatgctaggtttaaaaattgtttttattctttattttttaaatagggatagggtctctctattttgcccagctggttgcaaactccagggctcaagaaatcctcctgccttagccttccaaagggctaggtttacaggcatgagccaccacacccagccttatactagtttttataataaaatattaatttcccatttatagtacattctttagcccccatagaagcaagacagagtcctcaatatagtctgttatttcaaggaatgacattattattccctaaattatgaattgccctagaatccccaaatggcacaagggaaaaacaaaaacaaaaacaacaaccactagaccatgtcatccttttaaagtgtttcatttgattgaaatactcttgatatgatttggctgtgtccctgcccaaatctcatcttgaattcccacatgttgtgggagggacctggtaggaggtaattgaatcatgggggcaggtctttcccatgctgttctcgtgatagtgaataagtctcatgagatgtcatggttttataagaggaagtttccctgcacaagctatctctctttgcctgctgccatccatgtaagatgtgacttgctcctccttgccttctgccatgatggtggggcttctgcagtcatgtaaaactgtaagtcctttaaacctctctcctttgtaaattgcccagtcttgggtatgtctttatcagcagtgtgaaaactgactaatatggtaaattggtaccagtaaagtgggaactgctaaaaagatacccaaaattgtggtagtgactttggaactaagtaacaggcagaggttgaaacagtttggagggctcagaagaagacaggaaaatgtgggaaagtttggaacttcctagagattgttgaatggctttgcccaaaatgctgatagcaatatggaaaataaagtataggctgaggtggtctcagacggaaaagaggaacttgttgggaactggagcaaaggtgattctagttatgttttagaaaagacactgacagcattttggctctgtcctggagatttgtgaaactttgaacttgagagagatggtttagggtatctggcggaggaatttttcttttcttttttttttttttttaattgaggtggagtattgctctgtcacacatgctgaagtgcagtggcacaatcacagctcactgcaacctccgcctcccagattcaagtgattctcctgcctcggcctcccaagtagctggggttacaggcacatgctgccgtaccatgctaattttttgtattttagtagagatgggatttcactatgttgcccaggctggtcttaaactcctgagctcaggcaatctacatacctcagcctcccaaaatgctgggattacaggcatgagcctccatgcctgacttggcaggagaagtttttaagcagcaaaacattcaagatgtgacttgggtgctgataaatgctttcagttttataagggaagcagagcagaaaagttcagaaaatttgcagcctgacaatgtgatagaaaagaaaatcccatttttagaggagaaattcaagccagctgcagaaatttgcataagtaacaaggagctgaatgctaatccccaagaccatgggagaaatatctccaggacatctcagaggtcttcacagaagccgcttccatcacaggcccagaggcctaggagggaaaagtggtttcatgggccaggcccagggtccccatgctgtttgcagtctagggacttggtgccctgcatcccagttgttcaagccatgactaaaagaggcaaaagtacagcttggaccacggcttcagagagtgcaagcctcaagccttggcagcttccaagtggtgtggagcctgcaggagcacagaagtcaagaattgggatttgggaacctctgcttagatttcagaagatttatggaaatgcctgggggtccagacagaagtttgctgcaagggtggggccctcatggagaatgcctgctgggcagtgcagaagggaaatgtggggttggagctcccacacagaatccctctggggcactgcctagtgtagctgtgagaagacagtcactgtccttcagaccccataatggtagatccactgacagcttgcatggtgcacccagaaaagccacagacactcagcgctagcctttgaaagcagccaggagggaggctgcaccctgcgtaaccacagggttgaagctgcccaagaccatgggaactaagctcttgcatcagcatgagctgtatatgagacaaggagtcaaaggagatcattttggagcctaaagatctgatagccccaccagattttggactttcatggggcctgaaacctctttgttttggccattatctcccatttagaatggctgtgtttccccacacctgtatccccattttatctatgaagtaagtaacttgcttttgattttactggctcataggcagaagggacttgccttatctcagatgagagacattggactgtggacttttgagttaatgctgaaatgagttaagatttggggaactgttgggaaggcatgattagttttgaaatgtgaggacatgagatttgggaggggccaggggcagaataatatgaattggctgtgtccccacccaaatctcatcttgaattttgagagggacccagtgggaggtaattgaatcatggggacaggtctttcccattctgttcctgtgatagtgaataagtctcacgagatctgatggttttataagggaagtttccctgcacaagttctctcctgcctgttgccatccatgtaagacgtaacttgctcctctttacctttcaccatgattgtcaggcttccccagccacgtggaactgtaagtccattaaacctctttcttttgtaaattgcccagtctcaggtatgtctttatcagcagtgtaaaaatgtactaatacaaatctttattatttattttgtatttctagcatttatgtaataaaattatcacaatcaggtcacttttgtacttagactcaaagtattagaaaaaaatcttgaaatttatatacctaagaaacattttttttactgtaagcatatatagaagatttgtgattatgttttgaaaacttttattttacatatgtatgtatgtatgtatgtatgttttatagatattatatttgaggctggtctcaaactcctggtctcaagtgatccccccaccttggcctctcaaagtgctgggattaaaagcaggaaccttccctctctgcctgaacattttaaaataagtatttctaactatagattctgaatcactaaagggaccttgagagtctcatagacctaattataatcaccctgaagagatagttttcttgttttttagattttcagggaaaaaatttacaaattgcctttatttatttgtgctaatactcttggatggcataaaattcttgtatacacacaaaaatgtctttgttcttcgagttgaggccagttacttttttctgttctcagagacaactaagagttattaatcactaaccttcataatattgtccttcaaataaaggtgattatgagatcattatttttatgatggaataaataatactaatttctacttctatccccataaaaatctgaagaactcataagaattgtcaatagacatattagaaaccttccaacttcactagtcattgaagtatagtaaattacactgaaagcaagatgtctgttttcactatcaaaatggccacccctcttctttttttgcacattcacagtcaatgctgataaagatgtagtaaatacccttgaacctctgaggtgggaagtatgatattattgtgcaacctttctagtaagcaatttctttaaagttattcatcattgtctctggttccacttccagggatatgagttgtcttacatcagcttccataacacttacattttcttaagtgcatgtttgacttaaattagaaatcaagcctgagaagagatttggttgtaataatttattgactcttttgactttttaattatggccattcttcaagagtaaggtggcatctcattgtggacttaattttcatctggatgtggtgaaacgggaacaatttacactgctggtgggaatgtgtaaactaatacaaccactagggaaaacaatatggagattccttaaagaactaaaagtagaactatcactcgatccagcaatcccactactgggtatctacccaaaggaaaaaaagtcattatatgaaaaagacacatgcacacaaatgtttatagcagcacaattcgcaattgcaaatatggaaccaacttaactgcccatcaacgaacgagtggatgaagaacatgtggtatatatacaccatgaaatactacttagccataaaaaggaataaactaatgtcttttgcagcaacttggatggacctcaagaccattattctaactgaagtaactcaggaacggaaaaccaaatatcatatgttctcacttacaaatgggagcaaagttataaggatgcaaatgcataagaatgatataatggacttcgaggacttagatgcggaagggtgggaggggattgagggataaaagactacatatagagtacagtgtacactggtcgggtgacaggtacaccaaaatctcagaaatcaccacgaaagaacatccatgtgtccaaaacccacgtgtaccccccaaaaatttgaaataaaaatataaattagttataaaataatactaataatttattgactcaatgtaggaagagaaacagtatgggaatagagaaagagccaaaagggggtaaagattcatctaaggtaaagtctgtacctggcgctcctgagatgccatcttagctgccagtaccaggagctggggaagggctaaagttgaacattaggaaccaacactcatatttacggggagatgggcacattggcccaataaagaggattcagtcagtataccaaaacagatctaccgcatagttttggaaataatcacaaatgtgtacttaagattttgtgtatagatggtcactacactgttaacactaattaaaaattggtttttggttcttatattgttttttcttttaagtagtacaacttttttagttcagtagtataagatctctattaatttggaataaaggataaatggaagaaaaaaatatgaaaacaagatagactttcatctcacaaatttagttattaagctgatatttttaaattaaattgctaatatattaaattacacaaaaacgaagaatttaatatgtctcatatttgtgttgttttgtatcagagccagacacacaatttgaatgacccagtgcaaaatgaaaatgtgaaaccccttgttaacaattattaagaatttcaaaacagcaacagcagagccataaaccatgatgaccttttaactgtggggactgtttaactgcacagatcatatgcccacaaaatctgtcctgccctgggagcagactacaattttaaatggagaggatttcaattttgatatattgccatgtgctggtgatgatttcttatgttagataagtacctgcatatacaataaaccctttagattctaaatttgtggcagtttcccatttcatttatttattaaatgagaagataataaatttaatattgtaataaaagatacgtttggagaataaataacttataaacttatatttaaaagatatccacaatttttaaaagttgaaatatttttggaatgtatacatacagaatttatgcttctttaccctgcaacaataaaatacaacattccaactcaaaaaaatatataaaaggatggcatagggagcaagaaagtgttttctgaaattaagatgtttatcagttctcgatccatgaataacataatcaatgactaaccataaaaaataagaaaaacttcagacagtttgtataagtcaacaggagaaactcaaaaaacgtggggaaagaaatatgctgggctgtgttttatcagcacaagagcaatgagtcatttaggggatgctggaatctcttgagtaagatccacttgacaaagcatttatgccatctgatgtcactgtgactcatgacgaaactattatttttgaaaactggcttgttttctttagcatgaatcactaacttgagtttttaaaaatatgttcatcttctagccacagtagaaacaaaattaattttgaggaaggtgagaatcgagtagccagggtgcttatagtctcaagtcaggtaccaggaaggaaaagctctactgagttcacacataaaaggtagctgccgattgtagacaattttgcctcctctggctccattctctaacagagtctatatttttccaccacccaatacctatcgatttataacattaagccagaaaacaaaaagccatccttcccctataagacgagtaataagcattgataaaatcatttcatggatagaaattttgttaaaagtttagcattgtgacattttagtccatctgcaattttctactatttattctgaaactgtctgtagacccagttttgattctatttaatcgttatggaattgttccactcaaatacataaggctgcacacacatacacacacacacacacaccatgctatttatacaattacattaagggattccacttatgttgaaaataacagtgttactgttaacttgtgtcttcttatgtataacagatggtttacatgttgttttttaaagagtagatttgatataaaggtagctatgagactgtacaactccctctgtgagtactgttgattttgatgaattggttcttttttctcccaaatgacaatatgttcaaacagctgttgaacattcaaccaacaactattagggtgaccctaccctctgaggatgtatcatcttattctgaaaatattcattcatctttttgggttctcacatcataatgaatgcatctgttataaattaatattataaaattaatatttgtggaattataagggcttctacctctatagtaaagatatgtatttttaactttttgaagactatatgctacaagaaaggatagtttcatgaaaatattgagtaaagttaggaaatgaatagttatgaatgcaaaaacattagctaaactattttctgagcttttacaatgtattagtagttttatatatatgagttcattttattttcttaaaaactcctatgaagtcagcaccattgatatctctattttaaggatgaggaatctgaggcttgaataattttagtaacttttccaaagtcccatagcttgaaagtgaaggagaaaagatttgactttaggcctcagcacctacggacttatgtattacattattatgtaattcagagccccctttagttattaattcatattttaaacatttattatattggcctgtgatgtagacaggtatgctagaagcatattagaaaatggtttgcacatagtatgttttattgcatcatgtgagtcctcacgagcattgcagaaatttcatataggaagcaacagcactaaattttattatcatcttaacaaaaatttaacttgaaatttttatagaaagctaaatctgataggcatccattgaatggataaaggacatctattccaattatggaaattaagggacaaaataaagacagagagaaaatacttcagtatttttaccaaaatgcaggttagcatttcacttttttgttggcttaagtctcttctacctccatatataagttgcactttgaagacaagtatactaatgttcttgtgttatgttctcagtgtctacctcagtatttgacatgtggttaatttacagtaaatacatacaaagcagggaggcagagaatgatattgtttggctgtgtccccacccaaatctcatcttgaattgtagctcctgtaattcccacgtgttgtgggagggacccggtgggagataattgaatcatgagggtggtttcctccatactgttcctgtggtagtgaataggtctcacaaaatctgatgattttataaggggaaactcctttcacttggctcttcatttgctctttgcctgccaccatgtaagacatacctttcgccttccaccatgactgtgaggccttcccagccatgcagaactgtgagtccattaaacctctttttctttataaattacccagtctccagtatgtctttatcagtagtgtgaaaatggaataatacagagaaggagtgaggaaagaggtggaagggaaaaaggaaggaaggaaggaaggaaggaaggaaggaaggaaggaaagaattaaagtaggaaggaagaaagggtagaagaaagatgtaacgagaataagagagaaattatttaagaagatattaaaacaataatagctattatatgaggagttagaaaaagagggctttaaccataaatgaacagaaacttttcttaagttcacttcataacatacagcatatttgagaaataattagaagttgtgataatttcaccatgtcacatggaaacttatctcgttatgtttaattcaaactttgtataattatatataattcctaaatagccctttacttttaaaagtgggtaatgatataacaataaaactaatttattcaggcatgtttatccccacacaaaatcttttaaacaagttttcaagaatctgaatttcagttataacagctgtcttttctattacttaaacatactttgtaatttttttcttaaagtaaactaccataccaagaaaacagaaacaaaaaagcaagcatgctaatttgtacacttagaaattaaagtagaagctattcttggagagggagtggcagtagctgatgggtgaggagcataagggaagattctggctgttggttatgctctgtttcttgatctgggtgctgattatattattgtttggtgtttgtgcaaactaccaagctgtatgtttttctgtatgtatattatacttgagtaaaaagtttaaacttttagagagtcaatcttgctccatgttgtggtttgtgcaaacatcaaggcataatcacagaacaaaaaaatttaagacccaagcttcaatcgcaaagctgacagatttctacacttaggctcttaagcattattcttgtgctcttttcttgtcctaagcaatatttactgtacacacagctaaggaagtctactccttttactctgtcactataatatgctttagctagacttatttgatgtcttagatcagcatcagttttagattattattctgtgtatgaatggttaaagtttagtaatcatgttacctaaatttcaaaagggaaaatattgggcttttacaaaaatgtactttcaaatcaagtagttttgttgtgtttctgaaaaggaaagagcaaacaaaactagaaattgtgctactgaaaaggaaagagcaaacaaaactagaaattgtgctattatttgcttcaatttatccacctgagattagttaatctactcataatgtaagatgtgttgtttcaggcagataactatataatatgttggtatgttgtattttgtttgttactattgtgaaaaatagtcccactggttttccaaaagatacagtaaactgcccactaattgccaaaggtgtttataaaccatcagtcatcccatacaggaggtacatataaacattaaacaggacaaactattaatttactattaattaaaactactgaatttgtgccaaattaattcaaataaacataaaaattaagaaataaaccattttggtggacaacagtgcaattttagtttatatattaactactgcctctgcttcatatgttggccctacctaatattatctttttttattccttttggtggtgttcattaatctttgaaagcaaacatgaaaaaatataaatcatctcatttagtatcttgcccttgcaaaaaagatagtaactttaaaatgaaaagcagtaaaagggtaaatgtactggcatgctggatctattcagctcttcaattcctttcccttctgaaaaatgaagggggtaaactcattgagaagttattaatagtttgccaattgattcatatgtcattgcactatacaaaatttgtagaaaggagaaaaatggctttaatatatttgaatgctctgtgcaacaaatgtcctattcctctgataagtggtagctgtcaactgatgacagatacatgccttataatagggagatgccagttaccaagtgaaagataatgtttcatatatttgaaagttaagttgagatggggataagacactagtttacctagacttccactgtaaacaaaagtatgctagttttgggagagttcgggtattccctgcccttgaaatatgcagttgattcttcctacctcctagcactatatactataatctaagctgttgtcattgtagtagtgatagatttgctctaataatgaaaatgaatttgctttaacccaatcatggtttctcatggtttgtgacaacctgcaattgaaactgacctcagaatgggaaaaaataatcaaatgttgtgctctttttttggccaaaggacttcctctgccttagagcacaatttttttaaaaaacagacatcaagaagaaaacttgtaattataattattacaaaaaaaaaagctcagaaagacaaatttgaagcaaatataacaaattacaacaaactacacagagttcattcttaaacaccttatataagaatataaattcaataaaatttgaaaaaatagaaatatcatgtcaataatttaaaacattgatactacaagagaaagcaagaattttgtattaaaacttagttttccctcacctttagtcctaacccctttgttccttttccatgactaacagttctgatattatttcctttctgaattgtaggttgccttgcaattatcttcaaaatttgaagaagtagattatgctgtcagaaatacatagcatattttgttagtcttgattagtgattttttcctgataagtatttcaaaagcctaaaatgctaagttgtgaggttttctgagagaaaataaaaactcatctcttggaaagtcattactttataaattgtttttattcaaacaatggaagataacataaaaatcagctgaaacatgaaataagaggaaaaaagtgcaagaaataaacactcaaggtgagcctcaacaaatccataacttaatggaaacctaattttacatacttatatatgtatgggtagcatgaatattttgatgattttgcagtgtctaattctagaacgttcttgtttcaatactgtttctacttcacagtttattattaggaaatttgatataaatttttggctaagttttatactcttctcttccaggtttctttttcccttactatcctttctgaaaatttatgttaaccagttattttaatcaggaggaatttcatccccagaagacatctggcagtgtctgtagacgtttttgttggtcataatgggggatgggaaggttgtattctctattgatacaaactaatgatgctgttaaatagcctacaatgcataggcaagccccccacaacaaaattgccgggctttaaatgcctaacaccattgttgagaaaccctgatctaaaccatgatggtaaaataaactctgtaactgacccattgtttatgtttttttctaaacaaacaaacaaatgttctcagtatttcaatagttcttgtgttggttacctgttgtggtataaaagccccaaacagtagcttaaaacagtagcaatcaattattttgttcatgaactcagcagttgagtgggctcagcatgtgagtgtttgtctcacctgtgtctttcatgcagcagcagtcacacaatgtctgaggatggggttatcttaaaaggcctatcacttgcatagccagggcctgggctagaaagaattaaacaactagtgctgaaacagtagaggctgcatggacatctcctctctgtatatggtttctttacttgatctctctacatcaggggtccccaatcccctgaccatggaccactacccatctgtggtctgctaggaaccaggctgcacagcaggaggtgaacagcaggcaagggaccattaccacctaagcttcacctcctgtcagatcagcggggtcattagattcttataggagcaagaaccagaaccctattgtgaactgtgcaggtaagaaatctaggctgcatgctccttatgagtgtctaactaatgtctgtttatctgaggtgggtcagtttcatccccaaaccatcccaccccctccatggaaaaattcttttctatgaaactagtccctggtgtcaaaaagtttggggaccactgctctacacggtggccttagggtacctgggtttctttacatgatggttacgttcttaaagagacaatgtcctcaaaaagactggcacaagctgaacaaatgtttctctaaagttgcacagtatttttctaccatattctgttcttcaagttagtcacaatatcctgtccaggttcaaggaaagttaacatagcccctacctcttaaatgaatgaagattgtcaagaacttgagggcatggtccaccttcgtatcacaagtacttatactttcactacgtgcaaaatacactcactccctctcaagactttcaaatgtctcatatattgtaatatcacactcaggtttgaggttttagtatcctgttatctaaatgagatccatgcacgtaagaagctctgtgcctgtggttgtttcagtacagctccttcagtgctgtttctctcaacctgtagatctatgatctaaagagacaagttatctgcccaccatatagctaacatacaatgatggctcacatatagaagaactgatacaattccattcaaaataggtaagatgggaggcaatcagagtcactgattcatagcaattctgaaatccagctgagtacatgttgccagtttcttgatgatggctcagtcttattgcctaggaatgatttatcatacctctttggtctgccttctgggtcttgattttgttgtctgaatcatccttccttttacataagaagtgactggtgtttgcagctgagtgttcgcagctagctttctgctcacagaaatcctgaaatccaacttccttttaaatttatactgtccctgttcttgcattcccacctgataaaatttctttaaaactatgtgggttttcaatgaattaatgtgcaattctttctattagaaaaaatacacactcacagatctcaaggatgttgtggggaaagtctttgaagttattagatctcctgttattttacagagattatctgtgaggaacaaccttggcatcattaaaagacttcttgactctttgagagagtctacaaaacttaaccttaggtcttttgggatccttaacagagggctatcttgaatttgatctttcattataaaacatgtcttaatttaaaaatattttgcaaatgagagagccttggactgagaaatattgtggtggtggacaggtgggggaaaggaacaaagaaattctgatttctttccattttctctaaatatgacttaagattaaatgtaaacttttccaactttcttgctttgttatctctctacatggcatcctcagggttgctggatttcttggtagctaaagtctccgaaatcatgtgttccaagagagacctacagaagctgcatgaccttttataatctagcctcaaagttatgcaatatcaattattcttcaatgtatttattgagacagtcctacaaagccctcaggttcaaggtggtggaaacagacttgacctcctaatgggaaggagagtcaaagagctggtgacattttaaactactgcaatgttctatatgttatgtttattttaaagtactaccccaattaggtcctattaatattaacatctatatcatctgttcatgattcaagtttttcccatcatgatctagctccttactccctatatctccttttaaagtctcactcaatcatccaacaaaaattattaaagatggcttacctggatcaggagcaataagaaaaaaattaaatacaggacatgatttacgaccttaaggcactcataagttagttgaagaaaattctaaaatatgaaacacaattctagactatcaactgatataatagcatgttaaaaatgaaatttggatttagtcattataaagtagaggcattgtttatagaaattcaagaagataattaaaatgaatcctctcactcacatcaaagatacatggtggttgagagttgggaaataataaaccataatatttaaggaagatgtctttggagagagctgagcaataagttgtatactctgcccttcctcatactcccacttacatactcacatgaaaaaatggagggtaaaattaatcccaagttggtgagagaaactttgaccaatcaagaatctcatatgtgtttgctgataggtatggggccaatgtagaatggttattgactcatgcttgaaaaactaaaggggaaacagagaaggtggcaagtgtgaaataatcagttttgccccagtgatgtgtcaaacgtgcaagaatgtgatgcaccatgtgtggatctagcaggaagcacactggcctgtaatcatttaaaaaagaatcttgtcaaaaagaatgaccttgcaggacctgaagattttagtcaaggcttgggtgcattacgtcaacatttgaggattaattagaagaaacataattaagagaggccctgcgcacaccaagagagagggaatctgagaaatttgagacagccatagaaatgcaccataagaaaaaaaaaagtagactagcgcaattcatctggctcagaaggcttggattcacctttaaaatgttcttatccactttcctctcttctttcccctaccttgaccgtagattcagaagaatctttggctagcaagtttagcatggattggggagctagggaagactgaactatcatttatctgccttacattacaaagtcccttagtgaggaggaggaaaacacttcaaatcaggttcagaatttgattattctatggggtggtttattcaaattttgcagaattgggactgtttttgccttaaagtgaccataaggctttatataacgtaagattgaacaaaaaaacacacgcagtttgccagagggtccaagctgggtccctgattgtttaagtctatttatgtagcacgccatgcttcaatgaaatctaatactgtatgttttaaaggaaaatattcaaatctgtgattgcgacatttgatgcaggtagaatggttagcccagatattattaatctcatgtcattcaatgatagaactgtggataatatttatttccctggtgttgctaaatcaccccatatgtcaagctcttacatcctagattaagcaaatatcaacataaataacaaggacagtaaatagaagaatgttatggctgggtgagcacttcagcacttttcagtcatattttagtaatggttctgttctcccagcagtgagctcaagaactagagaaatgaggatgacagcaggagggagggcactgttaactgtgcatgacaggaagcaagcatggagcaaaccgaaagagggaactgtagcattgctacaggccagagaagactctgagcatgcatcttttcccaaagatcctaaaggacagagtaaaactgagccagtgtccttacagcagttaaacatctgaagttgaggcccatcctgtagatgccaacaaaagattgaagatttataattctattgtggggccttttcttggtaatgaactaacttgctgaaaaagtaaacacacacacacattataaaatatatatattgaaatgctttattttcccatatcttaatacattttgtgaacacatagcacactatcaagaccacctcaaagactgacctggaggtcccaaagtatcatatcctaccaagtcaatagtttttaagggatttatcaacagtcaaccataaaataataacagagcttttgttaaaacagaatatattggctgttgttactaaaagattctacatctctattcatatctcagcattgctttactctgttccctcagagtagcaaataaaaacaaaagcagttacctaatttggtttattcacacacctcaaaaattaactctaggtcaaatgtctattcctcattctggctttggaggttataaagggatggaaactgggtccttactagttggtatacataaaattgtctgatacattttagtagggagcatatggtatgcatatggaaaatataggtccaccatatgctggtgttaaacccaggtgtcgtcctattaattatttgtgtttcttgagaagaatacagagacatatgtgcaatactggcattgaattcatgttcaaatctgtacaactattttatacatgatagccacatcacacaacatttattcagtattgtttatatcaattgactaacaacattgtctcttactactctgaattttaagaatatcaaacaactaatgttgctagtttcatcgttgttcctcagaaatttataaataaataattacagtgtatgacttcctacataaattccctaagccactgtggatgttatggaaataaaatgtctatcttagacaagaaacatttgttaagataatgtgttagttttctagggctgccaaaacatagtgccacaaactgattggctaagaacatcagaaatttattgtctcacaattctggaggccagaagtttgaaatcaagatggccctttgaaggttccaggaaaggatctgtttcaggcctgtctcctggttttggcagcctcgggggctctttgtctgtcgctggccatcttcttgctgtgtttcttcacattgttttccctctgagtaagtctgcatatctgaatttccccttttaataagtacctattatattgaacaagggctcactctagtgacctcattttaacatgaatacctctgtaaaggcactatttccaaataaggtcacattctatggcattggggaacaaatacatgagtttgggggggacacaagtcaatccctgaaggacagtctccttttccttatcattttttctaacagtttaatttttaaagtatttcaattaaaatgttaaagtgctattgtaacatttttcagttctctggagattgtaatacaaataaaatgtaacaactgccttaaatttcattggtaaataggcaaaaagcatgtaattaaactgtttctctctgaaaagatttctgaaattgtgtgttcacaaattgtgtatgtgtaagtcttgtttagataacaattaaaataggaaagcaaagtttttccttaatttgaacatgtatttgttcgatacaatacccatgcattataaatttaacttttataacatactgaaaaacttcaaacctgtataaaaaaacattttcatagattttaccatatatataatgtatatatcttttaagtatgaaatgttgcctttatgatttaaaattcattattaattatggttcaaaatagtttatggcaaatgagcactccaacacccaatgattcttttaaattcttgacttcaggatgcatacacctatttaatgatctcctcagcactgttgtgtctccccaaattgtaatgctttaatgatgcaattggtctttgataaaattataggcatctctaataattttctgaaactgatttttgctcaataacaagtgtttcaaaaactgggtcatccaatgctttaaatttgttgttattacttgcagagccatcttttgggacccctacctcctctggcctaccatattatatggggtatttaaacagcagcattatgtgtaggttgattatgatattttttcactaataataactattaataactacctgagcttctacataatagatgcagtagctggagtgacatattggttcattcatgtgacattcaaaatgaaaataagatgtgctatgtttgaaagacagcctttgattttggtgaaatgtcatgttataatgtcaacataagttatttgttaatttactgaaagcttaaaaatcaacattatctcttgaacttattcttcctatccaactctaacttttcatcctttgactaacattttcccaacattactgcacccaaagcaggccagcctctagtaaccaccattctactctgtacttctgtgctgaaagcggatgttaagtgttcttaccacaaaaatgataactatatgaggtaatgcatttttttaactagctagattcaaccatttcacaatgtataagttctttgaaacatcatgttttacacaatacataaaactttatctgtccatttaaaataatcagcatcacctgaatttaataggatctctcacagtgattaatagcttaacaactagtgttttgaaagtcaaaacatctgaatattatggaattgcctagcattttatttgctttattatatgctgtaaaagaaagtacttaaactgaggaactgacttccttagaagctagagtacaccagattttcctccttttccctattttttaatgaccagggagctgtgtgaaaattgttacttaatttgttctctgttagttacgtaccagttctctgaatctcagtgaagaatatcacatccttagccttaaacaacttgggtgaaagtgacaatgattttgagtcagaccagacaacattaaagactccacaaaaatgggataaacacggaggctaaaacatcagcgccccctgacatttttgttttgttttgtttttttggtagagaccgagaccttctctgtcacccaggcagggagtatagtgggcgatctcggctcactgcaacctccgcctcctgagttcaagcaattctcctgcctcagcctcccgagtagctgggattacaggcgcacgctgcctcgcccggctaatttcttttgtatttcagtagagatgggatttcaccgtgttgtccaggctggtctaaaactcctgagctcaggaaatctgcccgccttggactctcaaagggctaggattacaggcgtgagccaccgcgcccggcccagcgccccctttttattttgtatacaaccatgctgttgtcacatttgtgattaaaatacagtagacacaaattacgactttatagtaagatgctgaagaattctggcttttcaaacaacctttccaaatgtggaaagttgcattatggttgcatttttcctagacttttaggaattaactgctttacctctagaataaatatgatagaatacttatgaatattagagaaaatatacaatcacacttcaaatccttcacaaaagaatgtccagtgtctaaagactatggatcgtttccaattgaaactggagctccttcaaatgctcatctcaaaaattcagataattacaacagaaacatcatctatcatttgacaaaagacagtttaaaacattggaaatttgagcaagataatgtcataaatatagctatgtcttcctcctaacatttaagaaaaagtttattaaatcaggtcatcaggaagtcacatgaatacacattatctttatttcctacaaaaatgtttctctaacttaaggcataaatttatagagatggaacgtcaatatgcaggtgacaggtctgatagagatccaaaaatgtaaattgtccatttgaataacactgctgtgtaaatctgtggttgacaatacgatattacctaatatattttatatgcctaaactccttcttattcactggcatgaagaaatgtgtctattcacattaagcaaaaatggttgatttttttactggacaaagggaactatacaatctaaatgtttctcctatttttgccatacgttctagtaacacaaccttggttagagtacaactgtagtgaattattaattggatgtttgttaatatgtgcatattcctttctaatatttttgtcctgttcttattgtttttgtttaatatgcatgcaacatcaagtcgaattttattgttattaaaaaaagtgtggtagttacatataaagataaataagtaccacctgtattggtgattatagctaattattgacaatctaaaattaatttgaaaacgtagagatgttgtccacaaaggtgtaaatttttagatattatagcaaaaatatttcttctgtacacaagtatttgaacatacctaagagtctgcagaggacttaaaagtatattttccatttgaagtaaaatcctatggcctttaaaaactaagacgtgaattatattttaacccaccctaagttaaacatattgaaaggctctattgtaatcacatcttcaaatgtatgttttcttcattctcatctatgttgaacccttaacaataattgttatcatttatactgttaaatccaaattattccaccctagttgacactaagtgtttaaagcaaataaagtctcaacatataaaacttgatgtgcacttttaaaatagtatatagtacttacccatccaagtagaatgtaacagcagctgagaagctgtcaaggagaaaaatgccagaaggattaataaatcatattgctataacatgatgatgagaattataaacagctatgtaaaaattaggtcactggcagtcagatgacttggcttcttttagtggtggtagtagaggagtgtatatttatcttttgttatgccctggtaagtagctggcaagcttgcaatatataaacattatttaaagatgttatgattggcttgaatccaggaaatgttctcagatttaccattagctatcagagatcttaaatattgctagagaggatcgaagaggcaaaggaaagccagaagttaaaaaaaaagatattaatagtaaaaaagttaggaaataaagcatgcatacttaatgatacaaaaattttaaaacagtaaaatctaaatgttcacatagttcttaagaaagagtgattattaaagcatgttattgaaacaaagggagaagtgatctaaaacaagggcttacagaatactttttaaaactttttattattttcattattttatatacatggaaatcattgttcataatgtatttctataatattatatatgaaaagatctatgttgttattcacagccattacttgtaactttacacaaaagtagtgatatgaccaccagaacaaaaaaaagaaacaaacaaaaaactcacttaattctcaatcctcatgcaatttaactgaagaagctcttgagaaggccaagtaataacttagttgtgatgtactagatttactttggtgatttaacaatgctcatgcaattaatgttctttattgataaataagttttattcagataaaagttaactatatttataaaatcatatttccatagaaaaagtctatgaggagtgagatgtgtttacgcaataaatgagaaaagttttttaatatcagtccactaaaatgattctaccttgtattacataaattaataactcttgttatgaacatagattttaaaatgtagtcaagaagtaagaaaattaaggtcattttaattctaccttgtggagttattcattattaatatttgagtctacatgcctgtcttcttcccctgtcttattatagaaatgttggctattaaagaaaaacacaaagatatgtaagatacaaagatgtaaaaaatgaatgtttggctggttgcagtggctcacgcctgtaatcccagcactttaggagtctgaggctggtgaattaccggaggtcagcggtttgagaccagcctggccaagatggtgaaacctcgtctctactgaaaatacaaaaattagcctggcatagtggcgagcacctgtagtcccagctgctcgggaaaccgaggcaggagaatcgcttgaacccgggaggcagaggttacagtgagctgagatctcgtcactgccctccagcctgggtgacagagtgagactccgtctcaaaagaaatgaatatttattatactcccgctcactactgttgagtttgctgcatattaggccacacttttttctccgtacataccaatgtgttttaacattattgtctagtgtacaaatatatgtatagataccactacataattatgaaaatacactgttttctcacttactttttgtcttagcattatatcttagatgcctttcgatatcaattcaaatacacctacttatttaatgatcatatacttgtaataaaagaataagaaggattaattcacatgtagctttctagtaatagaataattctgcacttaactataactcttgattattaaataaggttttatagttaaaacataacaagactaaagtgattttgcaagaagacacataaaagatggtaaggagaattgatgttctgtgcaaatttcaatgatagatgctattatatttgctagcaccacagggtaagtatagtcaaaaatcatttaattgtacatttaaaataagtagaagagtatcattgaattgtttgtaacacaaaggataaatgcttgaggtgatggataccccagttaccctggtgtgattattatgcattgcctgcctgtatcaaaatatctcacgtaacccacaaatatatacacctactatgtatccacaaaaatttaaaaaaataaaaatttttaaaaaaaggaaataaacttttataactaataaagccaaacacttccttcactgaaggcaggtgtaaaagatttgattctgaatagaatagtgtgagattactgggagattaattctaaagattttcctaggttgatgctaagaactgctataagttattttccaaaattgagagggcatttgaaacttaggagctatttaaatattgtttaatttttatttcaactaacttatttttgtcaaatttatatgcatatatattaaatataaaaacaaaaaaaactgtggaaacaatcatgtattaaaaggatgatatgcatttgaagaatggacacttattctcataacaaaagccctgaaaaaatgttgtacaacacttcatctaatatctaagaaatcattcccctagatgggagtagagtatctgttccagttttttctaagttgttgactttttaatgggagatttaaaatgtttatacagacttcaattgctcttgttcctaataggcaccatcagaaataacatgctttatactgttcaagacaaatttgtaaaaataaatcacttctcatttttttgatattaatcatggcatagtttcttttttaaatcttaggtgatggaaaaataaatcatgtgctgtgaataccctttgaaccacaagcattgcaaattgacattacagcatagatttttcatcttgacagcttatcgtaggagccaaatagccccagattttcattaaagaagaaccaaataaatctggtcgaacataaataaaacaaaatatttgtttatcactgtaaagaaatcaacttgtagattgaattccatataatatttatgtcaactgctacttgatagattaaaattagcagtaattttgttgttttgaaagggccagagaaaagggaatttattaaattaagaaactgcacctcaatttgttttaagggtaggaaataaaaagtaaacacaggaataaagtcatatcatctttttcaaggcacagaagaaaaaacatgtacaaacatgctacagagtatttgattaacaggaaatgcttctgccaatacaaatctcaatgctataagctgttgttttgtcagcgtacttgtaggataaaaggaatcagcttgaacgtattctaaaatacccagaaatagtgtctctgtgcaaatatgtgatatattgacataaaaagatcagatgagcaattttttttctaccataaattcatacaaagagccagaaaaagagtcaaggatctcctgctattgcagaatatttcattaaaggtaaatttccagtaaaatactgctgtgtttttggagtagaaattaggttctgcacatgacgtgggttaaagaggatatctaagtaaatataagacaatttaacgcagaatctaaattaaggattatgatcctcctcttccttttaaaaaatatttttattataaccgctattaacaactattgttatataatagatgttgtgcttattcttcagatgtgttcactttatttaatcctccacagcacttctatgaagcagctatcattaatgccactctagaaatgaaaaaactggtcacagagagacagtaatttgcttttggtcaactagttagtgagtgtcaaaggcagaagtgaagtaagattatctgattccagtggctgttcttttgattcctgtgtagatgtcaaaataacccatttgtatagaactttgagagttcttaaagaaattttaagcctcttatctaatttttcacttgtaactattatattcagtctgtggggtggtagctgttctgtataatagagacactaaaaatatatctggtttttagtagtagttctaggagtgattaacttcagagcttatgatattatcaactgaagattctattgcaattgcatctcccttgccttctgcccaatccagcttctcttacttctttcacagtggttttctctaagaataatacccaaataaatttcttgtatgttaatccatatttaagagtctatttccagggacactgacctaaaatagtaatttttcaaaatcaagccattctcttgagtcttttgttgaatcatcttagtctctttaaaattcttttgcccttttcttattttttttcagtaccttcgtttattgttgtaacctatgaagtatatttgttttttagttatgttattctgttcccatattaggaggctccagcttgtggcactttgtttccttaggtgttttgtgatttttctttagtataaatttatatttctaaatttttatttgtgataattgcttgtagtgactgaagacaagttcttctgggaaaaaaaatgcaattgtttctgctacggattgggggctataccaacctagatgcactttaaactgtagtattgcattaaggttttcgcatcacacaatttgaggaaattcaggctgcaatccaacataaaggctgttttttagctagaagcattacttttttcccccttcattcagcactagaagtcaagataggtatagctccttataaaaccctgaatgagtggacatttattcctgttttatgcttaaaggaggggctaggccatttgctgggcctaggtttatgcagggattatgctttcgattttctattttcagccaccactggacattttctctctataccttgtgctttgaaaatatatgaaaacaaaaactcaagtttactagaatgtgcaatggctttcaaggtggaaaccagtatcagcattctgcttgtcactttcattttatcctttcatttacttatgccttggatactctttactttctatttagttcatcaatgcatttgaatgttttaatacaacagtaccaatctttttggcactagggactggtttcgtggaaaacaattttttcacagaccggggtgggggcatacggtttcaggatgtttcaagtgcattacatttattgcacactttatttctattattattacattgtaatacataatgaaataattatgtaactcaccataatgtagaatcagtgggagccctgagctttttttcctgcaaatagatagtcccatctgggggtgatggaagacagtgacagatcatcaggcattagattctcataaggcgtgtgcaacctatatcccttgcatgtgcagttcactagagttcggactcctgtgagactctaatgccaagacagatctgacaggaggtggagctcaggtggtaatgcattgatggggagcagctgtaaatacagataagcttctcttgctctctggccactcaggtcctgttgtgtggcctggttcctaacaggccatggaccagtattgatctgtggcccagggtttggagacccctgttttaacatattcagcatttatgttttgtttgttttctccagcaaaaaaaaaaaaaaaaaaggatgagcagattaaccattcagccatactgcagaaaggtgtttctcccagtaacagtcatcaaattgcttcatttttaacatgtggtccttttcccccagcccagccagctgtaattaagtgaaagtacagagcagagatgtgaactctttttcattttaataaaagctatattactgacataatagacgaagatttggaagaatgaaaaattaaatcagtcttccctctcattataactaaaggataattactctatccagtataaagaaaggttgaaaaatgcattagagagaaatacttaaaaactgatgggatctaagaagactcttttcattgtattttctgctatcattgagaagtacatgagattttgacagaacccacagaacagtttggaattctaaaaataccacattttcccttaattatttctggaacagtgtaaagaattatgcttttagaattccctaataacccaatgaaaagggttaagatgtatttttgttgcttaagaaggggaaggcacaaggcagccatagcaagtatcctatgatccccgagtaacaagaagagcaaaacaaacaaacaaacaaacaaacaaacacaaagtttggctgagagaaagcaagcagatgttgaaagggtctgtgattgtgataagaagacattataacaaagagtagtgtaaaatgtatgtcaagaaaccaggtggaaatacagaaacctcaacagatgccaatgtggtgggtatgtgagacatgattgtacatcacaatagatgtcagtataggacaatggaaggctgattcccagatgcctcaccatctaatataattgtactgtatgaactttccagaagttaaaccaatccaaaaagcaaggaagaagggggggagacaattttgatttaactgaattaaaacccaaaatgcctgagaatcctttaaaacctctgaacttacttggaattgattcagttaagtttttctgcctctaagcaaaatgggaatgtaattagaagacaattctgtttatgaaaaaaataatgaaattaaaataaagcgaattacatattgtgttcacttgaattttacaaaatatgtatccactacatgtggagatcaagaggctagtctctcaagaaaaatgtcgtggtcaattctgtaaaatactgccgacagctaaggtaggatgggaatatgtaggatctggcaacaagttattaattggtgacatagaatcagaactctagtgtggcaaaattaaatgaaagttgagaaagtttaagttgcctttataaaagagaaaataaaaactgttgttaaaagctagttatgaagggagattgaaataaaaagacaaattaaaaataattgctaacaagagatattaggtcgagacaaagcatgccatgttttatttaagattagggatatgaggtcatgtttgatcagaaggagactgtgacagaaattaagatgttgaagactcaggaacaaaaacagctaaaaacagtgggagtagaggggaatgcatgtgcaggggctgaacttgaatcggagcagcgtgtccttcattctaatggaaaggggcatagtatgagctgaatatttgtgccctcctctcaaaattcatatatacaaatcctcagccccaatgtaatggcagtaggaggtagagcctttgataagtgattatgtcttcaggtggtgcccactagaataagattaataacccccatagaaagagacccaagagagcttgcttcttctctctctgccctgtagcacatgaggatacaaaagaagaccaccgtctacaaatcaggaggagtgccctcaccgcaaaccagatctgtcagagccttgatcttggatgttccagccactggaattgtgagaaataaatgattgttgttgaagtcaccaaatatgtagtattctattatacagtagcctgaactgatgggacagagaggcagcaggtcagttcttacatatggtagcaaaaagattatgtagttaccatctgctgtatttgttctggtaagaagtgaaataatatactgagattaagagagggaggaaaggagtaggaaaacatttaaatagtgtgtataagatgttatttaattgcggaacttggccgagtaaacttgctgaagaaacatgattttttgtgtgttttgtggaaagcccacttgagtttggttctctacataaactgtagagaatccaatctacttaggatgctttgctattcagggattttgtccagagtttccatctcgcctaatgagtgcgagattagaacaagggagtcaagaatattttaaacacagtaatagtaagtattatgcaaaaatgaagagaagctgggtgtgaagagtgtgaaagtattagggagatgactaatcccgagagagggtcagtgagttgggcccctccttgtagaaatcatttgtgatgatggtagctgttaaggtgatgatttcagttgatgaaatcatcaatgatttgaaagaagtaactggaaaatttgtaaacactccacatcagaaaggaaagggggaggtagacacggaagccaggcagttcaaatctgatggttaaagcttagcagaaataattgcctggaagcagcacaaggaagcaagggagaatcataatcgtgaagaatctgtgatggatagatttctatttcattttggggtcaatggaagtatttgtgaacatggaaaaatgtgtcatttctttgaatgggctgccttctaagaaggcagtcacaggaaatactcaaataaagactaaatattagttatactgtgaagaagttattttgtatcttcagatacaaaagattagatcatataatctttgaaatctcatcctactccaacatctcttctgaaactgactgttcatcctcccaccacctacatgtttttctcttaagttcagttattagcaaaatcgactatatccttaatctcttccttgaatgtctgtcacactgacttgctctaacttaaacctggctattttccaatgataacctttcttctgcatactttatatgtttttacccaaagtgggtaagtgtatttttgtattaaccaccctgaagagatattcatacaactgtctttaccttttctataaaaagcctctctctgttgctgtcatcaaaagtccccttcctttgttctttgataatcttagttctttactcattgtaattctctccaaaactacttctgtggtaattaattcacagttgaagacctagcttctccattcttcttctcaatcatcttggtccccattttaactccaaaactaacttctgtgattgtatccatgactttacagtaagccacactgttggcttactaacaattactattatcctaacacctcaatttcaaatatgtcttataattttctattttttcagctcaatccctcttagaacccagctccaagaatcttttgaagccactgaaaccttaccacttttctttatgtctccttcctcacccaacattcatacttcccttattatccggcttaaattttattgctaatcactataaaatcacttccttaaatgcaacattgtttcctatcttatttgtatagtatattaactaaatcaccccaacaatgattgaaaacagttctccacatactattcatctgcacctccaccagtgaacgagcctggagggaaaaccaaacacccaggactgactctcctttaagatcatgagcactaactcacattgtatcatcctaattcattcacttttttactgtacctatatagaagtcttctgtactatgtcctcttgcctcaaaattatccactgtctgctgtgaccactttttctacttcacagaagaaagaaaatcatttaaaagacaaattacaaaaactgtctcttcacatccattttcccacatttatacttgaatattctaatttattttattagcatggactggaccctaagtaaatacagtccttctattgtgtacataaccttatccctttccttctcgtgggcattgctctagtaattttcccatctctctcttgaaccatcaaattttcccatcaactggatcatatccatcaacatcaagctaacttgcaattctataaaaaaaaaaaaaaaacctgccaattttataaagacaaattatcttggcccactttctcttccagctattatctcatttctcttctatcaataaagtaaaactcattgaaatggctgcttcgcttgattccttaaatatttttctacctattttcttttgggtcaactatcatcaaatttttatccccacagctccagcataactgctcattttgttgttaaaattagtttctacagtgctaagtccaatggtcaattttcagtactcaccttttttggcctatcagaagcaattggcaccattgatgagtctagccaactaaaatactttttttttttttttttttaacttggcctctttcctaataacacacgggcctggttttccttctattttgctgactacttttcctcagtctacttttttcttaaataatctagaaaacctctaaattttaagctacctcaagattcaatctttgaactgtatctctatattgattcccctaagtgatttcatccagtttcgaagacaaattccatgccagtaccgatgcctttcaaatttatgtctccagctcctaatactttctgaactccaaacttacttgtacaactacataagctagttatataaaatttaataagtcaagaacagagaccttcacatccacccctaaaatttcctgttttgtcttcaccaacacagtcaataacaattctttccttccagtttcccagttaaaaaaaaaacagacttcctttagtcttttatttttctctcacatacacaacttgagtaaatactactggcatttctttcaaaatatatctcagcaattcttgcttgcacactagtccaagtctcttacctaaattttagaataaacttctacctatttctctgctttttcttttactttttagtctattttaaaaagaagccagagtgaccctggttaaacttaggacagatcacaataccacactactgaaaaggctttaattgatcactgttttccttttcaaagtgaatgctagggcattctatttgttctgtaaacttacttataatctgactttcttctcctcatggacctcatctaccacaacatttgtactcagtcattgcctactccgcctttataatttcaaaactgcattaaggtcacacaccacctgaaggtctttgatctggttgttccctttttctggattctcttctcacacatatttgttttccttcatatcttaattttttaaataatgtttttagtgaggtattccagccaaactaccccaattaaaattgttattttaattcttagacttaacatgtccttaactttttaaaaaattgtatcacttgctactattcaatatatggatactttatatagttccttggttaatttgttttccttctagaataaatatcttcatacaggtgaggatttttgactgctttgttcaataatggatccacaaagctgatacacagagcaggtactcaattaatatttgttaaatgaatcatgccattcattcaattttatagtcagttgcaagtatgaaattcagtttacattcatccaactcatacgaggagtgcgttacatattgttcgattttattactgcttttggaagtcagcctctgtatcaatacaatttcaggactgattattaatagaaaatgttaagaatatgacacatatgtctatgcatttcaattgtaaaaataaattaagtccaagactgggcttattaattaggactttggggttgaatttccaaccttgccacaaaattagctggtcctgtgaatctctaaaactgaagaggttgaacacaaaagcccgtttatatttttttatggtgtccatgctattactgggaaaaagctcttttatcataaaattttattaaatacctattcatagctatagcagaaagggacaaaaggaagatttttggtgtagtaagcattgaataaatgccattaaatgattgtcgttagggtatccacttttatttattattgtcattccaatttttgtcttattactctccttaagatgggtaaagcagatttttaattcagctatgtttccctgtgcaaaaaaaaaaaaaaaaaaaaaaaaaaaaaatctatgttataattgagacaaaagctttttggaaagcaaacaaataagctacaaatgatataaacttaagtcaaagcaaacatttttcaatgtttgtagtacctgtcctaaagatatgctgttatatttacaagtctatattttattcataaagagtaaatttccaaattcaaatacatgtttattcaactttaaaatttatatattcagatataaatcatttttagtcatttactcttttaataacatccaaactaaataaagcatatattctcacttaggaagaatatgtatatacagttagccctccatatacatgggttctacaatcgtaggttcagcaactgcagatgtaaaatatttgggggaaaaaaaaaggatggttgcatttgtactgaacatgcacagacttttcttatcattattctctaaacaatacagaataataacaatttacatagcatttacattgaattagatattataagtaatctagagattatttatactataaatgaggatatgcacaggttatatgcaaatactacactattttatataaggaacttgagcatctatggattttgttatctgcctggtggtcctggaacaaatcccccttggatactgaggaacaattatttttgtgtgtgtgcgtgtgtgtgtatatatatttatttatgtatgcacacaaacacacacacacacacatatatatacacacacacataagtcctaaggcatattatatatatatatgtttctgtaaattgagagtctatttataatataatattccttatgagctattcatagctaaaaagcttctccaaggatgctgagtactccatttttatccccaagtccataactgttgctgattcacaatcattatttttgaaattacaaagatacttgaagcaaaatgttcattttcattttagcaagaacccttcattatttcaatccttttccaaattctttgcagacaatgttgaaagctatgttctctttttatgaagacaatagaattaattttgtttcagattattatgagaaatgtggagttttagaatctttttttctttgaaaaaatactacttttgtgatggttcaaaagttgtaaaaataatcatggtcataaggataggattcattatatttttataatgctttttgctttcttttgtagattttgttcagtagaaaattttaaagccaaattgaagaagtttgtagaagtgtgtttataacactgaaataaaattgaaagactaaatgtaagcttttattaaccaaaaagataatagagggtgcatttaattagaatattaaattagaacaaataaaaatatatttttgaaatttaatgccacttctgattttgtagtttttatgcataaaaccatttctgcacagtacatcttttagagttgtttgtacagtagaatgtcaatgtatgttttagtaacacttctataataggtttctcagaattcacaggatttcagaaaagcctcaaagtcctcatggccttcaatagagcaattcttgtaaaataaatatcggtctggtcttattcttaatgacattaagtcaaaacaagtaatttagatacaaatgctagggatttgttatttgaatgcacacagttctttagtaaaaattattgcatccactttttaaaaagtaatttcaacttttatatacagagagtacatttgcaggtttgttacatgggtatatgatgtgatattgaggtttggaatacaaattccgtcacccaggtagtgagcataatatctaataagtagtttttgaacccacacccacctctctccctcccttatctagtagtccacattgtctattgttctcatcattatgttcatgtgtactcaatgtttagctcccgcttgtaagtgagaacatgcagtacttggttttctgttcctggtttattcacttaggattatgttctccatacccaaaagaaaataaattgttttaccaaaaagacacatgcactcgtatgttcatcacagtactgttgacaatagcaaagacctaagggcccatcattggtggatgggataaaaacaatttaaaataaagacatttaaaatggttttagattatactttaaattatttggttttattttcagttgttccaagttatcaaacgtagaaattgctgtataatatttttatatgatcctcttttgaaactataatgcatattattgttaaaataacacactgaatgtagtaatttcctcactttttgcataacagtaactaaacaaaaaagtggcttagaaatattaatttaaaaattggaaaaccaacgtgttttgtttggtggcattttagttatctgaagtgtaagtaatgcttgaaaattgttttatataattgtcaagaagcaaaataaaatttacttttaactcagaatacaaaatgactacgcagaatcagtctctgacactactcatagaaagcacccccaaagatttcagaaatttcatgcaagaatagttttgcttgtgcacaatgattcatcttcctcttattcctacccaactgcctgagattttcatgtcatctaaggactcttctaatcctgagatggtacttttgaataggatctccctttagaatactaaatataataaagaactatcatgaacagtagaatttatttaactcctccatagttttagactacatatttaaaagtaaacaagcaaaacagtttacaaaattgttttctgtattgtatttaaacaacattattttcacatatttgattatgtacctttaacttgtaaggcttatttgtttatttagacattgaaaattaataaggtggagttagtctatggttctttgtagttaatttatatatttattcttatttctatggtttcttgggtcaccttctgggtttagggttatcagagattcatatttcatatattatttacctcacactgtacactccctgatacaagtttctgaagaaaagcatagtgaatatttgctgattaactaaaaccaactgagaataaatatatctttgcactccctatttggaatattttgttgtttgtaaaaattcttcctttttctcaagtgcttgctgcatgttcagtatttgtagagtatacttccttaattgattaatattaagcatggctctttaacttgctttaaccattaaagaaggggcaggtgaaacttcagagttaataaaaagttgcatttatctgtttctgcttaatagtgccttaaaagatgttgcatttatgtgtttctgcttccaccttgctccatgagtatgacatgcctcagtttgccatttttgctgtagtcagattcccagaatgaatacacatgaaccaaaccctgtgatccggtttagtctgtttagcctaaatgagattagtggacctgaagactactgagattaaatgaataattattgagccattgagtttctggaggtttgttatgcagcattatcctggtagaaaaatggcaaacactccttagcatagtaaattagtatatattcagagcctcttaatataattgtaaataaatatgaaaagataggaaccatcttggcatgtaatcaataataaaaaaataatactaacatatcttaaatcttccatcttgattaaatagtgttcacagttgatttgttattcccaaactaaagctattacactgtacatacatttgcataatatttcaaagagcaaaatatgtaacactttcattattccaagaaaaatgtgtttatgtatatatgtgtgtgtgtatgtgtgtatgtgtatgtgtgtatgcatgtgtgtatgtgtatgtgtgttttgcatgtgtgtatgtgtatgtgtgtatgcatgtgtgtatgtgtgtatgtgtgtgtatgtatgtgtgtatgcatgtgtgtgtgtgtgtgtgtgtgtgtgtgtgtatagaagtgtcatttcggggtcagtctcaggttactctctggcttccattcagacacaataagtacggcagagttaatataagcatttcttcacaaagaactagggaaatggccatactgtgtaactttaaaacttttttaacattagagatagattatatacaaagaaaatatattctcaattatatattgttgaaaattgcaatgcatacttcagtgatttaataacttatggtacatatacattttatattttaaaagataatgtatcccaggggaaaaccagctttctcctgaagagattattttacacttgatgtaaatgtttagaaagtattggcacaaaataagacattacagctttcacataagttttctggctatgatagatttctgggtccctaaagtttctgctttgctaattagccggatagtatgaaataaagactcacagggatgaaagcacagaggaaataatgaatacatttccttaattttacagattgttaaacaaagcccaggtttttccaggttcataaattttattaaactgcaaatcaatgtccatcccagatacctctttggtcttccatctctataggattactacttagacagctgactcctgaaatactagtcaggcatttgaaatttgacagctgtaaaattaaatttacttttatttttcacagttaagtgtggctttttttcttactcaattaaattgttattaagtattaagtagtatgaacgttggtatcagcaggaaaaagtggcacactcaaaatgtagtgatttaggagactttaatgcaagggcagtttcaaagtataaggacaagttcaaagaaaccaacaaggcatatggaagcaccctgagctgagcaacagcaggagatatgaatattacttggcttgaggcagtgggaaggaacatgtactgaaatttacagcgggctgaagctggtgctgtagctgcaactacaagagagtactgctccacaagagctgtaaaatttggtagagaaactcagcaagggctaatttatggccagttagggagacaaccacggaactaaataactcaacttctttctactctaccatattctctcctgaggatagcttccattacccagactcaataggttgctaaggaaaaaaaaaatatgattgacaaagacagtaaaggtttgttttctggtgccaaagcagggtggggaagaataaacgggaaacctagaatggtaaacagagtgtatgtagcacacttgtacagtgtttcaagaaagaaacagaagaatctttcaaaatctctcctccttcactccatccaagttcatagtacattttggttcatctaaaactccagtggaactctgcctctccgtggattggtttaatggattgaagcaaccactggtgataaatgccagctctcagcacttctcataatgaggtaaaaaaaaaatcacaagtgatttagattctccattattcattattcactatttcaaggtgctttattatgaaatccaggacattcttagcataacaaatccagagttaggagtctatgagtatggatgtgggtgtgtctttgtagaacacactctgagattctgtgtggtaaaagctctccttcaagtgtgtcacttaaaaaatagctgcaccacatctgagggccctccaccacagtatgaacaattttatgacaaggatccaaacccgacaattaaaaaaattgaaacataataagcttaaaatgtgtattggttctggggaagaggctgaagtgacttgtggaagaagaaccatgatgcaaatccgttctgcatgcatcagcctgcaatttccttaagcactcctggacagagaagagaatgtgcctgcaggtaatgactgagctggagaaatagtaaggctgttcacccaaccttctcttccctagagggtagttagagctacaccctatggggcagagaggaaagggtgtaccacctgtgttacacctgtgcaaaataaagttttttttttaaaaaatgggctcttcaccatctactgaaagacatttcatcttttaaaatgatatggaaggtctggaataactgaatgataccaagaaaggcatatatatttagattcaaaatggtcatgtaaatgaaggagttcgcatctggagaatgaacaaatttctgtgtaatcaaagtattttttactttgaagaactaaagacacatttggtataaaggaagtaccaatttcagaagatatgcacatacttcttgaatataatgttgactttgcatttctacttcttattctggagtccaactttacaatatagcatgcatgggtttttacagtgtggttaagtttcaaaggaagttaaacagcaagataatagtaacccttggaaatagaggggaaaatatatgaatgccagaaacattggcctagaaaaccaaatttttagcatgatttgtatctgttgaatgcttaactcaatgcccataataatcatgttttgattaatggtgcatgaatgaatgaatgagtaaatctggctccattaaagtatcttctttttaataaaactacaaaaatttaaactgagagtccctgtctctggtaatgaatttgtgtcagaatcaagatatggaatgactgaatacccccacatgaatcaataaagatttctttcagctgtagaaatagaaattcagcttcaggaacttaagccaaacaaagatttcaggcatttgttttaatgaggcagaattatacagctgtctatctctaaaaaagggaacatcaccattctctgaagtggtgtttgctccagcctcagtgaggactattactggagtttgttcttctagaacatttcatcccctctcattcactctgctcacagaaagctggcatccacatttcccagtgagtagtcaatgcagtgaaattctcttagtgctggctaaatctctcttgctctcttagactttcctattcaaggcagagcaaacacttgtggtattgtctgtctattttcatttcttctaacccattctccacaaggcagctagaaggatccttttaaagcagaaattttgttgtgttaaacctctgtttaaaaacctttaggggcccaggggccttaaaaccctttaaatgcctctgaagacagttcaaatgtactgatttatcctccaaagcttttggtgatctgttatttatgttgctcaggagaccacaagtataatttaagggtgggaaaattacccactgtactggactacccttgtaatgaaatcctcacactcactaaatcttggtaataccacttctctgtcattctgacatacaaaaacatctccagagacccccaaatgttcctgagaaggctggagaacctgttcagttaggactattattcactgaaatactaaacttcaaatacagtgaattattcacagttcacttaacaaacaacaataatcattttctcttacaataatcattttctcttacctctgatccttctacatgctcctcgctcttctcttctggaacagtccttcacctccatagacctgactaattacaggaagatcaacaaatatcaccttaggtatcttttctgagccccctccaaatataggtaatgtctccttctgagttgccgtagagacaccttatacttaccctggatgtgataatttaacaaaatagtaggatctaattacttgtttgtttcgcttgctacatttaaagccatttgaaagcaaaaatattgtcctattcagaattgcgttcttggtttccatcctctgatgtacttaccaggtaatgactcatactaggtgcttaaatataaatgaagtgatgagggtggcactaaacttggaacctgatgaactgagtttgaatctgtacttcaatactatttgtgtaatcttggacaaatctctgataaactcagagcatcctccagtgctccttatcctgcaggatttcagtgaggattaaatgagttaatgtatgtaaaatctctttaaacactgatttatacttaaaatcattttcaattcaaactataattttctaaatgttagtagaaatgccgttgagccgtaagttgcattttcctaaatggcttacaaactttctggactgtgcagcttgttagagaatttaaatggctgtccaactaggcgtgtatttcaaaacaattactcaattcaactatttaatcagcctgtacttgtgtggaggttgttataattcatattaaactagctactcacgaataatttcacaattatttctctttaaaattgtattttttctaagtcctctaaaattttgtcctaaattggatgaaacatagctaaattatgaaaaatacaatagcatatggacagctatgtgttaacaaaggttttagggcaatgatctttttctttttcagagcaaatttcactatagttttctcttagttaatataattgataacagttatagagctacttggcattctaaacatgcagacatgtctttcgctgtctaaagtaaaattaaaaactgccaatagtcttttatgttcagtggtagctggaaggaaatttttttttttaaaaaaaagctggtaataactggctgatacgtgcaatttgaaagacgatagacctgagttgtgcgtatgaggaaggaatgacccaaagtactgtgacaaatgcagaagagaaactatccacacaatgaatgtgggatgctaaagtctttaacagttagctctgtagcacataagttacccatcacaattaatgtcaagaaagctaatttgattagcatcaatactaaatttataagcaattaggaaccaagccctgtttaactcactgcattattatttatcaatttatcagtggatatctgattagagagatgtaaatacctgcaaaattcctttgaccaagccatgtgtagctcaaagaaaaggtgctaagctttgacctattaataggctaaagagtcatactaagtagttgactactaaggcacactaatctagtcattaggacagtgtcatcaactcattttcatataatattggcaatgagaactgtaacaaacagttctaattgtataattaccttaaaatctgcctctggcctctgaataatatcaagaatttatgattatagaaactggaagcctggcgaagagccagaaattaaacattttatttccaagtctactcctcaatgaaagttgaatctctaagaattttggctcatgtacctaacatgcaaacctattcaaggataattgactttaacatttaggaaatacgtgataaaaatactacatgaggtcaagagccatgtataagaagaggagggggagccccaagaacagaactggaggccatgctgaattttggaaatcagagtaggagaatgagtagtcagggtcagaaatacagagtgtgtaatatcatgtaaagcaaagaaacatatcagagggagatggtaatcaataattgagtatccatagagactttaactgtataagatgtgaatttgactatcttgctagagttggattttttttaaacatttacaaagccatatcttaagaaaattatcaagaaataaagaaaatttaaaaaatttagtatattagtaggtaattcagccaaagaagctagtaggtgttcacaatagttattaatatttaaaagtgttgagtgcttaattttaaatttaagctgaaaggaatatattttcttttaaccttttttttttttcaattacatccaagcttatttaaaaagtagctgacacattgttttctttttgtctacccactcattctggtactcaccccatctggtttacatatcgtaaacctgcctaaactactcttatttcagcaattatcttctagtcagcaaaaatagctgcaaacaaacatgtttaaagtaatgttaagagtaatcagacataattgaatcgtggtttttctcagtagttaaatatttatttgctaactttccattcttctaaacaatagatgcactttaaatattttattcaatatttagtatcttatagaaataaattaagacaatatgcaacctcttgagtacttcaacagatgaccagtcttgtgtcttgttaattgtattatattgcattaatttgcataaaatacatagaaacttttgcatctgtaagatgtctaatgtaaaccctataccttcattcaattgttttatgaggaaatagtatgtcattgatcttactttgatatgatttttccttttaaaagacagttcattgccctcaaaatattataaattaggtaacagaaagaaaaccaaacaatgtatcagattttaaaattttctcttaatttttaaaaatgtcaattttacaactttcctccccctactaaataattaaagacaaatctggcttttatgttaaacaacttaattctaagtagatggaaaacattgcatcagatggcaaagaatgctgccaattttggagattgtgcagtgtgaaaataaaaacttatgactatcactgcataaattttaatgacttctacctttttgagggaaggcttttcttcagtaaatagagtcccatttagctagggcacatattctaactgatgtcagtagccaagttacatgtatgttaataggcactgagaatatagatttgcctgggttgaatggtgaggattaaggtttattcagtttgattataggagcaactttggtcaccttgaatctctgaaagaatatctcgcatatggtttgagcatagtaggaatcaatgtatttgttggattgttgattttatctccctagttcccatatgactgaactgaaatgaggtatatcttgtcaaaatttagacaaatgggaagattcttgagaagagtctattaagagagagaagaaataatttggtttaagtaagcctctggtaactttattcaaatgtggccaatcctttcataagaactaaagtggagtatcataggcaggaacatatgtgcaaggaaggttatagctcagctgaaaaagctaaaactaccaatcactcttatcagaaaagtccctacatagatgaggctgaattcagcctgaagacatgttcttgtttgtactgtatggtgtcttaaaagtgaacttgaatatcattagtcacgggctatactttctacccactattcccaatcattttaaactagatctgctttaccttcattattttttgactcacctccaaggcatttgagtgtgagatgcttgcctagacaaacaaacaaacaaaaacacaacaaaacaaacttgtccatggtagtctttcagttttgcccagaaaaagatcccagataacaattcaaacgaaaatattacatttgggaagatattatagtaaaatctactaagggaataagaaagaaatacaagagaaaaagagctgatgcaagttgtgttgttatgctagttactaatataggtaacttgacctcaattctctggggagctttgcaagtcgatatagaacaaggacatcctaacctagggataaaagaggtagtatatattttattttaccaactctagtcaacaattgttgaaggctaatagggcagaattgggaggcattaattttcagaaacttcaggccagacatgtaggctagactttaacagttagaaatgcacctgaagggtaaactttaaggagtatggcctggtcagccagcatctacgagagcttgtgtttgtttaaagtgctgtgagagggttgtaagttacctcaatagctcataccgtaagagccttgcacatcataaaccaaggggatgagaacacagtaaggagatcttacagattaagaacttagaacaccagtgccaggagaggaaccaatggagggaatgggttcatcactggtttgaaaaatagttccaacaaaatccactggtatgcaaaatgtcagggtagacaatctactagagaatattcactgaggaacattctagaaacttaggttactgcagtgtttcagttataacacactaaagcaatccaaaaaaatatagagccatgtggtcgtagaaattttcttgtactctacattttttcttgatttcttatgtctatcaacttgtgagaatactgctgtacttttaacgaacattaaccaggtaagtgtgcagatgtaaaaatccaatatcctatgaagatgtaaaattagaacaaaatcaaagaagattaagaacaagtaaaaactattgaaattttagcttttccttcccactccctgaatccagcccctgcactcagctaagtaatggacatctcaagacagactagctttgaatttaaagtgacttatatttatatcctgagtttcttatttctaccactctaattaatagctttagcataactgctattttccatgaacttctttatagaaatacaaattacagatggtggtttcttagaaaattcaaagcacattgcttaatttattgatgatttgtagtaaattacaccatgtcaataagcaaattaaagccttaagaaaggcaaaatatcaacacaagcctatcctccttcagcttttgttatgtaaattgctataaaatgtgataatactattataataaggaaatagaagagtatattgcaaaattaggcttataaaatctcaaaagttttgttaggaccaggcttaattcagcatttaactgatataaaccatatattcaataacatgttttaagatatgaagaataaatgctatttatattattttcatatgtcttggagcacaatgagacacagagacttataaaagcatatcaaatataataatgatgtatcaccagattgaatgagataattaaattgtaatgctcgccaagtaaaagcttctatgtattttatatagaaaagttattttgtgctctaaagagatatttctggcctgttggacttataatttgtctctgtgagataaagcttatattgttgagttaattaaatcctgtgtctagtgttcaatcattcagttagtgacatttagtctcatgaatgttccacagtttattagattaggaattttaaacacaaaatttcataaaaagtgaatacatacacaaataccacactctcttgattattccagttttaaaatgacttaaaatcagataacactaatcgtctagtgttatctagaatagtcaaagcaagcaagttgccactaataactgccttggctattttaggtcttttagattttcataatagttctagaattagcttgtcaatttccataaaattcctttgtgagaactgtgattggaacacatgaatgaatttatagattcatttagtgaatatcaatatcttaacaatatttaatcttccaacacatgaacataggatatctctcaatttatttagcttttccttaatttctttcagcattcaagatagccaaattgttaagatagaatgaccattaaagataacagaatagaaagtccagaagtagacccatgcatatctagacaacagatttttgacaaaggtatgaaggcacttcattgaacaaatataccctttttaaaatatcttgctggaacaattgcctatccatatgcaaaaagtaaaacttcatttcatacttctcaccatacacaaaaatttatttcaaatggatcatagacctaaatgtcaaacctgaaacaataaaacttctagaggaaacatgggaaagaacttctataaccttgagttagacaaagatttcagaaatacgttaccaaaagcatgatttacaaagaccaaatctataaactagacttctttaatgttaaaattcgtgacctataaaaaacaatgttgagagactgaaaagccccccaaagtctggccataaactggccccaaaactggccataaataaaatctctccagcaaggtaacatgtccataatggccataacgcccaagctggaaggttgtgggtttacaggaatgagggcaaggaacacccggcctgcccagggtggaaaaccgcttaaaggcattcttaagctacaaagaaaagcctgagcaatctctgtcttaagggtgtgttcttgctgcaattaatttggctcatcccttcatttcccttaagggatacttttagttaatttaatatctatagaaacaatgctaatgactgctttgctgttaataaatatgtgggtaaatctctgtttggggctgtcagctctgaaggctgtaagacccctgatttcccacttcacacctctgtatttctgtgtgtgtgtctttaattcctctagcaccactgggttagggtcaccagcccgagatggtctcggcagtcacgcaatgggagactatttcaaagcatacatctgaaaaaggacttgtaaaatatatacatataaaggactttcaaacttcaatattaaaaaaaacctcaatttaaaaggtaggcaaatggtttgaacactttacaaaaagatatgaatagaaaataggtggatgaaaagatgcttgatatcatcagtcattaagaaaatgcaaattaaaccacagagagaaagtactataaatttagactgcctaagatttaaaaagattgaccatactaagtgttgaaaagaatgtgaagcaactggaccactcatatactgttggtgtggatgtaaaaatcacacaactttggagaataatttgacagttttaaaaaaatgtaaacaaataagtactactcctaaatatttacctgagggcactgaaagcatatttatatagagagacttgtatgtaagcattcgtagtagctctacttataatagccctgaaccaaaacaaccaaaatatccattagcagatgaaagaatacataatttgtgatatttccatgcaatggaatttgactcctcagtaaaatataatggatccttgttatatgcaatagcataaacaaatctcaaaataattgtattgaataaaagaagacagatcaaaagagaatgtacttgataatgtcatataaaaattctacaaaaggcaaactgatctttagacaaacagcagctaagtggttgctagcaagcaggagtgaagggagggaaggattgcataggggcattacaaatggggtgagatgcatattcattatcttgattgtgatgttagttttatgggtgtatacatatggcaaaactaatcaaattgtagactttaaatatgtgtagcaatattatagttcaattatatctcaataaagctgtttaaaagatgaatgcacacaatcagaatggcaattttgtaaagggacatgaaaaataaaactgccacatggattgcagcctgagaagagatatttttccctgaaaatagtctatttaggaaaccaaataactatatttattgtagagtaagaagttagaacaagaaaagatagacaaattgactgtataatggaattaggctatatattcccaatatatccatctctgttttaggacagacttccacagataattaaaaattagtgatgttttgatcaaactttctgtcccctggacagagctgagaagagttttgtcaatattttcctctgttactcaccttctttgcttccatgatggtctgaaacataatggtcattttttttcctttacctatgttaacgtattcaatcagactttagtttttaattcatggtgagtctctcaaataatttcttcacaacacaatgatgactagttatatatatatatatcaacctgggttaggctatagtagtcaataatgtaataaaatactaatctgtatgttgctgtgaaggcattgtgcagatgtggctaaaacctacaatcagttgactttaacatggttttagtagagcagattactttcaataatgtggatggcctcatgcaatcactgaaagcctgaagagtaaatatgggttttctagacaaataattttgcctcaaatctataacatcattcctgcatgagttttctgctgaatggcttgcctcacaaattttggagttgttagccccacaaccatatgagccacctccttacaataaatattgtaatatgtctatatctacatcaacatttctatacatctgtattacactgattatggttttctggagaattctgactgataacattagtaatataatatgcactgatttcatagatttactatgcagaggaatatctttcctgatttcctgaactgtggcactctaattttctcaccccagtgctaataagatcttaattaacacatagtgaattattttttcttttcttttctctttttctttctttctttttttttcttttctttctctctttctctctctctctttctttctctctctccttccttccttccttctttcctaccttcctttcttttcttttcagggtctcactctggttacccaggctggagtgcaatagtgccatcactggtcactacagcctcaacctccccagctcaggtgactctccagccacagcctctgagtagctgggactaagtgcatgtgccaccatgccctgctagttttttgtagtttttgtagagatggagtttcatcatgttgcccagtctagtcacaaactcctggactcaagcaattggccagctttgggctcctaaaatgttggagttacagatgtgagtcaccacaccaggtctagtaaactattttcatgattattttaagataatcataatcattaatattttaaaatatatatataatttttaaagttttttaaatgttttatttcatcttatctgaaaatacatgtattagtcagtttgggttgccataacaaaataccataggctgggcagtttaaacacagaaatttatttctcacagttccagagcccagaagtgaaagatcaaggctggccattgtttcaaagtgttcttgttgaagcttatgaatagccaccttttttctgtgtgttcaaaaggtttttccttggtgagttcatacagagagagagcaggataaagttctctggtatctcttcttataaaggaactgatcccatcatgtgagtcccgcctacacaacctcatctaaccatggttaccaaccaaaggcctctgtcttctaatatcacaacctggtgaattaggcctgcaacatacgatttttttttttgagttgggggcataattcaatccacagagatatgctcccctctaaataacactaataactgattttcctaggaattctacatttcttaaaatagtcttgcatattttgtctcatttgattttaacggccactctatcaagtataaactgaatagcatatcactatatttcataggagggaaataaactaaaactaaaaaagttaaatgacttccccagcacaactgtaataacagatacaagaactatttctttctaagttgttgcactattcttatttcgccacaccacattccctaaaaacatcttcaaatccataaaatgatgatatagctgtatggagtacagagtataaaggcaggtgcaatataaggtccttggttctggcatgtctactgactttgccctcaaaaccctgaaagataacttcctaaatctaagcagcagctaggtttccaatgggaaaaaacattactttgcttcaaatgtataacaaaatcataataagcctttctcaaatcaaattaaattacattaaaattgttgctgtttatttaaaagttataattatactatatctttaaaattctatataaattacagccataaaaaactgatgagttcaggtcctttgcagggacatggatgaagctggaaaccatcattctcagcaaactatcataagaacagaaaaccaaacactgcatgttctcactcataagtgggagtagaacaacgagaacacatggacacagggaggggaacatcacacaccggggcctgttgggggttggggggctaggggagggatgacattaggagaaagacctaatgtaggtgacaggttgatgggtgcagcaaaccatcatgccacgtgtatacctatgtaacaaaactgcacgttctgcatatgtaccccagaactgaaagtataaaacaaaaaattctatataaattactatattaaaaaatagccaaaaacttactttgtgcattgcattaaatagcctatgtttttttcacctgaagtaaagacaatactgtaaagcagagatgcgtgtgtgtaaatgctggggtctggatttgtattcacttcatccatttctccctgagatatccccatggaaagcttagtcttttcatgctaccagagtgatttgaaaatgtttgttccaggtgatacctgcatagagtttaatattttcaatatgtggatttttgttcttcttagaatagatatttatgcttaaaaatgtaaagggttgtcacaatgggactgtatgcctaccacagtagagacagctcccaacaatacagtagaaaccctagatttgtgccttcccactgactttgacctcaaggcactgaaagataaccattttgtctaacagtaagtagtaattcagtttccagttcagctaaaaccatagcctcacctcaattttaacagttgaaattcttatgtcctctctgggtcacatctggtcacttttaaaacctcttaaattcagttaccatggaaccaatggatatcacatatagtatcctgagggtgagctgaaaaagtaagtcagaaaatgcctttctctaatagcttcttttcaaaattttccaaagaacatattatattgagcacaatccatgggacactttacatttttctgatgataggtgacagctgttgattgagatcttacatcatgagcttctactgaaactcaacaaactgcatttcaattacccaaagtttctttggccttacactggtgtcacaaaaataaattgctataaaactttgcaatcatataccactaaaggttttactagaccaagttggcaggttatcacagaagcacatatttggataaagatgaatcaaaggaattttgataagctgcaaaatgttagaaaataaagctagggaacatatttttatgtccgaatcctttttttttttttttaaaaaaaagaaactaacattaattagtatttacttagcacaattcttaggtataattcttattactgcatgtttttattaactcattaagtcgttgcctaactttttgagaaagatacatgtattaactttctcttccctttatagataagaaaactaaggcacaaaacacttagtaaatttcttatattattcagataagtgccaaaatcaaaattcaaacacagtcactctggcttcataggtttctgcatgtaagtatattcatattcaaatgaatatagtgagtcatgaacaaaaaagttgaattatattaaaatttatatatggtggttattttgttatgcaaaattggtatctctaaggaacacctcacaaacttccacaaacacaaatatggagtaaaacatgctgttttgatacacggatgcattgtgtaatgatcgaattggggcaattagagtattcatcaacttgaacgtttgtcatttatttatatgagaatattaaaaacctctcttctgcctgttttgaaatatatactgcattactgttaactctactcatcctactattcagtagaacatcatggcctattcttcctacctaactgtagctttgcacttgttgacaatctctcatcatcctccctccccgctctgttccctacctctggtaaccactgttattttgcctacttctatgagaacaacttttagattctacatatgagtaagatcatgtggtatttgtctttctgtgcctagcttatttaatttaacataaatggccctcagcttcattcatgatgctgcaactgtcataatttcattatttttatggctgaatagtattccattgtgtatatataccatggtgttttttatccactcatttgtggaggaacatccaggttgtttcctatttggctgttgtgaatagtgctgcaacaaagacaggagtgcagccatctcttcaacacactgattttatttcctttggatatatatcaaattgtatgattgctggatcacactgtagttctacttttaattatctgaggaacctccttactgtttttcagaataggtgtactaatttaggttaccacaagaagtacataaagttcccttttctccacatccttactaacacttgctatcttttatttttgaatagtagctattattactggagtaaggttatatctcattttaatttgatttgcattcccctgatgattagtgatgttgagcatgttttcctatacctgttggccatgtgtatttcttcttcagagaaatgtctattcaggtattttgctcattaagaaacaggtttttttgtatgtgtgttgctgttgaattatttgacttccttatatattgaatgttaatattttatcaaatgtagagtttgcaaataaatatattctctcattgtgtaggttgcctcttttctctgttgattatttcctttgatttttaaaatgtttcagttttatggaatctcatatgtgaatatttacttttgtttgctggaattcaatggaagcacaaaagaccccaaatagccaaaacaattttgagcaaaaataacaaaactgatgttaccacatcacctatcttcaaaacatgctacaaagtcataatgatgaaaacagcatggtactggaataaaaacagatacatagactaggagtaatataaagcccacaaataaacccacacatctacagtcaatcaattttgacaaaggtaccaagcactcacagtggggaaaagacagcctcttcaaaaaacggtgctgggaaaactgtatatacacagcagaagaatgaaagtagacccttatctctcaccatatgcaaaaaaataactcagaatggattaaagacctcaatgtaagtcttaaaactatcaaatcactagaaaaaactagaagaaagctccatgacactgacttaggcacggatttttgtttttgtttttgtttttgtttttttttggataagtagcttttccaagtagcaaacaccaaatgtaaaatgagtgattcaaattcaatgagaatgcagaactgttacaggcttccacttcattcaagatggagtaaaaaatgatcttattgcctgaaacaacctaagaaaagaacaaacaaacaaaaaatgtatacacaatatgcaatgaaacagctttagggacaccgggcaagaaaggatagtgatcccagagaaataagaaacaatatggtgagttccacaatgttccagctcactgccttagtagaatgtccagggcatagaaaagaaaaggggaattcaattgaagttccaaaaatgcccttagttaaaaagactttgctgagagtactctcagctcaggggagagaactgcatctacaacaacacaaatgaatctcaaagtaattatgtggaatgaaagaagccagataaaaagtgtatgtggtgtataattccacttgtataaaactagaaaatgcaaactcatttgtactgataacatatcagtgatcacattgtggcaagatttgtaggaagagataactcaaagatacaaggtaacttttggaggtgatgggtatgttcactatcttaattttgttcagtttcacaggtgtataaatgtgccaaaacatatattgtacatttgaaatatgtatattttatagaattcaattatacctcaacaaaactaagaaattgctgatttgggcataatgttttggaaagttgagttttgtggttggcctccatggaatgatggcacttagtaaaaaaaatgaaataaaaggccagcctttctttgatgaatactctaaataccagggaagtaagctaagggttttgggaggactgtaacttgatgcctttggcttgaatattggttaatttgggtcattgtgagagtactgaggtagtttgaggctaaatattattatgggttaagtgtaattatttacaaagacattgtattttttcctattgccacaaaagtagtggaataatacaatgcaaatttattattttgtggtttccatagatctggagcccaggtatggatgtattaatttcctattaccactgtaacaaataaccacaaacttagttgcttaaaacaacacaaatctatcctcttatatttctggagatcagaagtctaaaatcagttttattaagttgagttaaagatatcaggagtcaagctggtcaggagaaggctggttcctttcggatgctctcatgggagaattaattttcttgactttttagtggtaacttctagtggccacctgtattccttggcttgtggctacttcctccatttttagagtgcatccctccaacctctgcttccatcttcatattgatggctattctcttgaactttttgcttctctttcttaaggacctttgtgatagaatctagtgccccacaaaataattcaaaataatatatcttcctaaaattcttaaaatacctctgcaaagtctctgtggcatatagaataatattcatagtttcttgggattaggacatgttatctttgtcaggggggcattatttagcctgccacaatgggttagctgagtcctctgctcagggtcttaacaggctgaaataatggtgagggataggctgcactttttttttttttcttagacagggtcttgctttgttgcccaggctggagtgcagtggcatgatcatggctcactgcagtcttaaccccctggacttaagcattcctcccacttcagcctccctagtagctgggactgcaggtataagccaccacacctgctaatttttgtattttttgtagacatggggtttcactatgtttcccaggcttgtctcatactcctgaactcaagcaatctgctagcctcagcctcccaaaactctgggattacaggagtgagccaccctgcctggccctaaggctacactcttatatggggcttagggtccttttccaaactcattcatgtagttgacagaattaagactatgcaactgaggtctcatttcttactggctgtggggtgagaaagccactgttcattgttagaagctgtcttcaggaccaggtaatatggctctctcacatagccactcaaactttcagaccaacaagggacaatttctcgcatcattatgctggtatcttaaataaccttaattctgtgtccctcagcattttcccctggttaagtaagcaatgaaaaacccattgaatattttcattacatgttttaagaaaaagcagaagccctttgaatatatttttgacatttcaaaacattttgtcctattttaaaggctctacttatcacttgttaacaaataataaacacattttgaaagtagagaaacatgtcatcataaagcagtagcaggttcaaaacagacaaataaaagagccatattgatgatgctcaatgctccattctgccattttcaaatgaaaagcaaatacaagaaactctagtctacaggtgttcaatataaatcagatatcacgttatgacacatgtttctgttctccatgggatttatgcttcttcaagacattttgttacaaaatgtaccttattgcattttctgatattttgagaaggaacaaaatctaacacaataagcatatcttagggctttgtcactggtgtagaaagaacataatgaagtacaagttcatgttcctgttttattttacttgaaatcataaagagaaattatcaagagaaaaatgttaagtgtgactcaaaacaaattgtatgtaagtgacaagcggaatggcaaaagtgtgaattatctctctggcttataaacaaaattatgaatctattctgctattcctaattcattttgcctttacaagggtatattgaaaactaggtagggtaaaacttcccccactttactcctttcaggtctgcattcatatgcagtattttttttcatgttactgcaaccgtacctaaacctatgtatactgtggaatacagtgctcatttgatatcatattaatgtgtttcactggattttaattagttttcttcatttatattatgtactcaatttataaacaactagaaagcagaaatcattttatacatctttgtatcaccaatgtccatatctatgctttgaatactatacaaaaataattcataatgattctgtagacaatttcaataaaaccaattacaatattgcacattattttgagcattttgtaatctttggattaattttttattggtatagggacaaacatacacaactgaactcaataacacacacacaaatgtgtgtgtgttgtatatggtataactgcagaattcctgacacataatagttgttctataattggtagttaaaattacacttatagatcatttcacctaggatttagctaagctctctatacctagaatacagttaagaatgacattattagagggcagccaagacggccgaataggaacagctcctgtctacagctcccagcatgagcaacgcagaagacgggtgatttctgcatttccatctgaggtaccgggttcatatcactagggagtgccagacagttggtgcggggcagtgggtgggtgcaccgtgcatgagccgaagcagggtgaggcattgcctcactccagaagcgcaaggggtcagggagttccctttcctagtcaaagaaaggggtgacagatggcacctggaaaatcaggtcattcccacccgaatactgtgcttttctgagaggcttaaaaaacggtgcaccaggagattatatcccgcacctggcttggagggtcctatgcccacggagtctcgctgattgctagcacagcagtctgagatcaaactgcaaggcggcagcgaggctgggggaggggtgcccgccattgcccaggcttgattaggtaaacaaagcagctgggaagctcgaactgggtggagcccaccacagctcaaggaggcctgccggcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccctgagcagcctaactgggaggcaccccccagtaggggcagactgacacctcacacggccgggtactcctctgagacaaaacttccagaggaacaatcagacagcagcattcgcagttcaggaaaatccgctgttctgcagccaccactgctgatacccaggcaaacagggtctggagtggacctctagcaaactccaacagacatgcagctgacggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcgcctctcctactccaaaggaacgcagttcctcaccagcaatggaacaaagctggacggagaatgactttgacaagttgagagaagaaggcttcagatgatcaaactactctgagctacaggaagaaattcaaaccaaaggcaaagaagttaaaaactttaaaaaaaaattagacgaatgtataactagaataaccaatacagagaagtgcttaaaggagctgatggagctgaaagccaaggctcgagaactacgtgaagaatgcagaagcctcaggagctaatgcaatcaactggaagaaagggtaccagtgatgtaagatcaaatgaatgaaatgaagcaagaagggaagtgtagagaaaaaagaataaaaagaaatgaacaaagcctccaagaaatatgggactatgtgaaaagaccaaatctacgtctgatttgtgtacctgaaagtgacgggtagaatggaaccaagttggaaaacactctgcaggatattatccaggagaaattccccaatccagcaaggcaggccaacattcagaatcaggaaatatagagaacgccacaaagataccccttgagaagagcaactccaagacacataattgtcagattcaccaaagttgaaatgaaggaaaaaatgtaaagggcagccagagagaaaggtcgggttacccacaaagagaagcccatcagactaacagcggatctctcggcagaaactctacaagccagaagagagtgggggccaatattcaacattcttaaagaaaagaatattcaacccagaatttcatatccagccaaactaagcttcataagtgaaggagaaataaaatactttacagacaagcaaatgctgagagatttttgtcaccaccaggcctgccctaaaagagctcctgaaggaagcaataaacatggaaaggaacaactggtaccagctgctgcaaaatcatgccaaaatgtaaagaccatcaagactaggaagaaactgcatcaactaatgagtaaaataaccagctaacatcataatgacaggatcaaattcacacataacaatattaaccttaaatgtaaatggactaaatgctccaattaaaagacacagactggcaaattggataaagagtcaaaacccatcagtgtgctgtattcaggaaacccatctcacgtgcagagacacacataggctcaaaataaaaggatggaggaagatcaaccaagcaaatggaaaacaaaaaaaggcaggggttgcaatcctagtctctgataaaacagactttaaaccaacaaagatcaaaagagacaaagaaggccattacataatggtaaagggatcaattcaataagaagagctaactatcctaaatatatatgcacccaatacaggagcacccagattcataaagcaagtcctgagtgacttacaaagagacttagactcccatacattaataatgggagactttaacaccccactgtcaacattagaaagatcaacgagacagaaagttaacaaggatacccgggaattgaactcagctctgcaccaagcagacctaatagacatctacagaactctccaccccaaataaacagaatatacatttttttcagcaccacaccacacctattccacaattgaccacatagttggaagtaaagctctcctcagcaaatgtaaaagaacagaaattataacaaactatctctcagaccacagtgcaatcaaactagaactcaagattaagaaactcactcaaaaccgctcaactacatggaaactgaacaacctgctcctgaatgactactgggtacataacaaaatgaaggcagaaataaagatgttctttgaaaccaacgagaacaaagacacaacataccagaatccctgggacacattcaaagcagtgtgtagagggaaatttatagcactaaatgcccacaagagaaagcaggaaagatagaaaattgacaccctaacatcacaattaaaagaactagaaaagcaagagcaaacacattcaaaaggtagcagaaggcaagaaataactaaaatcagagcagaagtgaaggaaataaagacacaaaaaacccttcaaaaaattaatgaatccagaagctggttttttgaaaagatcaacaaaattgatggactgctagcaagattaataaagaaaaaaagaagaatcaaatagacacaataaaaaatgataaaggggttatcaccactgatcccacagaaatacaaactaccatcagagaatactacaaacacctctacacaaataaactagaaaatctagaagaaatggataaattcctcgacacataaaccctcccaagactaaaccaggaagaagttgaatctctgaatagaccaaaacaggctctgaaattgtggcaataatcaatagcttaccaaccaaaaagagtccaggaccagatggattcacagctgaattctaccagagaggtacaaggaggaactggcaccattccttctgaaactattccaatcaatagaaaaagagggaatcctccctaactcattttatgaggccagcatcatcctgataccaaagctgggcagagacacaaccaaaaaagagaatttgagaccaatatccttgatgaacactgatgcaaaaatcctctataaaatactggcaaaccgaatccagcagcacatcaaaaagcttatctaccatgatcaagtgggcttcatccctgggatgcaaggctggttcaatatatgaaaatcaataaatgtaatccagcatataaacagaaccaaagacaaaaaccacatgattatctcaatagatgcagaaaaggcctttgacaaaattcaacaacccttcatgctaaaaactctcagtaaattaagtattgatgggacgtatctcaaaataataagagctatctatgacaaacccacagccaatatcatattgaatgggcaaaaactggaagcattccctttgaaaactggcacaagacagggatgccctctctcaccactcctattcaacatagtgttggaagttctggctagggcaattaggcaggagaaggaaataaagagtattcaattaggaaaagaggaagtcaaattatccctgtttgcagatgacatgattgtatatctagaaaaccccattgtctcagcccaaaatctccttaagctgataagcaacttcagcaaagtctcaggatacaaaatcaatgtacaaaaatcacaagaattcttatacaccaatagcagacaaacagagagctaaatcatgagtgaattcccattcacaattgcttcacagagaataaaatacttaggaatccaacttacgagggatgtgaaggacctcttcaaggagaacaacaaaccactgctcaatgaaataaaagaggatacaaacaaatggaagaacattccatgctcatgggtaggaagaatcaatatcgtgaaaatggccatactacccaaggtaatttacagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaatagagccctcagaaataacgccgcatatctacaactatctgatctttgacaaacctgagaaaaacgagcaatggggaaaggattccctatttaatcaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccatgcaggacataggcatgggcaaggacttcatgtctaaaacaccaaaagcaatggcaacaaaagacaaaattgacaaatgggatctaattaaacgaaagagcttctgcacagcaaaagaaactaccatcagagtgaacaggcaacctacaaaatgggagaacatttctgcaacctacctatctgacaaagggctaatatccagaatctacaaagaactcaaacaaatttacaagagaaaaacaaaaaaccccataaaaaattggccaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtctggaaacaggtgctggagaggatgtggagacataggaacacttttacactgttggtgggattgtaaactagttcaaccattgtggaagtcagtgtggcgattcctcagggatctagaactagaaataccatttgacccagccatcccgttattgggtatatacccaaaggattataaatcatgctgctataaagacatatgcacacgtatgtttattgcagcactattcacaatagcaaagacttggaaccaacccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgagaactgaacagtgagaacacatggacacaggaaggggaacatcacactctggggactgttgtggtgtggagtgggggagggatagcattaggagatatacctaatgctaaatgacaagttaatgggtgcagcacaccagcatggcacacgtatacatatgtaactaacctgcatattgtgcacatgtaccctaaaactgaaagtataataataataaaataaaaaaagaatgacattattagctttattccattaaaaattttataatcaatagattagtatatgatgttaattcttatgatctgatgaggatgatttagcctatattcagaaacagagactattttttttcatagaacgttagtattctatgaacaattaggtggaaaaagcagttttaatataaatatccatttatggtggcaacaatagtgtagatatggagcagtgactgtatttatatacctggtctaccaaatttatatgaatgcagactttaaactgtttgaaaatatatgtattatttatattaatctttttatttcccagtgttagtacaatactagagagtagtgactactaaatattatctaatcaataccattctgttgtttgcattttgttaaataatcaaatgtttcaagaaacattatataatggtttcccatgatttctgctttatatatattttaggcctctcaaaacatattaaatattatacatgatccatagaagtagaattgcagaaggaagttaaaagacaatttaaaaataattgttggctgtgtttttgcatagataatgtagtaatcatagaaaatggtaatgaatttcagatgattcaggaatatatgttaaacaccataagcatcaacttatgtatgaattctttcaatatgaggaccaaagttttattcttgaatatagttaataatcttaatcttccctatttgaaatttaggtgtcaaattagaaaaagggaaaaaataataattttggaattaagtgtataaattttaagttgtttttctagaaatctttagttataagatatattattataaatatgacatgagcttgaaggaaggtggtgtgggttgaattgtgtctccttccccaaactcatatgttgagttcataactgtcaatacctcagaatgtaattgtatttggagatagggtctttacagagatcattaagttaaaatgaggtcattagggtgagtcctaattcaatatgactggtgtccttataagaagaggtaattcaggtacagatctatagagagatgatatgaagacatggagataagacagccatattcaagctaaggaaagaggcctggaacatatcctttcctcatgggcctctgaataaaccatccctgtcaccaccatgatctcagactcctagcctacagaattgtacacaaatttctgatgtttaagccactcattctgaggcactttgtcaaagcaaccctagccaaactaatacagattttggtactgagaagtggggtgctactataacacacattgaaaaatatgaaagtggctttggaattgggttttatgtagaggctggaagagttgtaaaatgtatgttacaaagagtctagatttccttggaaagattgatggtagaaatatggtcattgaaggaatctctggtaaggactcagaaaaaaaaagatagctgtagaaaaagtctctatcctcttaaaaaatatatatgtcattgtgtacagaatgtaagtaaggatgggcatggtggttgatgcctgtaatcccagactttgggaggccaaggtgggaggattacttgaagccaggagtttgagaccaacttgtttatgtaaaaaaaagtacataaatatatatgtgtgtgtgtgtgtgtgtgtgtgtgtgtgtgtgtgtatgtgtgtgtgtatgaatattggtagaatgttaaagatgctttggtaaggtattagagggaaaagagaaacattactgaaactggaggaaaaacgacctttgttatacagtaatgcaaagtttagccaaattgtgttctagtgttttgtggaaaatagaacttttataaatttggatatttagctgataagatttgtattttttataaaaagtattgatagtattccttctccttgttgcttatggcaaaatactaaaggagagagataagtggaagaaagaattgctaaacaaaaaggaagcagtatctgaagatatggaaaatcctcagcatatccatactgcaaaaaatcagaaaacctgttctggaggaaacatcaaggttgtggctgaatgaccatttgctaaagagattgtatgtatggctcatgggtctattcaaccatctcaccagaagctgggattgaagatgtggttatccaggaaagatctgtgaaggatcctcctggactgtcctcatgtttgatggcttggacgtctgtgaattgcatggtaggccagaaaagttttttgagaattcgatacatgctgaaacacacccagcttgtactgaagaaaataaagatgaaacaaaataaacggatggaacaaaattctacaggagggaaaagcagattaattggctgtgaatgtgcattatcccttaataaaaagattgaatgaccttgcaggcagtgcagaagttggcatttctgccactacaacaggcccgcgagtaggtttgtctcctccttggttctaaatggcaaggcctcctctaaagtttcaaaggaacaggccattgccacctaaggctgaggagatgaggctgccaccctgagggggcccaaagaataggactgctaccatgatggtccagaggacttaagatttggctccagagcagtcaaagaggataatttttaagatttaaaatctgatagaattttccctactagcttttggacttgcttggaatgcataacctctttatttctgttttcttccttttgaaattgaaacgtatatccaattcctatcccaccattgtattttcaaagaagacaacttgtctggtttcacaagttcacagctggagagtaattttgcctcaggatgaatcatacctggagtctcacccacacgtggatcaaatggcatttaaatgagatttgtgacttagagttgattctggaatgagttaagactaggggctgctgggatggggtgaatgtattttgcatgtgagaaaggcatacatttgtggggggcagagcatgacatgctgtgggctgggctgaattatttcccccttccaattcatatattgcaggcttaatccctagtaccacagaatgtgactatatttgatggtcactttacagatataattaagttaaaatgagttacttggggtaggtcttaatccaacatgactgatgtcttaaaatgagctcattaaagtaggacctagtccactatgactggtgtccttattagaagagtaaatgtagacataccaacatctacagagggaagaggatatgaaaacacagggagaagatagccacctgtaagccagggaaaaagcctccccttttggccctcagaaagaacctaccctgttgacaccttgatcttgaacttacaaccctcaaaaatgtgagaaaataaatttatacttttaaagccactggtctgggatactttgttatggcaaccctagcaaactaatatagaaggcaaccaacacaaacaaacaaaccaaaaacttcttaatattttcctactgaggaattaatattttcctatcttactattttcctactgctgagtaggaaggaaatagaaaatttgatatttatagctaccacaaggcatataattctactgtataataaatctaataatttatattcatatctcttaactatttataagacaagtgatatatgtatgtgtgtgtgcatgtgtgtgtatatatttgtacacttttaattttgagctctttcatggaaaggattttttaaactcttctttgtaattacatataatgtatattatgtaaagcttccacattgtataagtttatgtaaaatacttaagtatagattattttacattaattttatttaactaaaacatgtcagtttaacaggttcacatttttttaaagtaacttcttttttttttttttttttttttttttgagtgggagtctcactttgtcacccaggctggaatacactggcatgacctgggcttactgcgacctctgtcttttgggttcaagcaatcctctcatctcagcctcctaagcagctgggactacagctgtgcaccatcctgctctgctaatttttgtatttttagtaaacatcggatttcactatgttggccaggctggtcttgaacttctgacctcgagtgatctgtccacctggcctcctaaagtgctgggattacaggtgtgagccaccacacccagctagccttaaaaagtaacttctaaggcttgctctttctttctttctttctttctttctttctttctttctttctttctttctttctttctgtctctctctctcccctctctctctctctctttctgtctgtctctctctctctctcctctctctctctctctctctctctctttctttctttcttttctgttagccatgcacctaaacatagatgaaaggaaatcagttcatacgggtatattcgatatatttctttgaaaagttatctgtctcactgttgggcttgactgcattctcaaatgactataattattctattctcatatttttctcctgtagaaaagaaatcatgtttgcatcagtgcagtttgtatataaaataattcaccacatttatcaatttaattccaattagctttccttaacctgttaatatgattctttattactataaaagattttaatttaccattcaaaaggattttaaatattttaaaaagcattttgaagaaagcagcaattcaagcagtttcatacttcatcttaataagagcactaatttaatgattgaaaatagagttggttctataatgaggtctcatgagtacttcattacatgataaagtaacacacaaaggcaaccaattcttgcaaatttaaaagagaactatctgagagaaaagaatcaatgtaatagattatccgtaggtcaagtattattaagcagaaataattgtttagtggctaacttttgtaaacataccaaagctttgtcttttaaaaacatatacattgcataataaaaagcaacaggcctttagtaaatggatttttctatttagtaaaaagagccatgaaatagacattgcaactgattgtttaaaatgctttgcacacaggcacagacacaatctctcagtctcctgtgaattagcaaactggtgagtcacttctctgtgtctttaacttggacatgtttacaaagtatttaccatcctactgaacatagtataaaactctaaaacttaagataaagccatgtggatgaacataagcacatccatccatttttaaattcatatatatatatttaacatagataacaatgctatgtattatacaagcaatgcatatatgatgtatgatctaatatataattaaaatatttataaataaatacatatatacttatttaattatttaaaaattatgcttgctgagtatccagtacaaacacagatgcacaaaggcattgtcctggcttgccaggaggtgaaggtctcatgcagatgtcagacatatgagcaaataaataaactaaagtttttataaatgctatcaaaatggtatgtgaaagtgctacaggtaggaggaaggggaacttaacatttttgaagggggttaaaaaaaaggtctcacagaagcactgctatttatttaccacatggatagtaacctttgaaagaaaaaggataatggtgctcaaatgcacaaacttatcatttgctagaccaaataatttactatttctgaatcttcacttatttctatttttctaaacttttaaagttttgattttcttcttttttaccctgaaatatatatatataatatatttgtaattacttgagtcattatcaatcataggattttatttttttcctttatattgcacaatagatttgtttgcaaaacaattcgagaataatacataaaaatttgactgaacgaataacttatgacttttaaaatttcagaaatttgcatataaaatcaatgacgtttctgtttattttataaatacctgaactaaagtggtgagagtgagaatttgggactaataatagaataaaatctatagagcctgatgattgagtagatgtgggaattggctaaaacaagccaatataagattaaatgtgttttagctcagggaccattgataatggaaatacttgccatggtaggacactttgaaaaagagtctgtttcagagagcagaaatgggaatgataaaaaatagttttgaatatattgcatttgagtatttataaaacattatattaatttaatgttactaaaacttaaagatgaattagaacacttataacagttttttttttctttttggcttaaatttgtataaatgtttccatgtatgaggttaattgtaagttgatatgaagaataaatttaagatatcatgttacccttcaacttttttataacttaacaggggaaataaaacttactcaaatataactaaacagccttttgagaggatgaataccctactttctaagtgatcatttagagcaatgtctttctcaaagtcttgtatgggctggtggagaattcaaattactgtactaaatagaattatacttaccttctgatttatgaccttgtatgttaaaaatcctcagttttactatctataaaatatgcataatgttttgcaaaattattgtgagtaataattggctaaaatgtatgaaacgatctagtatagtgttttgtacacgttagattacttccttctcacactttgaatacattcaaatcaaatgagacatataaatatcagaatttttaaaggatgattgctaaaatgcacctacaaacataaattattaaatgattcaatttttttgactggctattatcaatgcaacataaaagtatatttaaaaatcatctatttgactaatttaaaaatatagccaaataaaattgtacctagtagctatctaggacttacccacttcttcgtgaaataaatttagaggcttaacttatctaatttggcaagactaatataaaaaattcaatggcaaattgccaaatcacaacagtgtgttatatttagtgatatagcccattcttttaaatttttttaatgtattttttaaatcaacagataaaattttaggtatttatatttcacaacatgatgttttgaagtatatattcattgtggaatggctattaaatccaaatacaagcttaacaaaatgctggaagaatgatttaatatatttaccatggttacaaaataatttttctgatatattctgttgaaacatgttatgaattctgtcacctctgcttggttacagtattgacacttccttgctgtaagaatatctaatttgtttgcagataatttatcagaattggactggtttacctctttcacaagttgctttggcaaattaaaaagtgtcctggcgtggtctctgtttggcttgagtcaccgatgggtatgttggcaatactaaattagaggcagccagaccctctgaatcttgtggttggaaatgtaccaagtagtctttggcacagagtttctcttattcaagggtgttagttttggaaaactagagagctgagatagaggaacaggagaactgaaatatatagtgaaggaaacatgcatttcagcccaggaggacatacaaggatttaagttgattggctactcctggctgtctccagaaattctttgaagtatgtgttcaaatgctttctgcatatttggaatagaaggattaccttaaatcttaaaagaaacattgataaacttaggaaaaagtagctgtgcagggatgtccatctcctatatatacgcaaactacctatacagaactcaaaactttgaattttgaataatactgctcagtctttataatgataataaatatattttaaaatcattgaattaacatttatttccttattcctttttctctagaagtaaggagataaatacagcctagagatatagatgaactatgattcatatctcacctccatagcttacaaattgcttggcctgcatcaaggccttttcctttcaaagcagctttctatcatataaaaatgaggataatactctcgtaagcaagacgaaagataaggataatgtatttagaacatcaggatcaacttcagaggtcctaatactgaaaagaatttgtagttttcaatcttcattcaagtgtgtggagcagggagagagaaagaaaactgagataacaaaaaagggagaataagctgcgtaaataaagagaagatgtataattttagacaacttgtttagatgcattctacaaaagacacacaagtacacacttctttgagaatttttttcctttcttacaaaaatctatctgtacataatttaaaacagtagacctggcaacctgaaaagggttaatttaacaatcgtataaggaaagaggcatccactatattcaaaatgagcaaagatggcctagtttcttacatttatctccaacatcctcaccactgctaagcttgcaaatgacacataaggaaaaagtcatagccttatgtgatttgactcatccctgttttgaaattgcacatataccaatattaagaacagtatctctaggacgtagcttttctaccaacatgtaacattgatttttatgttttcaaaacttttcaaattcccctgcatagaatgcagtgaattctattacttacagagacttacattagttactctagttttcctgtcaagaaattctaaatcacttttaatataatacaaagacaaatacttaaatgtttaaataaccggttccatataaaacaaaacaaaactactgcaaaacaaaacaaaacaaacaaaacctctactaaaagaatataatgagagccattttattgtgcctggtattttaaattatataatataaatatatacatattatacatacaatttcactaaaaaaaaaaaaacaactgttatttttcttgaagggaaaacaaaggatatataaattgccagaaaacgcacagctggtaagcagcttagctgtcaggaattacaatgtagatgtagatgtgttcaattctaaacttaggactcttcccttacatcattctcattctaattaccccatataaaagacaaaatataaattgttaaaaggcagagtaaaaaattataaacaattgaggtatggcccaggtttttctcgagaattttgtgaaaactatttattatctgtcaatagaaatcatcaaggaagggcatagtggcttacatctgtaaaccaagcattttgggaggccaacgtgggaggatcacttgagcccaggagtttgagaccagcctgagcagcatagcgagaccccatctctacaaaaaataattgaaaaaaaaattagccaggcatggtagtgtacgcctgtagtcccagatactggggaagtggaggtgagagggttgcctgagcccagaagtttgaggctgcagtgagccatgatggcgacactgcactacagcctgggcaccagagcaagaacttgtctcaaaataataataataataataataataaaaggccgggagcggtggcttactcctgtaatcccatcactttgggaggccaaggcgggcggatcacgaggtcaggagatggagaccatcctggctaacgcggtgaaacctcatctctactaaaaatacaaaaaattagccgggcgtggtggcgggcgcctgtagtcccagctactcaggaggctgaggcaggagaatggcgtgaacccaggaggtggagcttgctgtgagcagagattgcgccactgtactccagcctgggtgacagtgtgagactttgtctcaaaaataaaaataaaaaataataatattataaaaataaaaagatacacttgtaataaatagtaatatctacttttgaaggttggccaaaattaatgcaatacagctttcctataaaatgaaataatataattgccaattccccatttattttttaattatagacttatattcaacctcaaaacttgaaagaacgtttataatcacatttttttaaatttttgttgtttaagactttaaccttaactttgaagttgaatttaggctgcattaattatataatttaaattctctaactcaaaagccatgaatcttagatctttggtcaacattagaaatttttttatttgtataaatttaagcggtacaagtgtggttttattacataagtaatataaatcccatgtttgttatatattgcatagcagtgaagtctgggctgagatggtttgcctttgcgttcccatgcaaatctcctgttgaattgtgatcttcagtgttagaggaggggcgggtgggaggtgattggatcatgggggcagatttctcccttgctgttctcatgatagtgagtgagttctcatgatatctgattgtttaaaagtgagtagcacttcccctttgctctctttctcctgctccaccatcgtaagatgtgcatggattccctttgccttctgccatgattgttaagtttcctgagcctctcagccatgcttcgtgtacagcctacagttctacgaatcagttaaaaggtgtttctccataaattacccagtctcagatagttcattatagcagtgtgagaaagaactaatacatgggcttttagtgtaaacatcacccaaataatgcacactgtacccattacataatttctcatccctcactcccctctcactctcctacccttctgagtctccaatgtctgttattccacactctacatacatatccatacattgtttagtttccactgataagtgagaatatgcgctatttgactttctgtttctgaattattacacttaaggtaatggcctccaattccattcatgttgccgcaaaagacacgatttcattcctttttatggctgagtattgtgtgtgtgtgtgtgtgtgtgtgtatgtatgtcacatttcctttttcttatcatctgttaatagacacttagctctatgccatataatagtgctgcaataaacatacaagcacaagattttttttatatataataattgattttacactggttagattcccagtagtgggattgctggatcaaatggtagttccatttttagttctttgagaactcttcatactcttttccctagaggttataataatttacattcccactaacagtctgtaatcattcttttttctcctcatcctcatcaacaacttttttttttgactttcgtaatagccattctgactcgtataaattgtagatataagtattgagagaactcagcactcttgacttagaacaaaagaaaatgatagtatagaagattctaccaaaaactgtgtagattcttaaaaccacatctctttttaactacattatggtaatatagttaagattcaggtgaattgtgaagtgctataagaaatgaagctaatttgagtaaatgatattaaaatttattcactgagaaacatttttataatacttattttggacaaggcacttttctagacacttacggtggccagaaaaaaaaaatgacaacatccctgtcctcatagaaattccattcagtgataccattttagacaataatctcaatattcagcattttccatcataaatttcttacttcctatagataacaaatctagaatttgacacaaattattcaaaaattatttttaaagctggataatttccatagttgtggatgccttaacctaaagttgtgtaggtttgtatagaattgtttgcttagtgtctagcactcttaaagtgtttttatacaaaaattaaaaacagaattgttttttctattttacctaacttaattttgaaaaaaactccacacttttattaaagtttattcatagactttttatttatttatttattttttgagatggcgtctcgttctgttgcccaggctggagtgcagtggcgtgatctcggcttactgcaagctccgcttcccgggttcacaccattctcctgcctcagccttctgagtagctgggactacagccatccgccaccacgcctggctaaatgttttttgtattttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttaatagagacagggtttcaccatgttagccaggatggtctcaatctcctgacctcgtgatcctcccgcctcggcctcctaaagtgctgggattacaggagtgagccaccgcgcccagacctagtcatagacaattttaaaattaggatttatttggaatagggttaatataaatatctcacgaatgttgttattagtagtgtaaatgagttttttaaaataatgcaagatttatattttgaactgaatcatattccctcaaagtttatttgttatggcctaactcccaatgtgactgttttcagacataaggcctttaaggagataattatggttaatgagatcataagaatgggaacttaatccagtagaactggtgtcctttaaaaaaagaaagagataccaatgatctcttgcccagaggaaaagctacgtgaagacacagtcagaaattggatatctgcgtatgtacaagccagaaagaggtttcagaaaccaaccccgccagcatcttaatcttggggacttccaacttctagaactgagagaaaatacatttctgttgtttaatccaaaccggtctgtagtattttgttacagcagctgcagcagactaatataatttataacagacctagtaaggactgtgtttttatgttatgtcctcctaaattatctcatagcttcattacaccctgtaaagacatcagttataattttaagaaaaatgataatatattcataattcagagagccagaaaagtgtgtgattccatcatcattttcactttttccacaaaactgagaacactggtttgaggattctgatgtcatagtcataatacatacaaattaaatgcataaagaccgaaaggccataagaattaaatgaaaaattaaacccagaaggagttacataattaaagaaagtttgattgacaaagggaaatacttattagtatgaatgtcatatatttacacagtttgatgtaattaaaaagttatttcacatgcatcatttcaattatctctcacaacccagaagaagatcagaacaggaggacagaaaaatattatgaactcatagagcttcttatccatcttcccttcaagaaaatgaccacaattacaattttatttttatttgtgtaattctttggttattgtttgtctctcccactagattataagatccatatttgttttctcttttcattatatgtacagtgcctgatgtagttgttttgaacttttaaaaattgaagactaaatgcactttctaccttgatcctgaagttttgtattttggaggaccaactaaaaagcctcactcattttctttttttaaaaatgataataggaccaaatttcatataccctaatcatttctgtgaaaaaaatttttggtacacttacaatctcaaacaatatataatataaaggaaatcaatttagtcttcaaactggcaaggaataaattagtagtactggccgactatttcttttgggcatcaaggactgcttactatgggtggaagactttatcaatcttccttataatacagaaggaaaaattcacatgccctaaaacattcattgagctgattctacagcttaaatttgagggcattgtggtgataaggtgaccagagttaagtacatgtatattaaggtcttgaacttttggtctgccatgactccacctccacctccattaccatattcatctacaatattcctgatggtgcctaactgattatccagtatattcattgcaattaaataatgctatcgttcccctagtacgtaattaggaaggggaatttgttgcaactattcttccacccaaagactgacaagcctgtctttagagaagtttcaacaggagatggaaaaagagatatggagtgatgcatgatttctgtgactagattagaaagccttctctcataatcagtaaacttagcatgcagaccaccaaaacattcattccttccttcattactcttgtattttcctatgaattgagtattgggtttagcatagagaatacaaaattggcaagcaaaaagggaatgtcatgtattacttcataaagtttacaattgaaccagaaaaacaaaaactgatcacatatgtgaaaaaggtaattagaggattagggctccatccttgtgatctcattaacgctaattacctctcttagatgagtgaagttaaaatcatgacaagagataaaatagaggcagaacataggcaaaaactttcattaaatgaattaatgaatgaatatctcagtaggtaaaagaaaaaaaaaaaggaggctagattagctggaacaaagagtagccctgaaggaagcaaagactgatcacataacacagagcctagctaatcttaatcttagaaaaagaaaaagacattgaaggtcaatgtctttgctcatacctgttacttaaagggtaaggattattagaggaaggaaaatatcaaatgcagttctgaaaaactaactcaagcaatacagagaaagggaaatgattgtagggagctttggactgatatgggaaaccatatcagtttcatatcagtaatcatgctcttgggattagacagatttggaccttctgatcaatgcatgatataaacttggaagagtggacatttgttaactgctaaaaaaattcttctttgtattatcttcctttacatggtttcatcaaatgaaaggcaccattagctgccaggaataactctataaatacagtcgctaaattatggagctatttcatgcactatttatcattcaaatatgagaaaactaagctatcacaaatgtctgcctctatttgctggaaaactgagttcagtatattgattccaagataatgaacagcaatattcccttgctctgacaccgaaatatctattctttatttttgtgtatttttttcttaacttctaaattgaacaaatgtttcagtatttcaaaaagtaaaacatgaaaaatattaacacaattaaagtataagcacaactatttagtaaattcttcctgaaaattaaatacttttagaaattaaattcctgtcttgaaggaaaagtgaaatgccatgcagaaatgtgcaaatgtcatgaaaattatatctgggttagataaacctcacaaagcacaattttctggaatatggaacaaattaaaaccttttttatgttttagtaaaaatattttatattcaataaaaaataacaatagtcaataaaatacagtttcactatgataaagttaactaaaaggtattatcatttcagtgttttgatgttaaagttatctgttaaaggaagaagaatataattttgtataacattgctatagggttacactattttttatatatactgtatatatgtgtatatgtataatataatgtaatataatataacataataatctttggaaaaaagctcagaattttttaggtacccaaaattttcccattttctctgttgatttagagtttattacaaaatgtccaaagaaacattccaagtaaaaaaccagtatgcaacttaaatttccatttattcattcttcttgggtcgttaagcaaaaattccccaaatgtgacacaactttgctcccctgctttgtctacaacactataattccccgttacagcaattctatgtttacgatcattcaactttcactcctgctatatggcaggtaaatgttacatgttaggagaacaaagagaactaaaacattattattgaattctaaaaactaaaaaaagcagcaggtgaagtctaacagataaacagctgacaaaaatgcaatgtcgtagatactatgaacatttatgcataaagtgctttgtgaacacagataatgttggttgtatctgtaggtttctaacaaaagaaatctgctagaaatctgttagaaatctgtaggtttctaacaaatggttgaatctgtaggtttctaacaaaagaaatagtagaaattgagctttgaaagataagtatatattaaccaatgatgtcagtaaaatattttttcttttttttggtttcagaagaaagcaagaacaaagcaaagatgtcaagaaattaaatatgttggtgagattctaacaatctgtctcagttggtcaggggtttcatttttcactgaatatcctaggttcgcttttaactccaaacttctgctcaaactttttttttttctgggatactatttattatctttgataaatatctgtgtcaaggaaaactacaatggctgaaaatatatcttggcctgggctggtgcccttttgaagacatctcttcttgtctgagctcaattgctctatctttgaagttttaaaggaataatcttctgtattacttacgtcaatcctgttcacatacagctgagcttattctctgtattctctccttaattaggtagtaaacattttaacaggaaattttctccaacaatgttttaattttgtttataatactttccacaactttcaaaataaatatttattgtattgaactgaattaaatcttctttggtaatcaataagttcaccctttgattatgcccctcaattgtaagcttcaggcccatcaaacaatgtatgttttgtattttttacttttataggtttattgggcacaagtaaagtttggttacatggatatattacatagtggtaaagtttgggctttcagtgcaagcatcaccaaagtaatgcacattgcatacattatgtaatttctcatcccttacccccctcacaccctcccactagtctgagtcttcactctctatgttcgtgtgtacacattgtttagctctcacttataagtgagaatatgcagtatttgacattctgtttctgacttatctcacttaagataatgacaagttccatccacattgcctcaaaagacatgatttcattatttttatgactgagtagtattcaattttgtatatgtgtatgcataaatagtctgttgattgagtcgattccatattttttctattgtgaatagtgctgcaataaatatacaagcatggatattttttatatgataattcattttcctttgggtagatatccagtagtgagattgctggattcaatgaaaaaaaaaagtccaacatcactagtcatcaggtacatgcaaattaaaaccacaatgagataccatctcataccagccagaatgactattattaaaaagtcaaaaaacaacagctattggcaaggatgtggagaaaagggattggtcatacactgttggtgagaaggcaaattagtgcaacctctttgggaaggagtatggagatttctataaagaacttatagtagaatgatgtactttgtacattgtttttcaggacaggatgtcactctattgcccaggctggagtgcaatggcataatcacagctcactgcagcctccacctccaggcttaagccatccttccacctcagtctcctgagtagccttagtaaagagagaggaatacctttggccaagggagagtaaaagactgcagttaggaaagtgtggactgtgtttagattttaaaaagctttgaactttgtctagagaataggtcatggatagataacagaagaagagacatgacaaaatgatcagattcatgaggtagggagatttgttctcttcttttcagttttcattttcatgtatgtatttacttatatatatattttaaaatttatgggtgctatatatatataacacccacatatacatatacacatatatatgtattatataggatatatatatgtaatacataggatatcaaattaaggggtttagattaggaattacagtgggtatctgtttttagttagcctgcatcttttatatgctttaattttattcattattaggttttttttttttttggtaaaacatcctgaattatctttgaactatcccttgacactgcaaatcatgttgatcttgtctctcagaaatttgaaccttaatcattgacccaaggagaaaaaaatggaaggagctgaagcaccaattacaatgacatcaacagatttctttctcatttctacaaacttctctacttcctgtcctatacaaggactgtttttcttttcctttaaatctaggagttgccatggatcctgtcaaaaaattccttttgttttccataatttggccagagtcaatttatgttgcttaaaactaaagtactttattcagaaaccaacagaattacattctatgacattttcacataggtgttaggagtcagaataaagcaagattctatttctcacatgtagttttcaaagatggaataaaaattcaaaagatctgtccagtggaaaatgttattatagaatagatgttatttcaaaacatcattatgtagaaaatgctgtgctatcttttgaaggaaatcttgtcaatgtacaaagtaactgtgcttggaaaggattcttggaaagaataagtttctcatacttttgtagccaatgtataaaatcaacaatttacattgagaaatcaaggattagattatttctggagagcatgaagaacatattttcaattacttgaaaatgtgtagctcacaagaagtgtattcatagtgaagtaattttcctgaaatagtataaaaggttaagagcaaagtgaaagtaggaaggactcaggatacaaacaatatcaagcaaaggacttatttttatgatttaaaatgtcaactgacttatatgttaggtattcacgacacttcttgctaacattaaacaataactttgctactaataatagctgaaatgtatttagaactaagtgccaaattctgtgctgaacactgtgtagattatctcactcaaccttcactagactactatatgaacaggctgtgtaattcttaggactctttaatcacacaagaacagcaaacccgatctatatttgcttcagcaaataggaaatttatgggctcacataaacaaaacttcctggaagagggttgtcttaaagggcagtttaatgcatgggcttaaaacatgtaaacaatatttacagtttcaagtccctaccttgaatcccctttctttcatgaattgtcagtacctaactcctcacaatcacaggatagctatttcagcccagttgaacactcaactaactctagatacagaggaaagataaatacatgttttatctgtgaacatggtaaagtcttggcttgattctccttgactgaattgaatggtactcgttcctgtaataatcgagatgacatgtgttaaaggatttgcactatttataacaatataattgtgtgcatagtagtaataaagatgataaacataatgagagcagtgaacacttgcagtacttccataattctaaaaactttgaatagattaacttataactttacaataactgcaacacataatatgctattactatctacattatattgatgagaaaacgtacacacagagaggttaattcacttgacctttttcaaccatctgttaagttgcagaatttgggttccatcagaaattatctggccctaaagggtacaaactaaccattataatgtggtgtcattcattctttgagctgttagtgagaccattcccttgcaaaccacatgtactgaaagtacttgaatgctatcacagaaaatgcagagtgcttttctccagaagataaagaaactgaggcacaggaattaagtagctactctgaggtaataaactagtgaatggctaaggtagaatactacctatttgatggtagaactggaagtcctaactactagaatatatgaatgcataaaatgactgttattggatatatttgaaaacaaacatggtagccacaattgcatttggagtctattactttgatgaatttttatttttcccatgaatcatgtttgctgataatcaaagacctagtataaggctctgaacctaaggagaagagggagggcaaatgctacatggaataataattcaaaaaaaactagatttaaatttcaatgagaagttttattttgggttttgcttctttcttaaaagcataccgaaaagaaatcatcttaaaactcaggctttgcaaaaaatagatatgagaatctattttctattagcttccattcacatatctggaaccaatcctggttgactgaatcacagataatatcccatagttttgaaggtatatctctgaaaccattattgctaagctacagaaagaagtttcatacagtattgagaaacctaagccacagagaaatagaaattggcaagcccaagactgtctgtacaaaggccccattatagactaataaaattgaatctctgcgttcagagagtcaatgttaatgttcaaattttctgaccctaatcctaactctaggttcagttataaaaaaatggaatctagggcctgggcatccctatttttaaacaaatacccagtgtttttaatgttcagacaatgttgaaaaatactgctctagaaaaaaaagcactgtataaccaattctcccattgtgtaggcaacagcatcactgggttattgggaagttgccagaaaaataagcctgaagaagctcttctgactctcccaactctaaacatagataacaatgaattcagaaatttcggtgtgctctagtaaggggacatgtaggtgctgagaggttcaagggtgatggttaagaccaagagacctttgtattttggggttttatacatgagaaatatgaccaagaccacagatgccaaaaacaggtgccaaaaattctctctgaaaagtcagaaagaacaagtatccagtcaccaatgcaggctcaaaaacaaaggagctactcaacaacaactagaatatcataagtatttgaggttcccatgatatatccaaacaccatcttggaaaggaccagatatcatacaggtttggtatttgagcatttacacggaagaaaaaaaatttttaatgcaaagaaacatgctgctttaaactgtttttttttttttttttttttcctcttaacccacatcaggataaagagtgagggcaggttgtgggacttaagagaaaaagtacataaattatacagaataaaaagctttatttcctttgcatatttaggtgatagtatgcccatttttgacacacaaattctaatttcacatatcctattttattctccctacattttttgacctttttcttctctcattctaacagcaattactctgcatctttgcttctggacgggtttgtgactggaaagaaggcatttgcctagaaccatccctttctcagcattagttccagaagtgtaaactcattgaggaaattttacagagtgctctgaggaaactgtaagcaaagaagaagacctctgaaaagaaacatccagatggaatttgcctaatagcaagagaagaacccaacttcatggctggggaaaagcgcagtgattgtgagcctgtaagcaggagagacacaggcattgtgggtcctcagcagcagaggggagacggggcaaaattcccaaatgaaatcagtgcatgtgcacctaactttttctttattaacaataacatttgataacaatttgtacttacaggtgtacaacgttgacagaaaaatagcataatgctttcaaacctaatgaaggcactacaaacaactaaggcagtattttcttacagtcaggtaaaatcaaaagtccagtcaaaaattaggtcaatttaaagaaaaattacgtcaaatttattgtactcctaaataaactattcatacttactacctaaaagatagttttgaattgatagattaaatttacagacattcagtaattaagatattcaataaccaatacttgtttaaaatgttaaatatagaagaaaatgtatccttgagccaaaatttgaggctgagggaaaggtgacacttgcctagaaagatgagccaatacaccttagcctttacccaggtaaagaaagcactgctatcatggattttatcagaaaagagaaaatttcctggtatatccagctaacatatactcctagtatatccacataaacacatattaccccaaaaatatcaatatctggaattcgagtcattgatagaatgctaaggccccagttaaaaaaaataaactattgagtaaatatatggactcatacaaactagtgcaagcttgtgcattttaaaacctggttgtggccgggcgcagtggctcacacctgtaatcccagcactttgggaggccgaggcgggtggatcacctgaggtcatgagttcaagaccagcgcaaacaacatggtgaaaccccatttccactaaaaatacaaaattagccaggtgtggtggcggacacctgtaatcccaactacccgggaggctgaggcaggagaatcgcttgaacctggagggcagaggttgcagtgagctgagatcgtgccactgcactccagcctggacaacagagtgaaaaaacaaaacaaaagaaaacaaaactagttgaaataacatccttttggctaaaatttaattacccaagaaatctaattaataggtacattttgagactattctattcctcaaatagtgcagtttcttcacgccttacaataccctatagcttatttgctagaaaatactatctcatctcacattttgtctttacatttttaatcatttatatctgacattcaattggatagtgatttttttatttgattagcaattattttaagataattatgcagggattcatttttttagtttattcttgcttcgtgctattaaagatgcaacttttgttcacaggagggcatcattactcagaaaagaagtgatttatggagtaattaaagcaaacgaaatcttcagtaaccaagtgtaaattgtaagtgaatgctcacttggtctgacctctctactctttctaaacataaaatatttattgttgccattagtattttaataatcctgggttttagaaatatttttatttaattttcactttgtttatatttattttttctaagtaaaagatactaaaatgaatgaacatttttactaaaactaggaatagtgccagataaaacctagatgattttaaaactatgaataaaatagagttacaattacacacatatactctcacgctcatttgtttccagttaaacatttctgattacacatatatgtacctggcaatgtttcctatgtaatagtatatttgtttctatatagcatataagaattctctcataattattaatgtattcattaaatttacttatttattgttcaaacattactcattaaattgtgaacaataaatgattagagattcccctgccaccagccacaatctgtaactcttagttgttgacaattatattttatagattaagctgaattgaaaaactgaaacagtgatattggtaaatgttgcaaaaatttgaataactcttccacacattactaataaaaaatgtgaacaaataaataaataggccaagaatttggaaagcaagtaagagatgcatgaatgtttgggttaatatttttatacaaatacagccctctaaattcaaacatatataaaggagtacatatacatttttacagataagtaactagaaattatgactttatggtgcataatacaatgatgaattaatatagttacatcaccaatgatttatttaatatttagagttataatagattttataaaaatatattcagacatcaaaacattttttattaaaatgcttatattgtgggtgactgtatgttctttttaacattttattaaaaatggatgctttaaaatatgtttaataatcttgctcaaataaactagaaattagtttatatattcatggatatcatcagaaattttaataaaactaacttttagaaatattttattttatttatgtttcttttctatgaaaaagtaaaagtgatgagattaactcatttccacaacagatttcatgcttcagttccaatctgttttctaaaaataggaagtcaactcaatattaatgtttagcatttagttaatatctagaatatattactatgatactgatcatttttactccccttaaaatactgctgttaagaaaagaaatcaagatagaaaaatgttcttaatataaagcagcacaaagaggaataatattattatctgagaaattcctccttaaatacatgtttggaagtattctctgagggaactttgtactcttctttcgctttcctagagcataatgtgatttgttcagaagttaaagcaaaattaattaactgagtacaaacagaaatcaatttttttgtttgatgcaataaaatatgacttattgatataataaaatatgactcagatttataaagtttcattgttgtggttgtagctatattttagccacacaaaagccaatatcattgtgaaaatcagcagtattctataaaaatggaaccactgcaccccattctgtttgaatacttgtttcaaaaacatatttgatctgataattactttacaataaatcatagaaatatatttaaaatgatataagcataatgttcaattttaaaactaatttattataataatttgcatgtttaacagcatttaatatatgaatttgttttcaaaatacataaaccatttaatttttaagtctgtgttttcctttattactaaagacaaaattattttctactagaaactctgcatttattatattctaattacaatcttattgttctggttcttgtgtaataataatggagaaataacaattttgtcccatgtcataattaagaaagagtggagaaaaataacctgtgtaccattgattagttcaactgctgtagttacacttgtgaaattttaagacagtagctctcaatgactttccagtatttctgcccatattgccattcccaaatacctgagtgatatctacaatattaggcatattgtagcaaaatttctttcatctttagcatttcattgtctttaacctccacaagtgacatcaggttttaaaattcagctttgttcatttatttatatgtactcaagcttaaaaacggcattgaagtcaatgtatttggaaatataggacatgagagacagagaaaggagagagagagagaaagagagagagagagaaatatggagggagaggtacaggaagaagaagagagatggatacatctaagctgtttctgattattttcaattattgcttgatataaacctgcttctatccatctacttccccacaaacctgttccaggaattatttgtctagaaaaatttgatgcctacttgctctgaaatttttgactccaggatcgcacagttgttcatgtattagtagattttgaatcctactgctttctgcagatctttttatgaatgcctgtaaagtgtgtcagaattaggtttgaaagcaaaatcatatgctgccatatggaaaattagaaagagagcaacgtaagactggtgatttttaagagcatggaaatacatattttcacatgaacttcaaaaaatttacacgctttcttaaatatcctttgctgagctgaacctaagcataaaaaatacaataattctgatatagagaaaagtttctagcacctgaacttgacctaacctttaagaatttctgtgacttgttttttttttttcatgtctgctgtctcacacttgatgtgtcaccagccacactatattacttctgcacgtgccaggttgtgtgttactactgtgcttcaattatgttctttactccttccttttccatttctttactaatgcttcttgagcacctattaagtgtcagtctttgtgctagatgtacagtgggaaataacatacaacatgcccttgcagtgtttgccaaagcaaggttcatattctaaagaagaaagtcttgtcatttttgacaacatggatgaacctggaggacattatgttaagtgaaataagccagaaatggaaagacatatacagcataacctcactcctttgtgaagtctcatggaagtagagagtagactgatgacttccaggggctggaaagacattggtcaaaggatacaaaatttcagttacatagaaggaagaaattcaagagagctattgtataacatggtgactatagttaacaatatatagcattcttgaaaaatgttaagagaatgggtgtaccagttgtcagcacaaaaatggtaacaatgtgaggaaacgcatatgttaattacctagatttagtcattccacaatatatatatacttcaaaacatcatggatgtaagtgttctcaccacaaaaatgataactatttgaggaaatgcatatgttaattacttagatttagtcattccaaaatgtaaatatacttcaaaacatcatgtcatacttagtacaatacatacaattgtatctgtccattaaaaatatttgaaatttttaaaaagaacatgataaggaaatgaaaaggttctctgcctccaggtggtagggatggatggcttatctttttgactaatacactgggtgaatatctcatccagaatgagtatgattatttaatttccatcttcccaatacaaggagaattaagagcagctggagaaaaattacagccattgaaactgctgctttcctttctccatcattcttataaattctgctgtacttttatctcctctgttctataatttttatcccttttgtttattgccttctctccagaagtcataagcaatttcaagcgccttcccattataaaaaaataaataacaataaaagccattgccatgatcctacaatctctggagatattattcaatgttattcttctatttttctttcaagtttttttttttactttttattgctatttctacttcctcacattcaactgaactgtcatttcaataccactggcttctatatccaccacatgactatatataaacatatgaaagtcaataattgccaaatgtaacagatattttttttcaattcaactattaaaaataccccagaaggatttgccatgtttttactatctgtttgtagacccattgcaaccatggagaccacaggcagctgttacttcctgctctatctgcttctctttaattatgttttatcttcatttccttagcattatatcctttatgtagccatcttctaattatttgggtaatttaaacagttctcctgatttcagctaatgaaaatcaatcctgtaacttgtcctgaaatagcataaggcactttattgataatatgttcaagtctgaaatctttgatatttgaacctctcttcttctgatattctttattgtagttactgacactataccagcatcttagaataaagtctgcctttctttaatcttacaattcattgattgattgttaaattcatatacatttctgtttatatactcctgagttgatttcctaatctttatgtttataatcatgtcattaacttgtgttctttatatcttaactgtgtacacctacttacatatcttacctataactatccataaccatcttaccagttgctgtcaaggtgtatatcacataatatattttccctacatacaaccctttgttgacttcccctgtgtgtgagattaactgaccagatcctttccatgacacgtgaagccatcacaggttgcacacccatgaaaccagccttgttcacgttatgatcaaacagcatatactgcttacattcaccataatttactcattttgtttagtattgtaaaattttatttataattcactttgtagttcatcattttcttagtttgttttgtctcctctgccaggaatgttcttcccatcttcctctttaatgaatctactttcgacttaatgttctagattaatatctggacgagtgttactacctcaggaatcatttcatgtccccgccctgcacatgcacaactgtataaacctggatattcacaaacttcattatgtgcatctctttttcttattcacttctctattttataacaatctgattataagagagtcttctgtaatatactccaaattcctttgggggcagtaattccatattatttatcaatctttgtctttgtatacaattttgcaggtgctcaatacctacagccttctaattccaaacaatatatgtgaaaaatgaatgaagtatgccattgtaataatgcttgaatgctgggagtttagaataccagctgtttattgttgtttaaaacatggaataactgttatccacttcaattggttgccatgaaaaagtgtgtgtaaggtcttgaagaaatatcaacatgaataaaataaaatatattgtaaaaatcaaggtaaatataacatcttttattattctgtaagaagcaaatgatgtaagagttgccatgtcttaaaaaataagtttcattcaagagcaaaagctactaaactggggccactttatagaagggacctttgcttaaataatttaatttgccttctagcatctggccaccagttaaaagaaccagttacaaattagcaaagtctgttatatattaaggtgaaattcagcatacaaaaatcaatatgaagagaaggatttgattttcataaatttaacctaattatttgagataattattcctcccaacattttcttaccttcttttgccctcatcagcacaatcaccaagactcttactctttacatatttttccagtggtttctgcttgttataaactacattgacattttgaactctcaaaatatttcttaattagttaaggcataatttctctggttttctattttctctaggttttcatgttgaaaactgctttgaacattaatagaaaaaaattttcaggtttaaatagtgctttaaaatctcagttttaggaagaatattctctgacatgcattatttcctatgtggatactgcaaaggttttagttacaaatactttctatctcacagctgttctcctttaagctatcattatgtcaattttcttttaaaccattatttatgatgcacaaatagcttttatatttcaagaaaggaatttgtcagaagagagaacaatactagaagctacttaatagtaaatcatatctcatattttgttctatgtgactttttttatggccttcaatgtttgaccctaatgtagatacgtgattgttaatgatttattttcctttccttttctcttactatttttattgtggattgcgggtagtgttaatctttgtagtttatgttgcaggtcatcagactattaagaaccatatctgtacctaatggagaggactatatattgcctgtagatagtgacatgaggtagacactgtgaccaaatggattttgtgtctctcttgaatttgagagtgagagcatcttcctttgtgttatatataattgttttatgttaggcagatgcattgagttgtttaaatatgagtcaaaacatgaaaatgggtgctgagtgacacaaatgtaaaatctttggttcagtgcccatttgccctcagatgcagccattgacttttccatccttcctactatttacttcagggcaattaacgttggaagatgtgttccttagactaccatttcagctgacttatggcttggttcaaccagtcactgataaaggaagaaagcagagtatttctccttttcctgagcctctggcagcatttctgacagtgctagtttacatatatggctccaactctcactaaagaaactccctcatgaaaccaggttccactgagtgattctggatcctgatgtctttaatcacaaaagtaaggcagcttctttcttttgtgcctccatctggtcatagcctccagctgttggtaatctctgaattgatttgtgacctgcttgccttctccatcactttataatcaatacttgaattaaattccatctgttttaagtacccagaatggtttctgttttcatattgagctctggtagatataggaaaagacaatgaaataccaggatcagtggatataggtcctgctcatgcagatgaattgttggagttaggtatcagagggagtaaaccagaggagaggaactggtcagacaataggatatttgaaatggatattgcatttacaattattaataataactacgtttaaccatagaaattaatgtccaagatactgggaggaaagtgccattgtaagagaaaacaaattagaactgagaggtcagagtattgaaaagagcctgacaaagactttctccatgaccaaaattttgtcaggctttctgagtaattttctccactaggccccaacctctggatttctttatctatatttgccttacccaattttaggaagaaatcctgctaagtcagttttagccagaatccccatgttctatatctaattgtccacaatatctgattaaaatcctcatcacctaccatccttcaggtgatatcttatcactctggcctgccttcagcaaaaatcctcttaggtctgtttaactagaaccttgacctccagccttgatattttctgtttctcattcactgactttatggctgcacttatggttgcaacataagcgtgtggtgtaaaggcatttgatttaaaattagggaggacattgtttaggaaagaagagaatggtctagaaaaggcaatggaaagaacagaagacagctctccttgtctaaacgtcatatatttgcaggaaagaaaacaaccacaacttgagagagcttcaagaaaagcagtgtcctcaagggagaacattttttaagtaataaaaaagggaggagaatatcgagagcgtgttgagaatgtgtgtgattttaccaatgtatggactgaatccccaaggactcagtggaagagattcaaaatttaggaacagtaatgaatatgagtgataaaagcagatatatagacatatagaaaaagaatccaggggataggagatcaatagaaagttctgagtttgttgaaggcaggtagggattttttctgttggttacaaggcagatgatagtattatgtcttggaatgataatgagggctaaggtgaaggggagtacagatgggcagctgatgactaagaactcctggacatgttactcctgcttataaagttggaatgagtcattcttttcctctcaatttccaggtattacattggttgtgatctgacatgtattacctttcgaatggaattattttcccattcccacacaggatcaatttcttaatacttacaagttatccagaaaagccagaaatgtccatcatacctaaccctaattcttccagaaataggtaatacaaaatgttaagggaaatatttttattttatcacctaatggagtggcagattttagtgatttgccatgggaatttttttaaaccttatgtaaatatcaaactggcccattgttttctaccagccactaactacaattgttttcctcatttctttgcattcctaaatgctgtcagccactattaggaacttgtcatggtgaaattcaggactggcactggatcatggtcaatagttattctctaaagtataattgacacctgtgtaaacttataattagctttataccacacaaggtgccatatatttagaattgttgaaagattagtgaagagtgagtattttaataaccttaaacttgccagctttttgtcagtacctgggttaaatgggatatctgcagatttgctactcaggtatgattttatttgattcatttaattcagtctgtgattactgaatgcatactgtgttagatactcaaagtccaaaaatataactaaatattctgttccttttgaggtgctttagttatggtttttaaagcttttaaaattctgtacatagtactgtattaggcctacagtttgaaaatgatcattcattaatttattcactaattatttcaagcattctgtgtccttagcaaggtagcagaatatataatacatcaaaaataataatgctattctatattttaataagcaacttcagcaaagtctcaggatacaaaatcagtgtgcaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaagaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaacgagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcataaataatgccgcatacctacaactatctgatctttgacaaacctgagaaaaacaagcaatggggaaaggattccctatttaataaatggtgctgagaaaactggctagccatatgtagaaagctgaaactggatccctcccttacaccttatacaaaaatcaattcaagatggattaaagatttaaacgttagacctaaaaccataaaaaccctagaagaaaacctaggcattaccattcaggacataggcatgggaaaggacttcatgtctaaaacaccaaaagcaatggcaacaaaagacaaaattgacaaatgggatctaattaaactaaagagcttctgcacagcaaaagaaactaccatcagagtgaacaggcaacctacaacatggaagaaaattttcccaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcggagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaattcagtgtggtgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaattggaaatcataattctcagtaaactatcacaagaacaaaaaaccaaacactgcatattctcactcataggtgggaattgaacaatgagatcacatggacacaggaaggggaatatcacactctggggactgtagtggggtggggggaggggggagggatagcattgggagatatacctaatgctagatgacgagttagtgggtgcagcgcaccagcacggcacatgtatacatatgtaactaagctgcacaatgtgcacatgtaccctaaaacttaaagtataataaaaaaataaaaaaataaaataaataaataaagaaagaaagaagaaaaaaatatatatttttcttttatgaattagctacatcattttattatatttggctatttctcattataagtgctatattgtaattgaaataagtctttgtcagtgacaaaatataatacctcatatgcacacatatattcttcagttatatgtataacacttcataagtatttttcattgacaagacaatgctgatttcaactaaatttatttacagtaatttctaagtcaaattgttaagtgacagatccctaaattatctaagccatcaaagaaatttgcacatttctcaacagttcagctattttacctatatagaaaggcaaacttatggcacatttttaaagaaaaattttgagaataaattcacaatgtttacttctttagaaaacctatacttgacgaactttggtaagtaatgcaggaggtggcgtcctaagttttggatgtgattaaaattttggttaagcatttaactgatacatgtataaacttcacttttgcagaagtaagattactggaatttatggtatacacatttcaacactcataggagttgccaaatttctctacaaagtgtttgttgccaattatattgttatcagaaatgcacatttgtcctttgtgtatccatattaatattgtttatgaatactagttttcaatgactgtgatataatatgatattgtttgtttaatgttaattgtcttgattactagtgggattgaacaactatttctttctttttttgttgttttttacttttattttagattcagcagttatgtgtgcagatttgttacctgggtatagtgtgtgatgcttaggtttggaatattaatgatcatatcacccaggtactgagcatagtatatgataggtattcaacccctgttccctaccctccttaatccctctagtagtctccagtttgtattcttgccacctttatgtctatgagtacccagtgtttagctcccatttatgagtgaaacatgtggtatttggttttctatttctgcgtaaatttgcttaagataaagggtctccagcatcattcatgttgctgcaaagggcatagtttttttcttttttatggctgcatagaattccatggtgtatatgtgctacattttctttatctaatcaactattgataggcacctaggttgatttcatgtctctgcttttgtgaatagtgttttgcctcaatgaacatgtcagtacatatatgtttttggtagaatgatttattttcttttggatagataccaagtaatgggattgctggaccaagtggtagttctggtttaaattatttaagaaatctctgaactgatttccacagtggcttaactaatttaccttcccaccagcagtgtataagcattcctttccctgcagccttgccagcatcttttatttttattttttaataatagccattatgactggtatgagatggtatctcattatggttttgatttgcattctctgatgatttagtgatgttaaacattttttcataaatttattggccacttgtatctcttcttttgagaagtgtcttgaacaacttttgctttatcagttaagaatcctggtttctacctctttagttgtccttaaaattatttttgtaaaaaaaaacctttttattcattttcttatttttatttatcaatgtatagaatatatatattctctatactaatgctttgttgcaaatatatgggttgcaaatatattttattgcatttattatgtactcttttattagaatttttatcaataaaattgtagtttcaaatgctactataagaaataatagagagaagacctgtgtacactttatccagtttctcacaatggtaaaattttgcaaactatattataaaacaacaactaacattggtgtttgtacaattcatggatcttactcagatttatccagctttacttacatctgtgtgtgtgtgtgtgtgtgagagagagagtatatgtgtgtttatgtagttctatataactttaccacgtgtgtaagttcatatatacactactacactcaagatttactgaacagttccattaccaaaaggatccctcctgtcacctttctattaccacgcccatctcttcctgacaattctctgccactgatcacctccacttcagtccctgtccctaaccactagcatgcactaacctgtttccatttctaaaattttgccatttgaaaatgtcttcctttctggagctggaaaccatcattctcagcaaactgtcacaagggaaaaaaaccaaacaccacatgttctcactcataggtgggaattgaacaacgagaacacttggacacaggaaggagaacatcacacactggggcctgttgtggggtgggggtagcgggggagggatagcactagagatatacctaatgtgaataacgagttaatgggtgcagcataccaacatggcacacgtatacatacgtaacaaacctgcacgttgtgcacaggtaccctagaacttaaggtaaaataaaaagtatatatataaataaaaaataaataaataaattatcaaaaaaagaaaacgtcttatatatgaaactatatataagttgctcaccttttgaatgtggatattatttagtttttatttttattttaatcctggtgtacatgtgcaggatgtgcaggtctgttacataggtaaacatgtgtcatggtggtttgctgcacctatcaaaacattgcctaggtattaagctcaacatgcattagctatttttcctaatgctctctcttcccccactccaccctcagacaggccccagtgtgtgctgcgccccagtgtgtgtccatgtgttctcattgtttagctcccacttataagtgagaacatgcggtgtttggttttctgttcctacgttggtttgctgaggataatggctccagctccatctatgttcctgcaaggacatgattttattccttttttgtggctgcatagtattccatagtgtatatgtaccacattttttttatccagtctatcactgatggacatttggatggattccatgtatttgctattgtgaatagcgctgcaatgaaagtaagtgtgcatgtatctttgtaaaagaatgatttatattcctttgcatatataaccactaatgggattgctgggtcaaatggtatttctggttctagatctttggggaatccccgcactgtcgtccataatggttgaactaatttacattctcaccaacagtgttaaaccattttcctatttctctgcaaccttcccagcatctgttgtttcttgactttttaataattgccattctgactggcatgatatggtatctcattgtgattttgatttgcatttctctaatgatcagtgatgttgagctttttttccatatgtttgctggccacatgaatgtcttcttttgagaaatgtctgttaatatctttgcccactttttaatggtttttttttcttataaatttgtttaacttccttgtagattctggatattagaccttttctgatgaacggataaattcctggacacatacaccctcccaaggctgaactaagaataagttaaagccctgaatagaccaataacaagttttgaaattgaggcagtaatagcctaccaaccaaataaaagaccagaaccagatggatttacagctgaattctaccagaaatacaaagaggagcagacatccgtccttctgaaactattccaagcaattgaaaggagagactcctctctaactcattctatgaggctggcattatcttgataccaaaatctggcagagatatacaacaaaaaaggaaaacttcaggccaatatccctgatgaacattagtgtaaaaattctcaataaaatactggaaaaccaaatctagcagcccatcaaaaagcttgtccaccacaatccagttggcttcatccccaggatgcaaggctggttcaatatacacaaatcaataaatgtaattcatcacataaacagaactaaagacaagaaacacatggttatttaattagatgcaaaaaaggacttcaataaaattcaacattccttcatgttaaaaactctcaataaactaggtatttaagaaacatacctcaatataatagccatttatgacaaacccacagccaatatcatactgaataggcaaaaactggaagcattcctcctgaaaactagcaatagacaaggatgccctctctcacccctcctacgcaacatagcattggaagttttgtccagcacaatcaagcaatagaaagaaataaaaattcctcttttcaaataggaagagaggaagtcaaattgtctttgtatacagatactgtgatcctatgtctaggaaaccttgtcgtctcagcccaaaagcttcttaagctggtaagcaacttcaccaaagtctcaggatacaaagtcaaagtgcaaaagtcacaagcattccaatacaccaacaaccagcaagccaagaaccaaatcatgtatgaactgccattcacaattgctacaaagagaataaaatacctaagaatacagctaaaatgggacatgaaggacctcttcaaagagaactacaaaccactgctcaaggaaatcaaagaggacacaaagaaatggaaattcatcccatgttcatggataggatgaatgtggatttttatttagcataatcctttcaagattcatctgagttattgaatgtgtatagagtttgttcttttccattcagagtagtattccatgctatgtatatacacagttagtttagttgttcacctgttggatatctgagctatttccagtttgagctctaatgataaaaactaccatgaatatttttgttcaagtttttttgagaagataagttttcaaatgatagtttagtttgtatagtaattatatgtttacttttacaagaaattgacaaattggttcccagagtatatccaccattttaccttcccaccagcaatatatgattgacccagtttctttgcatcttcccctgcatttggtatcctattttttaaaaaaaaatttatttgccattctgctgtagtgatattgtggttttgatttatattttcctgctgcataataatgttgaatagcttttcatgtgcttatttgccatttttatatcctcttcataatttgggccattttataattagattttttggcttgtttggctgttgaattttgatttttctttttgtgtattctagacacaggactttgccagatatgagtttggcaaatatttttgctttgtctggtgttaatctttttattttctttatagatctttggcagagcccatatatttctatttaaattatggaataaacttgtctatgtctatgaaaattctttctagcacctttactaaaattgcattaaacagctttagataattctgcagacaaatggcatccgtactatattgattccaattcatgaacaaaagttgtctcttcattaatttaagcctacttgattttcttcatcagcattttgtaactttcattgtaaaaatccatacagagtcttttaagtgtttacctcagtattgcaaattatttggagtaattgcatgtagtattgtgtttccattaaatttctgcattttcatttttttatattgaaatgtgttttttaaaattgatcctgagtcttaaaacatttaggcatttggggaatttgacttgttgtgatttcttatgttataagaaataatcatgtagtctacaaatggtgagttttgtcttttttatttttcaatctgtatttctctatcttgccttattacactgaatagaattttcaatactatgttgaataagagtagggtgaacagatatactttccttatttccaatctcatataggagagcattcagtctttcaccataaagaattatatcagttataagcttagggtgatgttatttttcaagttgaggtaattcccttgtatttctaactttttaagagcttctatcatgaatggttattggattttgttaaatgctcttgtgtcaatggatatgatcaacagatttttcttcattagttagtggatatggtagataacattattgatttttgagtgttcaaccagccttgcaccgagaaataaatcccacttgatcatggcctataattattttcatatatattgtagttgatcttctaatattttgagattccttatatatcaacttttttgcatgcaaaattgtgagagatatatgtctatagttttctttgattttgtactatctttgtcaattttggtattacggtaatactagcctagtgaaatgattaatgaatgaatattccctcttctaaaattgctaattagcaattgcaattagcaattgctctgaatatttccttcctgctttttgctctgagtttaatttgctcttctattttctagtttcttgatgtagaaactttgatttttgatttgagactagtccttgtcaaagattttatatttgacataaactatttaagagtgtgtgtttaattttcatgtgtttagagattttcctgtggtcattctattattgatttctgcttcaatgtcattgttggcaggggacacattctgttgtgattctctagtgaaacaattttagattggtgatttcttttctgggagcttttaaattaataatttcatttttaaatgatcgactataaggcatcatgtttgagtttcagtgatttgtgctttctgaagaacagttccatttttttctaattgatgttcaccaaggcactcatagtatttttttttttttttttttttcttgagacagagtctcactctgtcacccaggctggagtgtagtggcacgatctcggctcacttcaatctccacctcctacgttaggtaattttcctgcctcagcctccagagtagctgggattacaggcacctgacaccacgcccagcaaatttttgtatttttagtggagactgggtttcaccatgttggccaggctggtcttgaactctcgtcctaaagtgatctgtctgcctcagcctcccaaagtgctgagattacaggcatgacccaacgtgcccagccagtattctattattaatggctgtaaaatttatattatatccccaatttcatttctcatattgacaatttgtgttttcttttattatttttgctagtcttaccagtttattaatttaatttgaagaaccagtgttcatcaatgttctctatcattttccaattttcaattttattgatttttgctctgaatatttccttcctgctttttgctctgagtttaatttgctcttctattttctagtttcttgatgtagaaactttgatttttgatttgagactagtccttgtcagcaatgtaagcacttcatgctatacatttttctctcagcattgctttagctgcatctcttgcatttttgtatgctccatatgtattttcattctagtctacattttttaaaatattttatatttgacataaactatttaagagtgtgtgtttaattttcatgtgtttagagattttcctgtggtcattctattattgatttctgcttcaatgtcattgttggcaggggacacattctgtctgatttcatttactttaaatttattgagatttattttatgaattagcatacagactatttcaattaatgttctgttgattgttgaaaaatgtgtattctgatattgtttggtgaggggttctataaatgtcagttagatcctactggttgagtgtgctgttcagattttctatatcctttgttattttctatctagtaattctctcagttgttaagtgggagatacagtttccaattatatttgtggatttgttttttacttttttcagttctagacatttttgcttcatgaattttgaagctttcttgtttactgaggacacaattgggattgttaggtcatcttgttaaatggatcttctgtcattattaaacttctttctgtctctaatagttttcttggattttatgtctactttattaggccgtatatattatatattaataaagtcacacatgcttttttatctttaatgttttaaatagcatttccttttccatcctttaactatcagcctacctatgttgttgaatgtgaagtgtatgtcttcacttttcttaggggaagagtctcaggtctactaagaacgactcttgagactgggtctcttttgttggttttgccaacctttactgggctatcccagtggagtaaggaaatatcaggcctaaatgggatggagagcacttcttctggtcactaactgatgccagaatttctgatcattcatttgccattggtattgcactcacctgatatcagagggtattcatttcaacatggtgaaaaaattagcctagataggatgcctacttttactaggtttcaggtcaagaaatgcctgcaaggcttcttctgttttgtgggtatatgcaagacatatactgctgatgccacattctcaaatccagggttccaaaccagttgtcagcattgtcttttgcttgcctcttgagtagtttatagagtttatagttgtgcttagcagggagaagcaagaagaaatagttctatatcatatccagactgaaaaagatgctgtttttggacatcttgaaaatagtaattttagagctatcaattttatcattatttttccttatgatttatacatttcaagtcttgttcaagaatctttccctacactgacgtcacatgatattacatattttctgtcaaaattcgtgcgtttttacctttagacattaagatctttaatctacctgatttaatttactctaaagaaataatctaattttgaaattttctcatagtctagtgaattttcctggtaccatataacatatgcttttcaaacacatttttttcatataggtttcaatgcatatgcaatgtatatgtgtttctaggctataattttatggtaatatatttatttatcaccctgataatatgacaatattttttataaccataataattcatttttaattgacacagtgagtcactacatatttctgaaaaattgccttaggttttaacactttacacttttataaaatcaccttgttcagtttcatccaaaactatgttgtgtatttgaatgaaattacatttactttacaggttaatttgggcagattttccaattttacaaatcttctcttccataaaatgtatttctccatttatttaaacattctattcctatagaattttaaaattttctctgtaaatgttttgcataattttgatataaatattcctttttctttcttttttttgggggggatggggaacagagtctcgctctgttgcctaggctagagtgcagtggcacgatattggctcactgcaacctccgccacccaggttcaagcaattctcctgcctcagccttccaattagctgggactacaggtgcacactgccacgcctggcaaatttttttgtattttagtagagacagggtttcaccgtgttgcccaggctggtcacaaactcctgacctcaggctgatagatatatttctaagcactgttatctcccatggcttttgcaaattatttattttttaagcttttattatctaattatttggcatatacgtgtatatatatacacatatatatacatatacgtatatatatacatatatatacatatacgtatatatatacgtatatatacatatacgtatatatatacatatatatacatatacgtatatatatacgtatatatacatatacgtatatatatacatatatatacatatacatatatatatgaaaggcatgttctttcagcaaataaagttactgaattctcataattatattaattccaattctcttataattatattaattccaatgctcttatattaattccaattctcttacaattacattaattccaattctcttataattatattaattccaaagaagattacttagatgttttctgaaatcgtttctatggtctgaatgtttgtattaccccgaaattcatgtgttgaaatctaatcacaatgtggtgatattccaaggtcgagcttttgggaagtgattaagtaatgaggaagaagccctcttgaatgggatgagtgcccttataaaagaggccccagagagccaccttaccttttccaccatttgaagaacagagaaaatgtggcctctatgaaccaggaaataagccctcactagacactgaatctgctgcttattttgaacttgatcttggactttccagctcgcagaacagtgagaaataaacttttattgtttataaagtatgtagtctaaggtattttgttatagcatcctgagtaaattaagaaatcaattataaaatgaaaaaaatgagactctttaaaatttttgtcagatgtacatttctaggaactttctggaggagaccttagggttttcaaggtaacgatcatattgttagcaaatagttacagtttgacttcctcaagaatctacaacgaactcaaacaaatcagtaagagaaaaacaatcccatcaaaaagtgtgctaaagacataaatagacaattctcaaaagaagatatacaaattgccaacaaacatatgaaaaaatgctcaacatcactaatgatcagggaaatgcaaatcaaaaccacaacgcaataccgccttgctcctgtaagaatgaccataatcaaaaaacaaaaaacagtagacagtggcatggatgtggtaaacaggcaacacttctacactgctggtgggaatgtaaactaatacagccactgtggaaaacagtgtggcgattccttaaagaactaaaagtagaactaccatttgatccaacaatcccactactgggtatctacccagaagaaaataagtcattattcaaaaaaaaaaatacatgtacacacatgcttatagtgacacaattcacaatagcaaaatcgtggaaccaactcaatcaacaagtggataaggaaactgtgatattatataatattatataatttatattatatgatagaatactatgcagccataaaaaggaatgaattaacagcatttgcagtgacctggatgggattggagactattactctaagttaagtaactcaagaatggaaaaccaaacatcatatgttctcactgacatgtgaaagctaagctatgaggacacaaaggcaagaatgatacaatggacttggggggaagagtggtgggggggcaagggaaaaaagactacaaatatggagcagtgtatactccttaggcgatgggtgcagcaaaatatcacaaatcaccactaaagaacttactcttgtaaccaaataccacctgtatgccaataacttatttaaaaaatcctaagggtgagaaaaaaagaacaaataattttattgtttctctgatctttattctttattttcctgaccatgtcccccaataagattttgagtagaaaatttgttgatcttaattttaaagggcctgcttttaagattgtatgatgaaacatgatatatttttgcaggttttcattagatagtcttatcaggtaaatgaatttctctttcatatctcctatatttgtaggttacaaggaatatatttttatgtttttattttctttttataattgtgtgtcaaaattgactagataaaccttgtgtatctacttataactttttaaaaatacgttacaagtttgtttaaattagttgacggtaagctatcccttaatttctgagaaaacatatattttatcagaatattttacttttgtgtatacattgctggtataggtttcaaatttttttaaaaaaatttttaatctttgaaaatgtcattaaccttcaatctttctcacactgacctaaacaagctttaatatgaaggttacgtaccagcaaaattaagtgttctagaaatttgtcattttttaatacattctggttaaaaaaaattagataagataaaaattatcttttatgtgagaatttgctaacatgtgccactaaaaatttttttagaacaacagtgggttttgtattagtgtgaatatttttgtgtgttaatgtgtgtgtctgtgtattgagtggatatgtccctgcaatatctgttgttagcaatcatttttcacttttatttttgtaccaaacattttgtcttgatcgaactaatcagtggttattatttattttgcttatttttatttttaattattttattgtttctcactgttattattattgtataatcctatatcactaataatttgatattactttatttcttattttgttacaagtattttgatgtataatatattgctttcatttttggtttcttgatttttcttttacattcttattcttatgcccctttttttctttctttcagtatattcagttgccttcctattattaaaccattgaattatacatgttacattaattttcaagcattcttattttcaaacattcttttttcatgatataaaatatagaatatatattttaatttatacactactttattcatacaacacaattgttgaatttaatacttttgttgtcattcagttctacatatttttaatttaagtttacattcacttcacttttgattgatagaatatttaaattgtttattattttaacataatccaaaaattattaaaaattgttttgtttctttttgtattgtttttacattgtaatttatttcttgatatttgtttcatattgtttctttagtaatttggagacttgctttgtttcctcctatttggatgaatgttccacgtgtattcttctacatctgttgggtacagacaaaagtccatcaaatcaagcttataaatgaagttgtctcacttatttttttctatggttttaaaaattgttctttctgtttaatctagcatttattgagaaataggcctactagtttggtaaatattttgaacctttgttgctataagcattaaagttcagaatcattttatattcacagtgaatttctccttccataatttagaaatgtccatttttatccttgacaatgacttcttctgcaaagtttgtcatctcagaaaattaatagaaatattactgtggcagaaataaagccaaaattgaaaatcacagtagtactctttgcaaagattttgagagaggaaatatgtcttaatatgcattggctttgattttaatctgtacactaggatagagtgtgggccttttaaactgcctaaagcaggaatttgaactggttccttccagaagtggcactggcataattcttattttaaaaaacaaacaagacaatacataaatataacttacctgaagaactataaacctagtaccctacttgcacaaggtgagaaatgaatattaacagcaaaaggtctattaaataaattaatgtaaaactactttgaccagatattgccacaactgcaactgaatgaaatttacacaggggagaaatgtgccaataaagatacactctttaagttatgcaacataagacaaaatttccatcatgaattcaaaacataagagaattagcatttccaagaccaataacagaatattaatcatcaagaacataaaaaatagtcttaaaaataagcaaatttataaaataacaaatcagaataaatataacaaatttggataacatgaagaaattaaaaagacattaaaaatcagtgaacaggtgaaaccattcttttgcacagattaaaagataattagtgaactactcaataattataaagaagcagagagggataaggtaatagaaaatcagagtgaattgttagaggcatggaaactgtagtgagatgtctaacaatacagaattagacaaagtggagagagctgactttaaataggtaattaaggtgattctagaattgatagaattcttgtctattcaagttcaagaagcacaacggctcccgtgtggaataaatccacatgtatacattcaacagggaaaaaaataaactcaaataaaacattttgaagcttctaaagaaaaaacgacaatagtacttttttaagagcaaggacaattggatttcctttgtcatctcaagtgctagaacagaaacacatatgataaagaacttcagtaatgaattcttagaactcaataataagaataacatgaagtctaacaacattcttaacgaatggacaagatatttaaacagccacttcactaaaataattatatgaatggtaaataagcatatgaataaatgctgactaccagcatgcaaattaaaatctcagctatatacccactagaagggtgacaacttaaaaatcttaaagtcagagatgggaatataatctcacacattcctggtgcaaatgcaaaatggtataaccactatgaaaaacaaaaatgtaagatttacagtaattttctcttttctaagtaaatgaggaaattgcatatttttatttagtactttccacatggcagccattgaaataagagatttacatgaaagaagtcaattattatatctcagtttcttaagtatcatcatcatcaactacttaaaatgagaaataaaaaactgaagctaaaataacttgtctaagccctcacagctagtaagtggttcatatatgatatgaatcttcctttttctctaaactgtggtgtagtataggttgctatatttaatcaaattcttgccagctgcatagattttcagtcttctaaggattcaaatgcaaaaaagaaaaaaactatactgcaaattgtacataatttattctttctctagaaacttgtaataatagatttttcctaaattatccaatgcaaaatagtagtttcagaggcagtcaataagtggtgtatgaaaaatatgtactgtggtcaaatacatttgggaaaagttaagataaaaagcataaaagttatttctttattggaaaatgtttaaaacttttattttgccaaataatatgtacatttctgaaacaatgtacagtagtaaacaatacctatatgtattttaatacagaaaacttttttcgtataataatttgcaggactaacttagagttaattagaatatcttcaacagtttgctctaaatcataattataataatgattaaagttgcactattaaggcttagattttaaaaggttatttaacaaaaaccaaaaatgtctagttccaaacatggagggtaatgcttaataagaatgagtatttaacaaataagtaaagctgtccatgaagaagaaattcttcaaaaagtaaacaaacaaaaaacattatttaagcatgatcctttgttgtgaagattaggctataatgggataatttgctatagataattctgaggaaatatattttattttttatttttgtttacaatatggaaagcaaatattacaaaaaataaagatgcctttaatctgagcatcatctaacaagatttaagataaagtataaatcataaaaagaaatgtctgtaattcaacaaatataaatatatgtattttttctacctttattataatgggcaattttctacttttataacatagaacacaaaatttggatcaatatttcaaaggttatttcttacttgttgtatatgtccactatgggttggtgggaagaccccatttataatggtttttcagtgactcagtatgacaaagacttcatttctacacaaataacatttctacaacaaggaaagaaaagttggaatttgacaccatcaatcaattcctttaactttcgattgacttatgagacttagtttaatttcatgggctaaaacaaatctagcattcttttctatcttaaagtggtagtaaattccaacctaataatttgcctgtaagaagaagaatcacagtatatgtggatagccctaataatcatgatcaatagttatttgaaactattttataaaagttttaatatgtcatttcaattttaactttttaaagaatttaataataaagtgatacatagatttttcaaaggttccactacagattggtttataagaagatgaaagagagatacaatatcttgaatttagtaagattagattttgagttcagtgtgaaggatatatttgaggaaatagatatataatgttgaaaactaatattaagtcacagtggagttatttggttactacttttaaatacttatcttacatgtatctctattttgcatccatagcatgtcaaatgtagttccaccctatttagggcaataggtaaaactaatgagagtatacaatggtggaatatcctcaatcatgttggagtgtattagtatataagaaacagaaagcaattcttagcccatgctggaagcctttatttaaggtgtgtaatctctttggcaaagcataactgaagttaaaaatttgtgtaaacaaggcattcaagaaaattacttttatttagcttagtcattaaagaatgagtgtgtatgtaatacatgcagagaaattttagaaggtaagaaatgtcctaacagaatataaacccttagagaccttgcaatgtattctacacagtgatgtagctgcagcaactataaaagttcctgtccaggtactttataaatgtatataggttgcactgataagtgaatgaaaaaaatagacaaaatattgaggacaaagttaagcaacgtttaatctttttaaatttttatggatgcataattttgcatacttatggagtatgtgcaatattttgatattatacaagcatagaatttgtaataatcaactcagggtaattggatatccatcacctgaagcagttatcatttctttgtgttaggaacattttaattccactcttttagttattttgaaatatacagtaagttattgttaatgatacttatcatatagtgctaccaaacactatatcttattccatctatctaattgtatttttgtacccattgatcatcctttcttaaagcctttttcaagtgcaccagggaggtttcattataggttagaactgtctgtttgctgcagttgttaaaaaataaaaatatcagccacggtttggatacttgacatttaggtttagtagtgtctaatcaaaaatttttggagagttacaataaaaccctgacaaaggtttaaaattactgtcttttttggtttggagataatatgagaaagacaactgacacatgcttgtgattctttatctagccattgcttactcactacagctatattattataacggtggtaggtaaattattttaattgtagtaaaaaagttaaagacaaaagtattaaaaataatgataactgaaatatgtttaaagacacaatacgactaggtataaattatgacaacaataatataatgtttatgagggtgttaaagtgtagagttttataagtgatagtgattgaatttaagttgttatcagcttaaaatataatgttataacatatgtgatgtagaccccaaggtcaccacacacattaaagaaaaaaatacatatacctatagaagttacaaaaaagtcaaaggaaggaatcaaagtttatcactgaaaacaaatcaacaaaacacacatgaagacagtggaaaaggaagaaacaaaaggactgcaagactaacaaaacaaatcacaaaatggcagtaggaaatcttcccttactaagttattttgaatgtaaatgaattaaactctaatcaaaacatacagagtgaccaaatgaatatttaaaatagacctatctaaatgctgtctacaaaaatctctctttagacacatgcaggctgaaggtaagtggatgaaaaaaagatactccatgcaaatgggaacaaaaagaaagcagggacagctatacttatatcagacaaaatagacttcaagtcaaaaacagaagcaaaatacaaaaaaggacagtgtataacgataaaagagttgccaggaaaatataacaattataaatatatgtgcacccaccatcatagcacctaagtatgttcagcaaacatcaataaacagagtcatgcaataagagtggaataattcaataccgcacactcaggaatgggtagtaaccacacaaaaaatcagtagatgacttgaacaacactatcaactaactggacctaacagatatatactaaatattctacctaagagcagcagaacacacattcttcaccagtgcacatagaatttttttcatgacaaattatgttaggttagaaaataagtcttaataattcattaagactgaaattataccaagtcttttctgatcacaatagaattttagaaagaaaactggaaattcccaaataggtagtaattgaacaacacactgtaacaaccactgggtaagagaaaaaagaaattagaaaaatgcttcaagaaaaacaaaaacacaacacagtaaaactaatgagatgcaccaactaagtattacaagaaagtttattgagataaatacctgcattaaaaaaaggaaatagatcaactagataatcaaattgcacatttcaaggaacaagaacaaaaaagaacaaacaaagcccaaagttagcataaggaagaaaataacaaagattcaaacagaaataagtaaaatagaaacgcaaaaggtagaaaaaaattaatgaaattgggtcttggctttttgaaaaaataaaggaaactggcacatacttagatttaaaaagatttgccaaataatttccatgaatttcatgtaattatctgttaatttttacagaaaaatctaaatttacggaaaaaaaattaacagataattacgtctacagggcataaacacaaatcagaatttcaccatctctaggaacacataagaaaacgatgaggatagttgtcacattgtctggcaaagctcagggaaagagtaaaatacaatcataaaactatcaaaaaaagatatccaggatagaaaatgggcaaaaaataaaaaagacaatttttaaagagagttaaaagggattaaggagaaaatgagacataaaaaaagagaagcaaaaaatagtcaaaagaaacacagaaaataaaatacaggtgaaagaaagaaaacattttatccattttttaaaaaaggctagtaagtgatatgcagaaaacagtagaagtgaaacatagataaggagagctaacatttgtataagtatattcccatggaataaaacagaaataataaaacaaaactaataggtttaaaaagtttatatagtaatcctcccttatgcaggttttcagttgcaaccacggtttgaacatattacatagaaagttccagaaataaacaaggtgtaagttttaaattacctactgttctgagtagcatgatgaaatcttccactgtcctgcaccatcctacccagagcataaatcatcccttagttcaaggtacctatgcctacctgcccattagtccctgagtggctgtctcagatcatctcagtggcagtcaaatcttatcagattgaccctggcatattacagtgcatgtgttcaagtaaatctcacttggtttaaaaatagtcccaaagcacaagagtagcgatgctggtaatttggctatgccaaaaggaagctgtaaagtgatttttaaagggaaaatgtcaaagttatctactttataagaaaaaaataaattgtatgtttaggttgctaagatttatgttaagaatgaatcttctatttggagatggtgaataaggaaaaaaataaatttgtactagttttcttaaactgcaaaagttatggctacagtacatgatagttaagatggaaaaggcatgtatatagggcttagtgctatctgcagtttaagcatctactgggggtcttggaaagtattccctgcagatgagatggaactactgtaatccaaaaaaagacttgaatctgcatcttgaaaagatggtgtcatgtcccagaggaaaaaaaatggtcccagactgtcaacactgaaggtatctcagtaagtttacttgatatcaaacatgaattcttattcagaaaatgctttagacagccaggccaaaaaaaaaaaaaaaaaagagagagagagagaagaaaagaaaaaatacaagttttttatattgaaattaacaagaggggaaaaagccaatcttggaattcttttgtagagcctttactgctagattaaaatggaaaaataccttcaaagtgctcaagggaaggaattatgaccaaaagaatttatattgagttaaataatcttttaagaataaaagcaataaaaggttttgaatacacaagaaatattttcatgaactgtttctgatctaagtagaaaaggtcaacacgagtcaatcaaaaatgactagaaaaaccgctagagtaggaaggaatttatacatttatctgtagatgtaagattcaaactaatgtgaggtttcgggtgaagaaatagaaggtatgtacttaatgcctaaatatagaaatgatataaacaccaaggtttgaggaaagagggtaagaaatcaggaagtatgtggaatactgacttttctaataattaccaatatccaaaaaagatggagttcatgaacatttctcaaatccataaatgtgagtaagataattttaaaaaagaaaacttttcagatattacaaaaccatcctaaatctttgctatatacgagataaacctgacgcaaagtgattcatataattttttaatgtgcagagatatagacaatttaaacataaagaagcagagtttactgtatcaataagaaacaagtatatatttaggccaaaactattaactgagacaaatcagagatctttataacattaatgggtaccaataacattgaagacaaaatagtaatggctatatatcacataagagcttcgatatacacagatacatttgtaggaaatacaaggaaaaatggaaacacattaatgaagaatatttaattttacttatctaggtcattgacagaatatttaaagacataaaatatatagttctagtaaatgatggagctagatttaaacttatcatcactggctctagaaactaagctttttaccagcatacaacagtgtgatactacagtgccccttggctgatgcaagtgaacataaatttatatatttggaggtgaaataaaaaatatctcctctgactaaaacaagaaacacatgaaaataaggggtcttggagatttaaaaaggaaagagaataaaataattttctccaaaagagactgtagtataaggacagttactgtgattggcaatagtgctaagagcctacttcagatcaattggggtgacaccagagtactagatgtctccaggaatccagcagaaagtgagtgtatccaggacccaacaagctcctcacattattactgcatctaccttacagctccataattatgggatacctcatcaacctccttcttgagcttccctctactctattgctctctttaaactgttttgccctgcctaatttgcacataagccattcatcgctatcgacttcctgtgttatgtgactccccagtataggcatccaaataaaactgattagagttttcatgatgctactccagattccagggcttagtttatgtcatgaggtcacatttatttcatgctgatctggtaggagacagggcaggattaggttataaaaactggctgcaattgaggactctcaaaagtctagtgtaggtgttgaccccattttacaaatatggtaatttaaatcattattaaagttaatttaaaaattatacccaaagtattaattgatatgtccatgtttcaatgatgccatcacaatatttttgtttaaatgcaccttgcaaaacaaaagctgatagcaaatgtctttttacccaaaacagttcattgaattttttatccataagaatgtaacagttataattttaaaaatccaacagaaatcatggttcgttgggggtaggcatgactgggaatgagagagttcatgtacttgagtgcatatgattctccttaggccaatatgttatagcactcttctactcctcctaggaattagcgatctagttaaactgaaacaaaaaagaaatggggggaggttccaccaaatattctcaagtataatgttatacttgtgcttttataattttagtctatgtatatttgtctaaaatacaaagaaaaataaaattttttttgttcaaaaagaatgattgtaaagccaattaaagaagctttctagacatctctgctactaatcccttatacttctaacataacagaaataacatggtacttaattttctttagaaaaatcaattcatatattaatagacacacagaaaaattgaatgatatcacttagaggatcacaagaaaaacatttcagacacaaggtatttatttctatttactgtaaaactgctttagtatgagatcccccatctaaaatcattttaattgaaccaagtaaaggctggccatattagcagcagggagagaccatgttgattttatggcatccatgagaacaaagataggagatggagcatttaattagaatgcaaaatccttttgctcctggtgcaaaaatgtacatggtcaaaaaccttataaaatggaaaaatattagtattctctcaacaaacaaagtagacactattttttctttacactttcctgaatatttcctactgagtttttctcaatagtatttttctgtaaacaaaatatctgttggatattgaacaataactaccaggtcagaatcaaaaggaaaaagtcatgagtatacttgtagatttagatggagtcgaaaatgtgacaatgaatgaaactgtccagatagagcaaatatagaaaaataaaagcaaacaatgacacttagagaaatgtatacttaagagttcaacgaaagaaaaatgccttggaaagacatgcatttatcatacttaaacaaatagaaagaaagtgttgtagtaaatcatatgtttgattgtctgatacagacaaaaaatgtggcagaaaaaaagccatttaaaagccaaataagttttgctttatacacaacttgacaatttcaaagtcaaatatgtataaaggcatcataccatgttaattaatcataagtaaataaataagtggaaaaattatcatgaagcataaacttgaaaaaagttcgtatgctttctgggaaatcagtaacttaaaacatgatagaaaccctatcaataagtagtctaacttataattagcctcagatgtctacatgatttggaaatatatacccatttttttcattagattaggaatctctaaagataaaaacttagaaaactaacttgagctttcacttagtaattaatggtagtaggaaaaattaaatgtagaaaatttttagaaatagaatcaaatgcatttaaaatgtaaaatctgttatgaataaaatattatggtaaagctaattatttgtagatttttgtctataatagtttattcaatcagaaaacatcacatttttaagagaaaataactttttcatgtaaaacaggaaacaaggaaaataataaataattttaactatattatatgtttatcatttatatttttactccgagatatgttaaacaagtaaggtaatttatatctaaaataagtaatctaatcttatcaggctagagtataacattatgcataaccttaatatactttcataacaaacttttaaaaatttgttttgtgtgctgtattcttagcttttaaaaatgacttttataaataccgacagagtaaattaatttgaacattagttggttttgaaacacacattcataatgtgaatagagattctaggaaaatgagtaccatcttcactctttgagagtgcacaatcacaaaaagtaacccccaaaacaaaccatatgtacatgaactagttaatggatgaagaaaatttggtatgtacaaagaatgggatgctattgggcaaagaaatgatgctacagtatgatgatcctaaaaacattatgctaagcaaaagaagcaagacacagaagactacatattgcatgattctatttatgtgaaacgtccaaaaaagcaaagatagagagaaaaaaaggagactagtggttgccttgggtgacaaatgagaggactataagtggacacgtggattctttctgggatgatgaaaatattctaaacctggattgcggtgatagttgtacacaatataaatttgccaaaagttgttgacttatatgcttaaagaattctatggtatataaattatacctcaacacagctatttaaaggaaggtgcattatatacacatttatacttttcagatattaataaaaaatggaaaactttgtttgttgcctcaccgaagagtaatttcatagcaaaacacaaatccccattcttagtttgccttaatttcaagtatcatatataatacacaatagtagatttaaaataatatgagaaattgttttatactggctgattatgttcacatatcattgaaaagaaaggatagttacaaataccatgtagttactacctgcaacatattttctaataatattatttaacatatgcatttaattatatagtctatacatccttccaagcctctaaaagtagctcctaaacaaccattaggctttgtcatcctataaatattcttataactgtaaaacatttggaagactgagtaactatttcaagtaaatctaaagctaaatataatgcaatacttaaaactttctacaaaatttaaggtccaatatatattcattcaagctttaaaatttcatacaatcttaggagtattctatattttttgttttcctcatcttatttcaaacaaaaaaaatcaagtgtattcataacttagaaatgatttcagtgacctatagcaaaaagactaagaactgcaataatggttttgacattaataatgttttggaggcataagtgttttgttcttttgtttcttttataattgttgttacttatactggagaaagaaaattgatcattttcttttctgacttgtctcttacattacagagcttgaaaagaccttaaggtaacatttcaacagcaacctcacaataacttgactattttatttgtttttcttacccaaagacagcagtactagataaaatgaagggaaattacaaggcatgtttacatacatatcgatgttttttttacatttatataataaaaaatgcattgctggatatattttagaagtatccttaataaacaaaagaaaatggtttgttactgaattttacctcatgaacatatagggtaaaattcctgtgtaagaacaatgcaagtatatacacatatgtccatgtctatatctatgttgggttgcctattaatgactggaactgcctgcccatgtttgagcttgagcctgagtctcactgtccctcttgtcagtccatccatctctttctgcccctgtatgcccgtttgtgcttttctacctgtctatccatccatctctctctgtggtatgtttcacactgtctttcagtttgcctgcccctgtcatggggtctgactattcctatcccatttttaatttctatctgttattctgtcaccacatgtgtttatcagcctgtctctgtttcggtacctgtaaggctgtatgtattggtctctaagtatgtatttatctgtttaagtgtctgtctatccatgactctatgtgtacatatgtgaagatttttcctttaatgtagatttagtgaatactatctttaaaaatcattattgtttcttaagagatgagtgtgtatagtattgtttgtgtgtgtatctatctcccaagcaactgccaactctataggtccaatctacataatggtaggacctagagattactcatgtttttcgaaagtcagcttctcttagcctatttaagaccatgctctattgcattctgcctctatattacaagatggctcctaatgaaacaaacaaacaaacaaacaaacaaacaaacaaacaaacttgtcacaggtagacgtggatatctacacctcaggcctctgctttctagttaccctcctcctaaagaggagctgtgaaggttttatgtgcaattgtagccccactctacatttccaaagaacctctacctcatggcctatgtgggcatttactaaaggtttaaagataactagaaggagttttaaaataaaaacaagacatgaaacaaatgctaaatacaactgatctcaaggtcaaaggagaacatataataactcaaatgctcagaaagttattttatgggcatttctccttttccaacttgattttcaagatccagcccaccccctgccgacccccattggaaacccatgaagagtataccttttttcaataatttgccatgttaatcttcatttctacatgtaaattctacctattctcataaagatatccattttccttgaatattcccaaccttgaacccacaatgataatcgaaaagaagaaagaaaaatccctggtagatcattttctgaagctcgaatcattctgggaggaacaatactatgtagagggagggtgtcagagagctacgagatgaaccacaggggtgtttaatgttacaaatcctatacacttcagggtctatttgtgatgggataagaagatgcttctcaatattcttcctgtagactaaaaatctgcttttcaatctcctgcgagtaaggcttggaaaaaatacaaacacacatgacaccaatgtgtatataaacactctcacatatacacatttacatccctactcatatgaacataaaatctttctagagatagtaaatctaaagacatattaaataaaaataatttcaatgcaatgtaatgtacgtagttatccaggtgtccaaataaaaatagctaaagaaattttgctttggtattgttctcctgtgtccaggagtctactaaagactaagatgatagggcctaataaaagaattttctaaataataacaatgttgtattaaggttctacataggcacaagcatatattttacttgcatgatagatattataattaaaacctggaattattaagcctgtttatttacattgcttgacttgggcaggtgattgacaacctttctctttatgatgattatatttcttgtattgtatatgggaatctgacaatatcacaaagattctgttgtgaaaatgaggtgatagaagaataatttatgaagtagatcaactgtacttaacattgcatgggggtgctggcctacttttcaaggatgttctaacaaattcaaatttggcaataaaatataactcagttctacaaaaaatactgtaggcacatcagatgcatcactgaacttaaaaaggaaaacccaggaatttacacaacatcatatacttcttcgaaacaaagcagaattaccacctggcaaagatttccctcaagcatgtcccgccacaaaaccattcaagtctactccctgtgtattagaatatttataactatttgtcagtttggcttattcattatttctctacataatatgaattattaaactaagcatggacttatttacttgcaaaattaagcacaaaatttttgtaactttcaaattataccattttgttctttagattttctataagtctgacgtatttatccatactcattcagcaaaatattttgaagaaaaaaagtcctaaaaagataagtcacatactctatgagaaaagacaaacagaaatcacataattaactagagtagcatcatacctgcgatttacctaaacctgtaaataagattaaaataagcaccatattatctctcctctttttcacttacagtgctatgtaatagatatttttctacatttttatagcttttctcatagtaaatataaaaccgtgccatggtttgagagccattatagtatggtgattaaatgtgatattgtgggacaaagattctgacccaaaccttagctaaccacgtaatctacttatgctacgtaatcatggacagttgcttcatctttcttgatttccacattagtaaaatgatcataatagcaagtactctggaaggttgctagtagaatggacatgagaaaacacatgtttagtaatagtctttactccacagaatgtattcaacataaaaatgttatgattttttttcatatatcgttttaacactgaagcttttaagtgtccattaacagtgaacttaaaatattgaggtagacatttacatcaaattgagattgtcggatgtacattggtagaagaaattggtctagttacattttttaggctaaaaataactgctgacatttgtatattagactatcttgtgccataaaacggaagtttagaaaatttaggaaacaccttaccaaagtaggaaatttgatcaaactttgaaaggctttgaaagtccttggatatcctaggagaggataaattatgttccttggccaaatttggcctaagaataatttttaaatttttaacagtgaaagagagggaggagaaagagaacacagaataatatgcaacagaatcttatgtggcctacaaagtcaaaacatttattgtattactttgctaggacggccataacaatgtactacagactgggtggcttaaataacagaagtttattttcttacaattgaaaggttgcaagtctgaaatgaaggtgtcagcagggttgtatgcttctgaggcctcacttcttggcttgtagatgtccgtcttctccctgtgtcttcacacagtctttcctctgtgtaagtctgtgtccaaattccctcttcttaggataccagtcctattggatgagggcctactctaatgactccatttcaatttaattccctcattaatgaacccatctacaaatatagtcacattctgagatattggaggttaagtcttcaatatatgaaatttagggagacgcaattcaaaccacattttctgtctgtttttttgtttgtttgttttgtttgtttttacaaaaagtagttagcagcctgtgttctggaagcctgagaagggtacacctgacaagggaaccagtagtttcctagtgcctcctttactatttgtctgacattatatataaattgagagaatcactcaatttagagatttgctttcccattaccaatttgtttggcttattttacttagcataatgtcctccaggttcacccatattgtcataaatgaccaaatttctttcttttttaatgctgaatagtatttcattgtgtatatataccagattttctttatccattcattcaacgatggatacctaggttgcttccaaatcttaaaatttaaatatatctatctctatctgtctatatacttacagatctatctatagatagagatagatagatatagatatagatatagatatagatatagatatagatataggtccatctatagataggtagatagataatttgctgagggaaaaatgcctcagggaattagtggccaagccaaaccatttaattctaactttgggtcaaaggggcagggtttaatattatggaaatatttgcctggagttagccatggacagaagaagaaagtaggtgagcacaaatctgtgaccacaaaggaagtctgaaaatcaaagtaaataacagcaaactcaacatcggggtggacctggatgtggtgatgttatgacagaaacaacaataaccattaatattttttactgctttacaaggccatataatagtattttgtgacattttgtcatttgatccatatcaccaaatgaatatgatgattacctactgtctacttcccccaaccaccacacacacacacacacacacacacccctttacagattaggaaacacagctgaaattataacataggctttaatctccttaagcattgggtcaaaatatccaaaaataatacaagaacttcaataatctttttataaatgaagtcagatgcctaacatgtctcctcattggtgtgtaggcgggttgtaggtttaagactgggttggcactgtcaacagacactgtctctaaagaaaacaaaaacaaactcaaatggttcatcagcaagtacttgcttttgtgtccacattttgacctagctagaatatgctagatactttcctgtaaagcaccttcaaaacaattagttggtggctcccttttgtacacagataaattcaatataacacatgtctgcctttactttttgtgttaatatttggaaacgtacaaaattttgtttccaaaattttccaaatatcaatgtgtttccaaatatcaatacaaaaagtaaagacagacatgtgttatgttgaatttatttccccatataactcagaatcttaaggagtttttctgtatattttaaacttaatatgagatgcatctgaggaattcagatgtagaatttttcagtagtcttgagacccaataaaaacagtttctagcatagatactatttttgtaaagatttaaattcacagttaaggtcaacatctggctgaatttaacattcacatttgacagttttactctcattaaaaaatgtttagcattttttcaaagcagaagctgtcttttattttaataaaggtcttcatatatttgctttgttccttgagggatggattggtacgcttgaactactctgtgcagttagaatttaaggccatatcactagataatccacgtagcaaaataaaatgcaaatgaaaagggcaaagggcacggtataatgagcaagaggatttattgtcttgtcttctatttccatatcctttgggaaaatgtaaaagtgggaaatgaggaatagttctctctgctttctctggcaaattatggttgataatttagctattagataaccgtatagaatatgccaagtgatttcccaaactagtcacttttcaattttatctatgcgtaagtatccacaggttctttaattgcaaacagtactcacatgctcaatgcattatttttattactgaaactgcaaaatagacatgtgataatatacatttacacagccaaaacccccctccacacacacacacaaacacacacacaaacatcattaaagagtcaaattaatttcaactagaacatccttatgggaaaatatgtgagaaaatatatgcaaaaatatgtaccatttattgagcatatgcggtgcacaaactacgtatttattatttaattcatgtgatcccactcccaacaagaatctaaaatgtagataccactagtgccattatacatataatgagacagaggtgtatagagatcaattaaacaaactagcttaacggatttaaacttagtttgtcttatcaccaatcctattttctgtctactataacactttgacatgtgaaatatagttaaaggagaatttgaaaacaacttgatgaacagtctggaatcctctgtaaagataaattcaagtcattgactgaatataggatgtttcatacctataatgcacataagcagcaactaaagagtcaggcttcatttcctccctctgtgtgtaccaattagaggtcctgaaatattaataaactggctgatttaggagagaataccattacatttttttttgtcctacatgttgcttggaagcaacaaacatatcatgggcactcagtaaatgttatttaacgacaactaataaaatgaaattatggtaatatattttgtaatgaactcaccataagatgaggcaaagtaagttttagtactaaacctggaagttgagcagatttcaatggctgggtaggtgaatgaatcctatggggaggcaagagacactaacatgattgtggtagagaatgttaataagaggtcagatatataaaatttttattgcactttgacaattggagctgcccctcctgattttcatatatgttatattcatctaacattcaaaaggcaaattaaagaatatattgctaaacttctattctagctcctccatacccaaacatgaagtgactatttcattatccattggtatcatcattggtatgattttggaagaacatgaaatatgttccctgaaatgctttctttttttcctacttgtgcctcctttagcacattgtttgagattttcggaagagtcagttgtaatttttaaaaatagaaaagagagagagaggatgttaaatcactgtatcctctgaaagtcataagccatcgaattgtaaaactctaagacattcaggagtgtatgtagtttcagagagtgcacttctgtaggtttaaattagagctgtgagttattgggggagaaaccagactgggagcaatctcacttttttaatgctttaaagtgagtggagggaaaaggttccacaaaggagagaaagcttgccaaatggaggaatccgtagggaaattttaatttaaggccctgttcctcaattcctgtaaagttcatgaaaaaagaagtacttaaaagtctctttgaggactttatactcttttctcttttccatttttttgccttttacaatccctgtgaggaaaagagaaaatgcacttaaagttacgatttgggtgactcaatccttccctctttcctttgttctaatagtctttcaaatgctccaaagaaattagaatacacttaacaagtgctcttgtgaagcttagccaccacttcctctcttgagcctgtattaacccactgaagggaacacaaactctgtgttccagtccatacagcagcaggtacaccatgctccaggtcaaatatacaccatgctccaggtcaaatatacctgctattctaaccatttttatagtcatttttaacacagaaaaacagcaacaatatgatagatttcattgagcctattcacacaataataaaacattaaaaaaagctcaagagccctaatactacatgtttataagatcactgtgattactatatgcttcttttctattctacactcccattctctctctgatacagaacatacacacacacacctttaacttttcagaaacagacacggaagtcacctttgctgttctaagatatcataagtataatgggataaatttcagtttcgaataaggctttctcccattttatcggttctgttgatattcagaagtttttcagtttttagcattttgctttgctaaacatttcttgtacttctatgaaaggcattgaggttttcactaacagaacaaagttaaataataattttgtagcataattaactgaaactgtagcaatcaattttagtaaaatcctttcaaactcaaaaatagatatctgtaaggcaaacaattatatctacataatattatcaaaaagacttatactgaagtttctttaaattaaatactttcatcattcaaatatttatgtatcatacgcatccatgataccaaaataaatacaagcatttgagacaaagtttgtattttggaaaatataaataaaatactatgattgttttaaaagattcaaaaatacatatgggtaagtgagtttccaaagtacatatttttcttcattatatattgcagctacaaaaggaaaatcctcaagagaattaatatgaacttatgataatgcagcctgcagcacggttttgttgtgattttttctgtttttgctgacaatgcaattcaaactatattctactaatcttcagtaaagggagcagattatttcacctataaacatgcagcaataaagtgtcattcttcagtccatacagactacttaacatctttctctttttacaggtttggatccctagctcattagactattacctgataaagaagagagggtaatgaattgagaaaataactacgtaccttcagagaaaacctgcccgataacaataatccattagaaaactggcaatatcctctgatctattgcccgcaaagccatgacttgatggagagtttcattccctgggctcagttctccagaagaaaatcagcacaatttaaatatttcttggaatgtgacagctctctagatcccgggttgcattctgttccccagggatggcaatctggtgttcctgtgtgcatagagcagtgaagat

SEQ ID NO: 2019 - DNA, 345184 bp, Homo sapiens
tatcgggccgccggcgtccgggctccagaggccgcctggctgggcgcccggtgccttttgtctggcgcagggccggcgtttgcatcacatttcggatacctccctctctttttcgcctctccttctgcctcccgctcacatcgcctccccactcccgccaccgtcccccgccggactgctagcctcctagaccgaagcccgaggacgtctctgcccgagcgatgtcccctctccagaaagttgccgccgccgccgccgccgccgccactgccgccgctgggcggtgaaacaaagtctggcggggccgcctcccggtgcaggagcgcaccggtgcctagcggctggactccgctgccgggcgtcccgctttcccccggggagccctaaacgctccaggccatggccgagggcgcggccggcagggaggatccggcgccgcccgacgcggcggggggcgaagacgacccccgagtgggcccggatgccgccggggactgcgtgacggcggcctctgggggccggatgagggaccgtcgcagcggggtcgcactgccaggcgccgcggggaccccagcggacagcgaggcgggcctcctggaggcagcacgggcgaccccccggcgcagcagcatcatcaaggtaagcaaagccgcgccgcaccgggagcgtggctgtgggtgatgggtgggtcagggacccgggcaggatgtgcggtgtccggaggcatccgggctcagcattgttttctcccacctccttcaacgccaaaccttccttccttatccggaggttcccagactcagctgtcagccacgagacgcacaagtgactttttctccccactgacggcagaggaaaagttccgctctgcgtctttgcgttctgatggatgctttccctcattttctctgcaagcttcactaaaccgttgatggagggaggaagggagaactctggataaatgcagacccaccggatggttgtgcattgctttccaatgaagggttagcttttcccatacaatgaagaaaatgcacagcttactctcaagtgtaaaaaaagaatccctctagacttaaatgatcccgaaatcccaagatgtgtgaactttcccggtagggaggcagagttttaagtggaccctgcatcacagtaaagagcaatgcaagagcccagagtttttgcgctgcagaaagcacaaccggaaagcaatcaatcccccaagcattatcactggtccttgtggttaccaccacatccagggaaaacgcttcctgacccgctaatcacctcacagaatttctctccatccatttggcaaggaatttgtaaacctctttcctcccctttctctttccatcttccttccacttggggcttgtttcttctgttcgagatttcctcttttgggagcatgactttggggtaaggttatttaggaaagaaccctcgcacaggctctggaaaagggcctcagtgtaaatgcatgtgagtaatcaatcaaatgtatgtcagattaaaattgattttggtggagcagtcagtataaaacgatatgtatgtatgtatatatgtaagtatatatgtgtgtgtgtacatacacacacacacatccctcaatgacaatgaaagatggacttttacttactattgaatttattgggttcactaatatattcaaaagctctgttcagggttaagctgcgtaaccagtgcatcacgcatgttgcaagctcccagcaccagcttaggtagactaaccacagaatgtggctccagtaaagtctttttcccaacactgacacatggaagtttaaaatcagtggagaggtttctataatatataaagaagagtgggtggtaattacaaatggcttgtagtagtttctgttattttgtggctttttgattatgtaacaggagtgttctattctgggtgtgaatttggacaaagggaaattactattttgtttttaacccacaggtcagaaagcacactgttttcaaacttaaaaaacatcacaattaggaaacacatacattttggattctactgtattgatactacatggtgtcctgtgtgtgtaaaacaggcactgcaagagactttaaaatatatgacaataaagagcaaacggctctataatgttgtaaaaaacaaaagtaatggagtataaggaatatacaaattcttgcaactgagtttgccacttgtgaattgtactatgctggtttatattctcagaagggtcattgctgagtaatggtgcctcttttgttttgaagtttctttttgtgacaaaaaaggagggagacaacagaatattaacttgatttttcccctatttaatagtaaatgcaattaacatttggtaaatggcctttaaaattaaagatattagaaaataaagtgaattattatgttaggtttttattggaaaagtagcacatacatataatttaaaaaatcaaatgttgcaaaggagtgtgaaggaaagaccctcagacactccacattcccacttatgtagtccaccctcatagatgttaacactttcttatgtatgcttccaaaatattccatgcatgtgtaagcagatatatctatatgtgtctatgatgaactatagcagctcctgatttctacaaaaaaatctggctagagttttacaagtctcatagttttaagcatttttgaagcctagagggggtaatctggtaggtctttggtgggcagcagtcattggggtctgttcccagaggccttaacgcccttctaaggagaaaaaaaggcaggtggtaagctctgttccactccgtctctgagatcaagaacctttctggtgacattcttgaatctgctgccctgtggtttgttccctttagcatagtaaaaatgagtttccaaaaaaagtttagatcatataagaaatacatagcacatgttctatattgagagaaaatgcatttttcacagttttgccaagagatttttttttaaatttggcattgaaatgtacacaaagaagaaaagctttagtacattttaatcaaaatattaaatgctgttccaaatagctgtagtgcagtaataattgatattcataatgctgagccactgaaaggttgtgaatcatcaaatattaaattcttgtcagctcaatttaaggtattgtttcagaatagtgctatcctgacagaaaacagactgtcttgtatattaataaaaagaatgtttttagtaaatttgccctccataatttgtgaaaacatgtgtttagttgaaaaaacaattttcttctgagctgaggaaaacaatgacaacatttatctgtatgcatcttcagaaattctttctactgacattgtgtttcttccccacatataaccaatcctaggtttaaaaacgttcaatgtgagaattaaactaagtttttttaaaatctgtctactttttcctatatttttctgtgtgattgtttcaacagcattgacattgataaatgctgcatgttttttggtaagcgcattgttatataccacaataatgcaatagaatccattttaatttcttcttgatgacttgtggtttgaaatgacaagttggatacctgcagtattgataatctctaaaagttgtttactattctgcatttgaatatatttctaattaagaaataagaccatttatttatctggtatttgatatcaaacttatagcatttaaaatatttaacattttagattattgcttatagccctataatctgctgccctgtggtttgttccctttagcatagtaaaaatgagtttccaaaaaaagtctagatcatataagaaatacatagcaaatgttttatattgagagaaaatgcatttttcacagttttgccaagagtttttttaaatttggcattgaaatgtacacaaagaagaaaagctttagtacattttatattaatcaaaacattaaatgctgttccaaatagctgtagtgcagtaataattgtaatgttttggaaataggaagcagcatagcttatttactatattagttggtggaaactgagctacatgtgtattttaaaaatagcagttgatttttcttccattgtatgtgacacattgacgggttctactttttttcaacttccttttgttctacttaagaacaaattctctaggcaaggaagaatagaaattgtcacttggatctcatggacatgggtgtgggggatgaagatgggagttgggaatgaggtgttgagaccagcactggagcagctacttgggtgttgttcatgtctcattattttatatcatggcgagtctcactctctcatgtcatcttgggctggtatggtggatttttgaactgaagccttaaaggtgccccttgggtaccagtagacccctatcaagattatggctttcctcagagaggcaagaggaatgcagttcacattaagtgcctactactgtgagtcatatactaaactaggagctttcgtacgtttgtatcacttaaacctcacaggaaactctctaaagtatggaaggaaggcacagagagctactgttaaaatgtggagtgatgactgaaagtcatgtctgcttaatttcagagtttgtgctcttgggctggttctcagatgcaagaagtcccacaatccatcaacacttctaggtttgaaacagcccgaacacgtgagatagtgacagaagagtacgcatcttaggtcctatggtttgtggggtacattatcttttctcagccttctttccttcagttcagaacatttggaggttgattattctagaaagggattgcaacctcttctgtctttggctattttgttaggcctgtgctgtacttgaaaagacagagcaatctggcaggtgttctgcttggcgtcaatatatggagcttacatcctattgttttaccccaggcccactttccccatacccctgcagacagtggagtttgtgaagcattgtattctcttttaggctgatacgcaggcagaaaaaatacctgggtcataggaatatatataaatctaggggagtaaggaaatgggggaatcttcttttggagctctgaaagtgtgtgtgtgtgtgtgtgtgtgtgtgtgtgtttaaatagggacggttatgaagggaaattaaatgtgattaaaaattagttaaaaattttaggcactctatggattatataggcgtttgtagattgacccaggaattaatcagcatttatagattttattctctacaaatatgtgttaaaagttccgaataaccaacttatggatggattttggagaaataaccagaggagctggccagcctttactttaccgtaagggttgctgagagtgtgccctgggggcttcagctgcggctctcctcccgagatgtgatttggctgcatgaatggcatgaacctcttaggtagatttggtttatgatccccacaacttcagttagaatgttactttctctcaaattgccatagtaacatggtcacatttcaccttagaagtggttgcttcttattgcagggtctttctgatgtgatttcttatagcacctctcaagaaaatgaagaataaacttcaggtaaagagctttgtcttactttgatgaaaggtttttgaagtgtctgttgattagtgtttgctactattatcagaatttacaaagtttgttttcccttttggaaaatatattaaggctaaaaaaagtgtaagttaattacatagccattgaggggttaaacgtgcattgtgattgagactgaatagtgttttcccaacctttccctttttacaatggagaaaacaggtaattaaattttgtacagtaaaatgtcaattgaacatttattgccaaataacacctcaggcatagcagggcattatgaaaagatatcaggagacagccgaccttaccttggtgctactgaacaagcaattcattaactgcttctaggcaatgccacagcaaactaatcaggcagtggcccaggcagtaactcaatgaaggaattgcatcagtcttctttgcgccctcactcaattctgttcagctttaataactgtgaatattaaaaataactccacattcaggagcaatgtccaaactgagatgtgcttaacactgtatattttaaaaaactatccgactttagatgaccagacagagctaagaggcaggatctcagcaacagtaaatgagccattggttataagaaggagggagagaatcattgtgttggactttacattgaaatctaaggtaataaatcaataaactttattatagtgaaacctttcagttctgcaaaatcttagtgttttaataatgtaaaagaggtttatttgtagttttgttgactcttattcacctccctatctatcctagatcatctctgtattctagttcctgtaataggaaacaatagacagagtttatggtaattaatgattatactaaactgacaataactattagggccaaacggccaacttctgtaacaacaacattcggtcttacatattggcaaatgtattgtgtatttcagctaacttttaatggcaacaaaatcatagtatgacgaagtattggaatagtccattggatttaaaattggatttcatttgtagttttatctgtaacatcttttgtgaatataagagagagatataacctagtttattttcagcagtgccgtttaaactcatcttattaataatcaatctagcattactttgagaaaagtaggattgtacatggtgagtagaaaagaagcattgtttacattatcattatcacttcagaaagaaggcaagttaattttgaaaataataaaatctatcaaggcaaaacaacataaactattttagtgtgtctcgtttccatatatttcttaatttgtatttgtaaatttatgaaagtgtgtagctattataggcaaggttattgtgtttttccttaactatacatcttcatattcaaaagtttaaaatacctttgaaagataatatctgctttattaattcttatgctgacctttttcaagagcctttaatttttaacattttttacttcttttctcttgacttttaggttcagggggtgtacatgtgtaagtttgttccttgggtaaattgcatgttgctgaggtttggtgtatgaatgatcctgtgagctagtaagcatagtacccaatagttagtttttcaacccaagtaccctaacccaaccttccccttcgagtagtccccagtatttattgttcctctctttgtgttcatgtgtatttagtgtttagctaccacttacaagtgagaacatgtggtatttggttttctatttctgcattagttcacttaggataatggcctccagctgcatccatgttgctgcaaagcacatgattttgttccttcttatggctgtgtagtattccatagtgtatgcttcccacattttctttgtccagtccaccattggtgagatgattccatgtttttgctattgtgaagagtgctgtgatgaacatacaagtgcatgtgtctttttggtagagcgctgttggatatatacccagttgtgggattggttagtcaaatggtagttctgttttagtctctttgatgaatctccacactgctttccacagtgactgaactaatttacattaccaccagcagtgtataagtgttccattttctccacaacttcaccaacatttgttgttttttgacttcttaataatagccattctggtgtgagttagtatctcattgtgattttgatttacatttttctaatgattagtaatgatgagcattttaaaatatatttgttggctgcatgcatgtctttcaaaagccttttaaagatgctaagtatgtactaaacacagactaagcccaggcaatatgtataagcaggcaaacttgtattatttacacggtacaatatcacggttagaaatggtgggattgtgatgctactgagtatttagcaatcagagatactcaaattcagaacacctgctctgtgagacattctctgatgtgagggagatggatgcacaaatgaggcaaaaagagacaaaagaacactttagtgttatctgggaccaaaattacaatgtagaaccctagaaagctagacctgaccatgttgtaggcacttttccctaaggcccaaacgacttcaaacaaaagcaagccaaataacctgtatacttaaagcccacaccccacctcccagatctgacagccgatgatgagggtgcgcacaccttctagggtgtaatcaggggcacacgcattagggctagacaataaggagtcagagacatggtcagcagggggagagtatgtttcccctctaagcctcccttggctcaggctgggttaaggcctggttcaggaaaagggtaatggcatcagaagagtgatggccctgctcccctacaggtcagccctgattgttgggttggggaggagagagagaagaccatgctatgtgcactctgacctctctctcctttgaaagcttcctccccatataacataccccatcaatgtccttgaacttgcagtttcttaatcattgatggtgactaatgtttggaagtgggagtggggatggaggtgagggagttggagcctcatgctccccctagaggcgtatataaaagatgcaaagtcatcttcagcatttagtaaactccagctttgaaatattttggaagtattgatttcatatcataattaaatattatatatttagaaatgttattaatagtaagtagctttatttttatgtttaatctaatatataaaacacctagtaacatcttgaattggttttcctactgagcaattttctttataataatagcaaatactaatataatttgtatgatgagtctagcattgttttgagcattaacgtgtgtcaaataatttaattctcacaataaccatatgatatgcatattattattatctcgatttttacagatggagagatgttaagtgacttgcctaaggtcacatagctaataaacgcagagccaagaagtaggtccaaataatctagctccagaggttgcttttaatctttatgctatatgttcttatcctctaaaacagtattgatttgaagcttagctggtgtggataaaatagcagattttttattgttatcttaaacactaagttcagctgacaaatcaaaaaccaatttttaaaacagttttgggaaactcaaggattacttgaatatacattttttctcagtttcatagccttcctttcacataaaatacctataactttactttaatattgcattccattttcccttgagaggagtggggctcctagtagtacaagcaaacttcacattatcacactttgctttgttgtactttgcagatattgcatttttttaaacaaatagaagatttgtggcaaccctgtgttaagcaagtctactggtggcatttcgtgtctcattttggcatcgtgtgctcactttgtgtctctgtgtcacattttggtaattcttacaagatttttaactttttcattgttattatatctattatggtgatctgtgatcagtaatctttgatgttactattgtaattgttttggagtgccatgaactatgcccatataatacagcgaacttaattgataaatgtgtgtgttctgactgctccactgacctgccgttgtcagtgtctttccctctccttgggcctcctactctttgagacacaacaatattgaaattagttcagttaataaccctataatggcctctaaatgttcaagtgaaagaaaaagtttcacatctctcactttaaatcagaagctagaaatgattaagcttagtaaggaaggcatgtctaaagctgagataggctgaaaggtaggccttttttgtcagttagccaagttgtgaatgtaaggaaaagtgcttgaaggaaattaaaagtgctactccaggaagcatatgaatgataagaaagcaaaaacagccttgttgctgatatgaagaaagttttagcgatctggatggaagatcaaaccagccataacatttccttaagccaaagtctaattcagagcaagatcctaactctcttcaattctgtgaaggctgataggggcgaggaagctgtggaagaaaagttggaagctagcagaggttggtttatgaggtttaaggaaggaagctatctctataatgtaaaattgcaaggtgaagcagcaagtgctgatgtagaagctacagcaagttctccaggaaatctagcagagattatcgatgaagccggctacactaaaaaacctcaaattagaagaaggtgtcatctaggacttttatagctacagcagtgaaatcaatgcctggcttcaaatcttcaaaggacaggctaactctcttgcctggggtaatgcatctggtaactttaagtggaagccaatgctcaattaccattctgaaaatcctagggtctttatgaattatgccaaatctactctgtgccctatgaatggaacaacaaagcctggatgacagcacatatgtttatagcatgatatactaaatattttaagcccactgttgaaacctactgctcagaaaaaaacattcctttcagaatattactgcttgtggacaatgcacctggtcacctaagagctctgatggaaatgtagaggagattaatgttttcatcctgttaacataagatccattctgcagcctatggatcaaggagaaattttgactttcaggtattattatttaagaaatacatttcataaggctatagttgctatagatagtgattcatctgttggatctgggcaatgtaaattgaaacctggaaaggattcaccattccaggtaccattaagaacattcatgattcatggaaggaggtaaaaatatcaacattagcaggaatttggaagaagttgattccaacctcatggatgactttgaaaggttcaggacttcggtgggggaagtcactgtagacggggtggaaatagcaagagaactagaattagaagtggagcctgaagatgtgactgaattgcttccatttcatgataaaaattgaatggatgaggagttgcttcttatgtatgagcaaagaaattggtttcttgagatggattttactccttgtgaagatgttctgagcattgaaatgacaacaaaagatttagaatattacataaacctatttgataaagcagcagcagggttcaagagagtgggctcctattttaaaagaggttagttgtgagtaaaatgctatcaaacagcattgtatgctacagatacatttttcactaaagagtcaataaatgtggcaaacttcacttttatcttattttaagaaattgccacagccacccaaaccttcagcaaccaccaccctgatcagtcaccagtgttcaaaatggaggcaaggccctccagcagcaaaaagattatgactggctgaaggctcataatcattatgattatggctaatgatcattagcattttttagcaataaggtattttaagattaaggttatatacattgtgcttttagatgtaatgctatagcacatttaatagactactgtatagtgtaaacataacttttatatgcatgggaaacaaaaaaatttgtgtgacttgctttattgcaatatttgcttaattgtgatggtccagaattgaatttacaatatctctgaggtatgcctgtttatttttattctttgactgaagttatcttctttaccatgaagcaagagtttatggtccaactttggtataaattatataggctaaggatggaccattacttaattattgtaatctgttatgaattattttatattttgatagatttgtctcccagtgtcaataaataaataaataaataaaataaagagcatttaagtttccagtccaaggaagttgtaacttttgtttagtggtaggagagatgatgctatatggtcaagatttcctcctaattagctttgaggcagatatagtgccttacatgtaggaggaacatgtttaatatttgttaaattccattaaactgaaattctgtctgatcaattaatttcttatttttggtagaaattgcaaagtcaatatgtgggaaattcaaatatatgattgtgtcatgaaattgtgcccttgtggatgctttattgtgttaaaggtaatgaatccattctgctgtgcagagatttagtgtcatggccaaatggtacccataagtttgtccccataacttggagactgcctagtgttaaaggtacagtaagctttcttttgtatgtcagttttaattatctatctgaagttatgttaaattattgaaaggtacaggtctttggctctctctctagtattacagcacttatgcaataaagtatttggtcacattctcttaaagtgattttttttttcttgtccaaaaagaaagggttctcccaagcatttgaaacctaaaaaactttttttcctcatactttctcatgtttatttagtgtgggaacaagctagttttgtgataaatgaactgatgtttctatgtgcgtgtgcgtgtgcacgtgtgtgtgtgtgtgtatacttacgccaggcatattggaagtcagaagtctcaacaggaggtaacatttattttattttttttagtagagatgggggttttgctgtgtttcccaggctagatttgaactcctgggcttaagggatcctctcacctcaaactcccaagtagctggaactataggcctgtgtccccatgcctggtttaggtaaccttttgatccccagttttctttcctgcaactgggaagatggtctttatccagagacatcgtcatcaaagtaagaactgcataggttgtgagaagtcacactcagaaatgttagctgttaagcttgaccagtagttgaggtttctgaaaggagtgaagagaaagagagggatcaagatgtgctagaggggaatggagtcagatgggaccatgcttataaatgggctgagtaaatgccttgacaaatgtctttacttgaatcattctgccagaagttgtacattttggaatttatttattttttttaattttgatggtctttggtttttttggagaacttttaaccgatgggcacctgacaccttaacacacttagcagtgatcgttggacccaaagctcttttgagtctgaagattcctgagaagaatcaagggaggactgttctgggttgtcgatagtgatgattggcgttaaaagtaagctttgtctacttggctattttgctaaccccagctctaggaaagtccagggagattcttcatggtggcaccttcagtatgatagatttaccaatagggagaaatgacctgacaaacaaatcattgtagaagttggtgtactaggatggaagtagttgtgagtgctggaattagccaccactcctttaaaaaaggctctaaatattcacatactcaggcaaccatgaccgtcccttccttactaagaagctggcttcactacctccactaccttcactatttcttttgcccaaacccttttccccaggctgagtaagggaatgactggaagggacaaagtagacttggaggttggggcggggggtgtttgtggttcctgaagacagcctattccttccacttacctcattgtaaggtgaagagataatgaccctttctgaggttgagaaaggactcaagtgatgattcttttttgtttgcttgttttgagatggtgtctcactatattgcccaggttgaacttgaacttctggcttcaaacaatcctcctgattcagccttctcagtagctgggactacagcacatgccactgcacctggccaagagataactcttaagtgtaagattggactggtaatggtggcggcatttaactgtctccttctccaccaaatctccccataagttcagactggtgtctttctgtctcttcttgaaagacactgagttactggaccatcagagcccctgatgctctcctgtttgtggagaaagaggacactgtagaagacatccagtcctcttgctgctgccccacccaaagaggtttcttgggtgaagagactctggtaacaaaaggctgggacaggggctggtgagggatgggagggaaaaggtcaatgttcatgccaaatctcccacaccaggataataaatgtgtggggaagaagggcactatagggaataagcaacttcatagagagtcagcctttggatgcctgcctcacagagagaaccagtggtcagttcagtgttaatttgaggagtagagaaaaccaacccagtggggcctgcaacatccctatgaggccatcctatggagagacctcggcttcatttcatcctccagcttaagactagaaaggaagtgtagcagggaagagaaagggagaagtgggtagagtagacccacccccagccctagccactaaatccaccattctagcttgccgtgggggctgcaaagtagagaagaccttgaattaaacatgacattgaaattttaaagtgagcaagactgagtaaggactcaaaagaacccttctgataatggaaacagaatgaaacactatggaatctgagtaagctatcagtaataactggagtatagagaaacagagaggatctgagaatgagcagttagggaaaaaaatatatgtttataccacaacttgagactgcttacttattcaattacattgttatagaattggagggctgaatgggagcttagagaccattttccaattctaccctttcattttactaagccggctgtctactatcactcccattctttcagagaatcattaaaatgagattatttgtgataattagataatgtaattagaattgtttatgataccagggataggtagtggaggtttctttcaagcgttcatgttatagaataataatgagcacaccattgtcaagatcttacaatatcttcaattcttacaacagtctgggaagacatgtagctatcattatcacttccaccttagagatgaggaagccaaggctcactattatgcatgtgtgtgtgtgtgtgtgtgtgtgtgtgtgtgtgtgtatgtagtagggttgggggaaggtatacttttactcttcattttcttttgtcttccaaacctgcaacctgaaaaaacgaacaatgatttcagaatatattcatctggctggaatggagctgagcagaaaaacaaaagttaaggtagttaaaccctggattgttttgcaataaaagcaaccaccgtttattgagttaggtgcatatatgttatttcatttaagttggaagtaggaaggatctaagaaaaagcaatggatctgaagtagttgttttggcacaactcctagggctgggttttgggcttctgactcttcaaaacttacatgtcagcaaccccaagtattagtttcttgttgctgctgtaataagttgctacaaacttagtggcttaaaacagcacagatttattatcttatagttctagagtcatttattgtgttcctctgtgcattgtcagtgtaatggggtatgtatgccagcctgtatggcagtgtaagatattaaaataagaacaaagcccagttttcttagcactgcttgtatcaaagtgtgatttccatataagctcacatcatagggaatcagttgcaatctggtttcatggataacaagaccaggttatggaatatttttcattgcatgaagcctgttaaaagccagaagagaaaagcaatactttctgctgacattgggatcaactgagaatgtggtgggcttagtggtattaaataagataaaaagttgaaatcaaaatttaaaactgtctagatgtagatattagatatttatttacataaaatgaaaattctgaagtggatatttttgctgttctgaacttcttcaagaaaaatctggagaaagcaaaactgtgatttaagttctttacccactgtgcctaataccttactatcttttaaagaatttgcttttttacaagctacagaaacattgctctgaagcttcgtatggacattaaagcttaactgtgtttatctgattatgtttgaagcctttctgtattcttattaatggtttcaattttgatatttaggtcttacatttgaaaatggcttaagcattttaaagatcaagtagatgattaaggtagattatttgtcttgtccctgtaaggatcacggtgctataacccacaaggactgtctttgtagttttcttcaagttctcttttttccccctatcatttgggtcttttcctttataaaccattctgtttttcagtgttcaggaagtatatcactggtggtggtactcagccctccaaagtattgtttgctttagatagttggcttgatctacatctgaacttaaaatttcactataaaaatcttttttaaaggaggaatttagctgagaatatttatacatgaacttctgagcttttgaagtgaagaggtccactctccatatttataaatactttcatctgatgggaggctatgtcgctctgacaaagagatccctgcacatagtggctcaaacaagatagtttatttctttaataagcaacactaagcaggttattacaaatcaggtaggtgtctctgctccgtaaagtaattcagggatccagattttttgctcttctttttgggccaccccttaagatgttggcttgtccctttgatgaaaatggcctatcaccacatttgccttctatttcataagaagggggatgaggaaagtggagagcaattagtttctttttaaggaagtgacccataagtttcacatgccacttctgttcatatcccactggcccattggcccagtggtcatatggccatacccagctgcaaagaaggctggaaaatgtagtctttatcaggatggccatgtgcttaggtagagattaggagattctattggtaaaatgaacaagaggagactgtaagtttttgttaaggttaaaacagttagtcgtgggatatattcttaatttggagaagggaccaaagtgttttgtaataggagggaatcagacattattctgttttggggttcacattgtttaacctggttaggaaaattgaccagaacacggctcatgtgctactagggtctgtctgtatgagccagttggcttcaaaatgatgtctcacagacatggactgcactttttatcctgactttcaaatgtataccatatgtgaatcatagataaactccaagcaagaacaacttaggatgccttgagtaactgttgtgtgccacatgctgtctgaaagatcctgtggtgaacttttaggagagcctttggaggtcattttgcagttaaccacactagggcaggaacccttctagatgtgcagaatttgcttccagtcagcagggagttgcctcccttactagggagccaatttcattttcagtctgcttttgtcgtttgaaaaaattcttacgttgagcccaaatcaagttattctctgacactttccttaggcagtcctatttctaccttcaggagctataaagagtaagtttaagttctcacatgacagctcttgacatatttgaagggagttacgtgggtgtctcctcccacactcccactataataaataacccctgacatttattgggtgcttaccatgttccagacactgttctaagcactttatgtgtattaactcttaccaattcttactagtcttatgaagtagggactgtctaccccatttcatggatgaggaagttgcagcacagacaggttaagtatttgcccagattcacacagtaagtggcatgttctgatttgtcagtgtttcatttgaaatggtgttcctaggcctcaacactggttgctatgccagatgcactgtggtccactgtagtgggctgttttaccttccttcttttggatcctgtatttctacaaatgtaaccatcaggagaattgtttttctggaaaaaaatacatattccattgaccacagttcagcaaagttgtctttatattaagacactatgctcctgaatttgagaggatatgatgagttcaccaaaggtaggcttgatatggcagctggattcaatttaatatgatgtataaagccgttgtacttttcttcaatagggaagcaattataggtaaaaatcataggtaaaaaatcagttaaaaatgattttctatttttccttttaagagatgggctctccaggctggtcttgaactcctgggctcaagtgatcctcccatcttggcctcccaaagtggtgggattacaggcatgtaccactgcccccagcttaaagataattttcttaataactatgtgaaacagtagaaataaattagggattaggagaatggctagaagtttctagaattaagtgctagatctaagaggtggtatagcactaccattaaaaggccctagaattggactgccagaattggaatactgattgtctctctctatatatatatatgtggttggtggtttttgggaggatttaaatgagagaattcatgtagagtgcttacctaaatggttgatacaaggtagatagtcaatgaatgttaattattattatttggaaataggaaaataaaatctgaggctagttttgaaagaattgtcaggacttctcagatatgaagaaataaagaaatagtaattcttaagactttgatcatagagggctttgaataaaatggtatgtttgagtcatggagcaaaccttgtcttttggctgccatatctaaccaggttggagttgtgatggtcatctttctggtagatggggcagttccagtgtctctgttcatattggtcatcattgattttctctaatttcttgcagtattacaaagaaaaatgcccagaaactttgatttgagttgatatagtaagtagttacttgttttacgcttcaaatttcttccaaaaaagttctgtaaaccactcctcagtatgtataattgtcactctctctgttctttcttgacaaacaaaagcacaatttttacgaaagggtcaagtttgtttaaaagtggtctccactttcctcaaattctagagtaaaagaatgagctatatatgaatttagcatagctcaatttaattcagcaaatgatttttaagtacttacagaatttgacactatattgtgtccttggttttgatatatttgtgtccttggttttggtcattcttttatctaaaatttcatattaatgaacaatatataatggttttttttccttgcttcaagttgattgaaattttagaaaagtcctcataattctcatcttgacacaaactcagacttaagagacacctaaaactctgtgaaggcatctgttagaataactttcttaacttgtccaaactgattgcaccttacaattcaatgacatctttgaattttgctttttactgagcaaaagtcctgttacagctgatgacttcatactccttttttttttcaccctggaattatggccattttggtaaaatttgtgctatatgcaaaacgtgaatgaaaacttaagtatttaaaaaatcagtctgtaatccaaacactttggggagctgaggtgggagcatcactttagcccaggacctcaagagcagcctgggaaacatagtgagaccccatctgtacaaaaaatacaaaaattagccaggtgtggtggtgcatgcctatagctccatttactctggaggctgagatgggaggattgcttgagctcaggaggttgaggctgcagtgagctatgattgtgccactgcactccagcccgggcaacagagcgagaccctgtctcaaaaaaaaaaaaaaaaaaaaaacatgtctgactcctactcagatattcagcttgtttgtttatgagtctgtctttcttgttagactgtaaattccttaaaagccagaactctttcgagctgttcagttttgtggtccaaaacgatgctctgtaaaggcaggggccttaaataagtaatgactggtcttaaaataaaaccttaaaattaaggaaaggggtgaaccataaaattggcagctattactcattttattataagtaataatttggttaaggaagcaatattgccttttttttctgcaggttttttgaccaagcatgctgaaaatcagaggtgtctctggttttttgccttaggtgtttgtcacctgccaggttctcgtgggtaagacacaagtcagtgggtggaggaggatataatgaatataacatttttctgcttctttctttatacctattagatttaaacatagctttctttatgaaagcattctgaaagaattggaattttggctgtaatctttgtgcaagccaatcatggattcactctgaaattcagctgctgtatgacactggacccagtcctagtaccacagtaaaatggagccagtgttcctggaagttttaaggctacaagctctttcagtagaaggcataggcagtattcttttagctaatcagctataaccttgattttcacaaggatgatataagttagaaactatcctataaacagtgggaaattacagtgtctcctaccaattccatgaagaaagggaccacattttagacttttcttgcatcttctgtagctcctactaagtgctaagcatgtacttgatttatctcccatctctcacccaaactaaaccaagacaactcattctcttctaccttccttaagggaatcttgccctgagttaatgtagtctaccattgctaggttcgctttccttaacaggaacttaagtctttgagagacagcgtgggcaggtaagaggacacagatttgagaatttgatctgggatcctggaatctcatttttgctactttctaactgtgtgatcataaaatttttcctgagcctcagtttcttcattggtaaaatgggaattttaatgcctatcccacaagtttgccataaggcttgcaggtgaataatgcaatatatctgttatatattttagaaatattttaggctgtgcctaaaaaaatggacttgacaatccatttatctagcagttcctctaataaagacactgtccattggctactaatgaaaagtcggtaattcactacataattttacgacagggtctatatactttcctagcagttgtacctgccagtatttccttctcggaggcttttcactgagcctcacaacagcagtggactggtgtatgagaagcagtcctatcggctgccgctatctcttaatcaaaccatgtatgacatgtatttagtcagactacccatctgctatcttgagatacctcgttcacaatagcataagtgaatgtttgtgaatatggaccacatctggcatgggtggcctatcatctacctacgcttcatcctgtgagatacaactaaaatgaaaacaatgttctttaggtgattatatataaaggaatttcttaattctgatagattttgactctttccttcaaatattgaaaattgagttgatatataattgatttatatgtgaagatgaggaagaatgtggaccttttctcttactatttaatgttttatgttaaatctttaaatgtatgcttaatatctctgttgtggatccaaggccattgaaatttaactctactaacagcctttttggcaatgctaatcaattctttttacactataatacatttggcaaagttacttttaatgaccgattcgttcattcatctgttcattgatgcttctagcattcatgacaagactatatttgcaatatagagattcgaaggtgaggcagacatgcacaatacccaatgtattaaaactgtaagcccaaatagaatataggtgctgtaacagaagtatagtatagagctgagctccaagccaggtgcttaaaaatgtttattgaatgagtgaatatacctaggcctggatatctgtttgctggatatttccaagttcctagatttttccttctcgtttttcatctcatgaatagcaccactatcctcagttgcccttgctagcaatctggatgtcatctttgtctcctttttcccctcttctatcatatccaatgtatcaccatgttttcttgggtctacctactaaatagttctcactgctacactagttcaggccactagcttggcctgtatcattgtggcatcttcccacatggtagttctgcctccagccattttcttttgcctgattaattctccagagtagtagctagagtattatttctaaatggcaaatccaactgcatcattttcttccttaaaagtttttgatgacttctcattgtcctaggaataatgtgcaaatccctttacgtgggtcaggaggcccagtgcaatgtggagcccgctttttcttccagttccaattcctaccacttcctacttctcacattccagtttatgagatgacactgtgtgtatatatgcatataaatatatatgtgtatatatatatataggcatagtgccctgctcatagttgctcaatatatgttggctattcttatttttctaaatgtgctttcttcgaaactggcacagctgggaaaaatgtttttaggagcattaaacaagggagattggaagagagagaagctcagagtcgacaagaggatataatctaggtgttgtcaacaaagtggatatcatgataaaggttaaaaaataaatccattcaacttttgaaaaacgtatttttgggttggttttgaaaaataattcagtgtagcattaaaaaagtactctgttggatcttaaatttatcatttcctgagattatgatctagtttagaaaagttgccagatattcgctcttcaagatttacattgttttccaaagtcccccaaatggtcatagcactgttgttaagtgttcagttggctacagaatttccttaaattgtgatttttagtcaatggaatatgatgactcacagggaatgtaactgttttctgttttagcttactgatctttatcttaacatggtcaagagtctatgtttctattactctcacagattagcaaatatgttttttataagacatgaaataaaatatcattttgctaactttttattgtctagtattacaaatactgttgataacttgagattgaatcatttaggtcatgttttagagatgaatagaaaaaagtttgttattatagtttttctttttctttttataatttgggttggaagattcattttcattagtttggagtaaatagatcttttgtaaatatcagtatttcactggtgtttatattaattatgttttatttgataaaaccatttgcaagaggttggttggttcacgggataactgttgtcaaattgctttgaaatagtataaatgccacatagaaaacttatattattgagacgttttgatgatcaaaattacctttgagttcaaaacttgttttactaacagtaaaaagcacaaaacattttatttaatgtctttgtgattttaaattgtagtcaaagttttgattttttgctaattcatatatctatattagattacagaattgttatttaacataggatttaaaaattcttatgcttggattattataatttaacaatcaagtgtggcttttgaaaaaatattcaataatgctaattttgaagtttagaacaaatcttttaaaacttatacctttgcaatgtcaaaggaaattttgtaaaagtatccatatagtgatgtgaaatatgcttatgtgggcagaaacttgattgctgagatcaattttataattgtatacataaatccataatcgaatattccagtcattgccatttgggtaaaagcaaatactaaaagctgttatgtccccttaggaaacatatcaagaacagattgaaacagaatgtctttaactgtcttaaaacaattccataaatggttaccactttaactcaaaagttaggaatcctcttgaatccattgcagttctttacacaggctgccagctgattgtgtaattacatgccatatagcacaaagcatgatttatgacactattgttatggtgtgctcactaaaaataatgaaaaatagtaagtatagtattagcagagttgctgtaggtggttgccagacaaaatgcaaggcatgcagtcaaatttgcattccagataaacagtacataagtttttagtacaatttaggcaaaattatttattgtttatttaaaattcaaatttaagtgagcatcctgtgtttttatttgttaaatctggcaaccctagctgtatgtgattgggtagactataggtaatagtaaagaaacagatttttctaatgaaacagaatttcttccctaagttcctccagaatcaaataaagaatatcttggttacccagctagtaaatcatatttgaagctagtacgtgaacttagagagctagctttaagagccgtgccctatcaccacctctcatattggtgtttgtgaaattaaaagtaattcaattgcaacattacacactatttcatactgtattatgttgaatttatgcatcgttaaaattattaaaatccatttttaaattttatgttaagaaattaacttatttaataaattaattttcttctttttaaaagaggcatttttgatgagaattttcaaaaaacatgtagatttttgctgttctattataagtagtattcattagtttcaccaaatgtttttgtttgctttatgattaatagtgatttgcctttcattttcttgttaaggctgaattactgtgtttgtgctatgcaactgggaagcagccatagtttggagtggcacattgctctggttgtttctttagcttggctggccttggtctcttctgctgtagccatcagtcatccagtgctctttgcatgctatgggacatattttttcccatgagtgacagtggttgccttttatgacttagccctcattaataattaggcagggattacatatgaaatcttgtaataattcatgatctacatttactcatttacaagtataaataaatgaaatctaacagtcacaaaataccttgaaactggaacctcttaaatataaagatgaaaacatcacatcgtaagccccattagttaaaaatatgcttttgagaatggttaaaatgacttagctgaaaattccaaaaaccagaatgccccttctcctccaaaggatcacaactcctggccagcaagggaacaaaactggatggagaatgagtttgacgaattcacagaagtaagcttcagaaggtgggtaataacaaactccttcaagctaaaggagcatgttctaacccaatggaaggaagctaggaaccttgaaaaaaggttagagggattgctaactagaataaccagtttagagaagaacataaatgaactgatggagctgaaaaagacagcacgagaacttcgtgaaacatacaaaagtatcactagccgaatcgatcaagcagaagaaaggatatcagagattgcagatcgacttaactaaataaagtgtgaagacaaaattagagaaaaaagaatgaaaaggaatgaacaaagcctccaagaaatatgggactatgtgaaaaggccaaacctatatttgattggtgtacctgaaagagatggggaggatggaaccaagttggaaaacacttttcaggatattatccaggagaacttccccaacctagcaagacaggccaacattcaaattcatgaaatacagagaataccacaaagatacacctcgagaagagcaaccccaagacacataatcatcagattcaccaaggttgaaatgaaggaaaaaatgttaagggcagatagagagaaagatcgggttacccacaaagggaagcccatcagactaacagaggatctctctgcagaaaccatgcaagccagaagagagtgagggctgatattcaacattcttaaagaattttcaacccagaatttcatatccagccaaactaagcttcataaatgaaggagaaataaaatcctttacagacaagcaaatgctgagagactttgtcaccaccaggcctgccttactagagctcctgaaggaagcagtaaatacggaaaggaaaaaccagtaccagccactgcaaaaacatgccaagttgtaaagaccattgacactataaggaaactgcatcaactaatgggcaaaataaccagctagcatcataatgacaggatcaatttcacacaaaacaatattaactttaaatttaaatggcctaaataccccaattaaaagacacagattggcaaattggacccatcagtcaagacccatcagtgtgctgtattcaggagacccatctcacatgcaaagacgcacataagctcaaaataaagagatggaggaatatttaccaaccaaatggaaaggaaaaaaaaagcaggggtggcaatcctagtctctgataaaacagactttaaaccaacaaggatcaaaaaagacaaagaagggcattatataatggtaaagggatcaatgcaacaagaagagctaactatcctaaatatatatgcacccaatacaggagcacccagattcataaagcaggttcttagagacctacacagagacttagactcccacacaataatagtaggagactttaacaccccactgtccatattcaacagatcaacgagacagaaaattaacaaatatattcaggacttgaactcagctctggaccaagcagccctaatagacatctacagaactctccaccccaaatcaacagaatatacattcttctcagcaccacatagcacttattctaaatttgcccacataattggaaataaaactcctgagaaaatgctaaagaacggaaataataagaaacagtcacgcagaccacagtgcaatcaaattagaactcatgattaagaaactcagaaccgcactacatggaaactgaacaacctgaatgactactgggtaaataacaaaattaaggcagaaataaataagttctttgaaaccaatgagaacaaagacacaatgtaccagaatcgctgggacacagctaaagcagtgtttagagggaaacttatagcactaaatgctcacaggagaaagtggggaagatctaaaatcgacaccccagcatcacgattaaaagaactagagaagcaagatcaaacaaatttgaaaactagcagaagacaagaaaaactaagatcagagcagaactgaaggagatagagccacaaaaaacccttcaaaaaatcaatgaatccaagaactgtttttttgaaaagattaacaaaatagatagatggctagccagactaataaagaagaaaagagagaagaatcaaatagacacaataaaaaatggtaaaggggagatcaccaccgatcccacagaaatacgaactaccataagagaatactataaacacctctacgcaaataaactagaaattctagaagaaatacgtaaattcctgaacacatacacccttccaagactaaaccaggaagaagtcaaattcctgaatagaccaataagttctgaaattgaggcagtaattaataacctaccaaccaaaaaaagcctagcaccagacagattcacagccaaattctaccagagatacaaagaggagttggtaccattccttctgaaactattccaaacaatagaaaaagagggactcctccctaactcattttatgaggccagcaacatcctgataccaaaacctggcagagacaaaacaataaaagaaaatttcaggccagtatacctgatgaacatcaatgcgaaaatcctcaataaaatactggcaaaccaaatccagcagcacatcaaaaagcttatccaccacaatcaagtcagcttcatccttgggatgcaaggctggttcaacatacacaaatcaataaatgtaatccatcacataaacagaatcaatgacaaaaaacacatgattatctcaatagatgcagaaaaggccttcgataaaatttggccaggtgcggtggctcacgcctgtgatcccagcactttgggaggccaaggccggcagatcatgaggtcaggagtgaaaccttgtccttaataaggatacaaaaattagctaggcatggtgacatgtgcctggaatcccagctactcaggaggctgaggcagagaatcacttgagcccgggaggcagcttcaggctaaaaactctcaataaggtaggtattgatggaacatatctcaaaatagtacgagctatttatgacaaacccatagccaatatcatactgaatgggtaaaagctgtaagcattccatctgaaaatcggcacaagacaaggatgccctctctcaccactcctattcaacataggaagttctggccagggcaatcaggcaagagaaataaataaagatattcaaatagaaagacaggacatcaagttgtctctgtttgcagatggcatgattgtatatttagaaaaccccatcttctctgcccaggatctccttaacctgctaagcaacctcagcagtctacggatacaaaatcaatgtgcaaaaaatcacaagcattcccatacaccaataatagacaaacagagagccaaatcatgagtgaactcccattcacaactgctacaaaaagaataaaatacacaggaatacaacttacaagggatgtgaaggacctcttcaaggaggactacaaggaaataagagaggacacaaacaagtggaaaaacattccatgctcatggataggaagaatcaatatagtgaaaatggccatactgcccaaagtaatttatagattcagtgctattcctatcaagttaccattgactttcttcacagaattagaaaaaactggttcaaatttcatatggaaccaaaaaagagctggtatagccaagacaatccccagcaaaaagaacaaagctggaggcatcatgctacctgacttcaaactgtactacaaggccacagtaaccaaaacagcatggtactggtaccaaaacagatatatagatcagtggaacagaacagaggcctcagaaataatgccacacatctacagccatctgatctttgacaaacctgacaaaaacaagcagtggggtaagattccctatttaataaatggtgttgggaaaactggctcgccatatgcagaaaactgaaactggaccccttccttaaaccttatgcaaaatttaactcaagatggattaaagagttaaacataatacctaaaaccataaaaaacctaggcaataccatttaggacatgggcatgggcacagacttcatgactaaaacaccaaaacaatggcaacaaaagccaaaattgacaaatgggatctaattaaactaaagagcttctgcacatcaaaagaaactgtcatcagagtgaacaggcaacctacagaatgggagaaaatttttgccatgtagccatctgacaaagggctaatatccagaatctacaaagagcttaaacaaatttacaagaaaaaaacaaccccatcaaaaagtgggtgacagatatgaacagacacttctcaaaagaagacatttatgtggccaacaaacatacgaataaaagcctgtcatcactggtcattaaagaattgcaaatcaaaaccacaatgagataccatctcacgccagttagaatggcgatcattaaaaagtcaggaaacaacacatgctgcagaggatatggagaaataggaacgcttgtacactgttggtgggagtgtaaattagttcaaccattgtggaagacagtgtggcaattcctcaaggatctagagccagaaataccatttgacccagcaatcccattactgggtatatacccaaaggattgtaaatcattctactgtaaagacacatgcacacgtatgtttattgcagcactattcacaatagcaaagacgtggaactaacccaaatgtccatcaatgatagactggatcaagaaaatgtggcacatgtataccatggaatactatgtagccataaaaaaggatgagttcatgtcctttgtagagacatggatgaagctggaaaccatcattctcagcaaagtaatgcaggaacagaaaaccaaacaccacatggtctcactcataagtgtgagttgaacaatgagaacacatggacacagggaggggaacatcacacaatggtatgtcaggggtgggagcctaggagagggatagcattaggagaaatacctaatgtagatgacgggttgatgggtgctgcaaaccaccatggcatgtgtgtaactatgtaacaaactgcacattctgctcatgtatcctagaacataaagtataataaaaaaaccatagtgttaaaatgtgcataacagaaatttttaccattttaaccatttttaagtagatagttttgtgacatttagtatattcacattgttatattcccagtatacaggtccataacattttcgtcatcccaaactgaccctgccaattactcctcatattccacccctccccattcctggcaaccatcgttatactttctgtctctatgagtttgcaaaggccatgtttaatagtgccaaaacttgatatccactattaataggagcagcatgatatggtaggaaaaattttggactggagccaaacgctttctgtcatatttagtttgtaatctgggccaaactgtttgatttctctgagactctgtttcttcgcctctaaaatgggactagcaatttactgtgatgttgtgagaattacatgagacaacgtatgtaaatcatcaggctcataataggcatttaataaatgatattagaaatatagaatgttctcaaagtattcttattttattttatttttgttcttaaaatattaactcatttttttcagtcggacaattttttaatgacttctgcaggagccggtgagactactacagtgtaatgatagtatgtcattgtgaattcaaatctacctatttcccaggttggtccatggtatgttacaaatgaattttttttccttggagagtagaaatcacaagtcgttgcattttataaactgaagttttaaacaatgttttgctatatctatagaaataaatttttttggctgttgccagtagaaagcaaagtaatgatttaactcatgaattttatttttggccagtttttaaatcatcctctaattttcctattaaaattattttgtttgtaaaaaatccttacctttactttgggaggccgaggcgggcggatcacgaggtcaggagatccagaccatcccggctaaaacggtgaaaccccgtctctactaaaaaaatacaaaaaattagccgggcgtagtggtgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaatccttaccttttgttcaattcactgtctgtcacttccgtcttagaatatatagaataaataaaaggagatttaacttaagcttgctaaatttttgttagctctgttaaaacaggtcttctgtattccaggagtcaaagagtatttaaactacccaaataatcaagttatgcaaattaatgaaattcctatattgttaagttacatattttactatttccaatgtattgattgaaaaatatttactgggcaatttctctttttttagagatgggttctctgttgctcaggctggagtgcagtgacatgatcatggctcactgttgcctggactgcctaagcttaagggatcctcctacaggcacagtctaccacagatagcttatttttttaaagttgtttttgttgagatggaagtcttgctgtgttgcccgggctggtgttgaactcctaaactcaagtgatcctcctgccttggcctcccaaagtgctgggattataggtatgagccactgtgcctggctttattgagcagattctgtcaagtattaagtatcagtttttgtgagagattaaaaaaaatctaaatcatgatttcttccctgaaagaatttagagtctccttggaaagggaggccacttgtgcattaaagtttaaggttgcggttcagaaggtcagagtcatggggtttgtgagactaatgacgagttaggctttgaggtgaagatgggatatcctaatttaaatgagactctggatctcaggacaaaagactggcatgctatccaacataaagggttttatatgcattaatgataaaagcagatgttggtacaatttgtaaactttgctccctaaatagtaagtatattttaaatattctacaaaataatcaagtttgacaatagttttcagttgctacctctttctgtggtctctgtctgcttagccgttttcttgaaatcagtggcttcttaaaggaagaaggacatcaggagtatgttagaattgcgcctcaagatcagctgacttcaggtcatatatcttcaccactttctccagagaagatagatatcaaaaatccaacttggctaagctaaggatgggaactgaaggatgaaggatggagagccgggattgggccaggcctgtagaaaggcatctagttatgactggcgggtgacccactgaatcaactaagtgagtggattggtttcagtgcacaaagttagtgtgtaaaattgttaactaaaattaggtttctggaaaaattttgggattttattacaaaagctatgttaatccttaattatcataggaatcatttggtgcatattgaaagtagaagaagatatgcatccagttagaatattatgcaatttagcatcaccagggaagcgaaacagcagcatttgtttgaaattgggggctccttttttccaattacatttttcaaagattgctataaactgtgatttttttttcaaagaacaaatagtcattcctatattgaattcagctgtgtgtttaataatttttacattctaaaatttgtatgtggtgtataaagtttctttcctcagcagctgaaattgataggttaagctaaagatgaaaatatctagcatttgctctcggcttgaagggagcggcatgtttctcaggaagctctcgcctgggagctcagtttgtttgagttctgttatttctagtgatgctagctaatcatcttttagagtttcagtttccctttggctatgtcaagaggtcgagtgttataaactgccttatgctttcctcacttagatgggagggcccatgtaattctgctttcgaagagcatttagcttctccaaagaaaaacacttaaccaactaatgaatcataagagttctaaatgcttttcttagtaatatctcagttttactctgtagtggcagaaaaatttagacagctatgatttcctcagttttagtgttggagaagactaaggctgggatttttcaggaaatgaatgatgttttaacttgaaaagtactggatcacaaagaacataacatgcggtatgctttcagtttcttttagaaaaaaaatcatgaattgaaaaagttttaatagctttccatgtatgctaggtatttctataccattctggagacactaatcaaaggaaatataaacacatatatcacaaaggattgaaatttgactttaagagggtgagtggcaatggagctcctcgatacacttcccgtttcacaggggaagagatgggaatttgcagaaaaactgacttagttctgcctggatgtgtcaagcccatgagccagagctggtcaccatcctgacccacagtagaatcagtggttcagttgtaattttctctctgatttatctaaagagatcactgttaagaattctgttaggaacctgctttatcttagaaatatgacaatgagtaaaattgtgaaatttttacactgttttggtgcatatgcatttatgttgaatactattcaatggaaaagtattgccttatatatctgctctgttcagtttttgaatctttcatgccgttgtcaacttttacaaaagaagaatttaataccacattatttcttcttacatctatttttgaaaagcagttattctcaacactaccctaaatatttaaaaagaaaaacatttcactaacacaagattttgctatttgatatctccctgtcaaatctgaacagggtacctttacaaaaatctttgaaaacaacctttagaaatagtctggaatcagtttatgtcaaacaaatgtatgctctaaatcagcagtccccaaccttttcagcatcagggactggttgcatggaagactatttttccaagggaaggggggattgtttcaggatgaaatttccacttcagatcatcaggcgttagttattttctcataaggggcatgcaacctaggtccctcacatgtgcagttcacaataagattcgagctcctgtgagaatctaatgctgccactggtctgacaggaggtggagctcagttgttaatgctcagttgctcacctgcagctcaccttctgctgtgccgtgcagtttctgatgggccacagactgacaccggtccgtagccatgggattggggacccctcttctaaataataattctaacaagccaccttaatattcaattcaagaatgcagtccatgatcaagtaaaatgttgttagaagaaacaggtttcatatttcatatctccagagagtctttaagaccattagactattcagcaaaattatccatatatgatttttattttttgcttcccattagccaaacccacatatattattattacttttttaaaaactgcattagtatgttctaaagcttccttttcatttcttttgtggttttaatctttggagagtgagctagaaatacccattagagatgaattctaggaaaataaatgtaagcagtaactctggctcaatttatttttcttctctacaagaactgtttaaaacctggcagtggaagactattctcttgtctaccaagtattatagtaggaagtgcaaggtcatctctaaatataaaagattctatgtttctaaggaaagagtgtatcttaagaagggtaaatgaaatagttggctagagggaaagggaaatttccttatttcaccctgaaacttggcagcatttctgaaacagagcttgaagctttgagatgaattaaaaagagtttgtttcaccttctatggaagctcttttgcacccaatttacttttcccctgtctggtcaggaaggcacttcatcattagagattttgtaaaacttcatcggttgattaaaatgcagatagcatgcctctcggtgagaaaataattttaatattgtcagttttagaaatctgcctacataaaacatacgtgagaaaaaatgtgttttcaaacctgaatttttatgtaggcttgttcactaacttctccatttcatcatcagaagctcaccctttcaagctacttcgctttgtgtgttgtggggagactgagggtgggtaaggcattttggcacgactcaaactggtccattttatttcaaataagtcctgatgaaagggcaaatcctactctcagcataatcttctttagaaataggaggaataaatgctcctaaaatgaatgcatagtaaggaagggcagggcagatgccatgatctgggtgcaactcttaagctgatgtgtggcccaatgatcctcatacgtggaagccgaatggaccatagcaccctagcttcctttatagtcccctttgtttggttttatcagttgagggagatggcctacttctttgccatgtgagtaaacaacagaatgcaactaatcttctagtggaagatcatggaaaaagctgctacctatgactatagaagtacatttcaaaatttggtgtaagtcagaaataaagtcctggaaagtagttaaatttcttcaacacttcagggctaacttttttttaagttcataaactttactttttagagaagttttagatttacagaaaatttgagcagaaagtacagagaattcccatatactcctcatatccaacccaccgcagtttcccctataattaatgtcttgcattagtgtgatacatttgttactttgataagccaatatcaatatattgagacccatagttattttttattttttttcttcatgaacccataggtagagattcatagtttaaatcagggttcaccctttgtgttgtccattctgtgggttttgacaagtgtataataatatgtatctatcattatagcaccatacagagtagtggcaccgtcctgaaaatctcctgtgctttgcctgtcaccctcttccaaacccctgacaaccactagtcttttcactgtttccatagttttgcctttttcagaatgtcatatagttggactcaactatgtatagtgttttcatactggcttctttcacttagcaatgtgcatttaaagttcctccatgtctttttgtggcttgatagctcatttctttttgacactgaataatattccattgtatggatgtaccacagtttgtttgtttattcacttattgaaggacatcttggttacttctgagttttggcaattatgcatgaaactgctataaacatttgtgtgtaggcttctgtgtgaatgtagtttttaactcatttgggtaaatatcaagaagtataattgctgaatcaaatggtaaggacatgtttagttttgtaagaaatgtcaaggtaacttctgatgttctgtaaatacttgcggatttgaagaaagaaaaatgaagcagaaatgatgtgatgcctttaagaactgagacccttgcaattgattggaaattaagtggtctattgctatatgtattagcttagttttattgaagacatgtagggaagatcttcccttctctattcttgttctaggtaaaaactgctcagaaggttttagcctatgttttaaaaaatagctgggggaaaaaatgaagccttcagtaagtccagatttgtttggcctcataggatctaagattgcccattaggaatgcctgttaaattttgtgtcaaaactcccctacattcttgcctttttctttatcattcctcctatctttccctataaccatagcctacctgccccttacatgatctttcaatagtgttgtttattctcctacccctcattccagttttgaggagaaaggttgagcacacttctccttgatgcctccttctaaagctttaaactcttgttccagtgccatctctgggaaccctactcttctctggaggctggtggacagctgacattctgacttttctcatccacattaatgttttccactgacctccaggactctctcacactctttagttttattattcttattcacgatcttattcctcaaaattgccatcccccatcagcacctctaaacactgtctctcaaagggtcatataatctctgggaactaatgttccagcttcaaaattgagaactttgaatctctcttatctcatttgtctgttcatcataattctgttttctcttcactcactcttactgaacctgtacttaaccttttttgtggtttctgatttctcaacacccatattctaacccattagctcccttgattcctttctcagatccacaatcaactctatcaacaaggctattaccagcacctaaaattgttcttatctcttgtccttatgccacatctgccttgtcaacctctgtcgtatactgtctcaactgtatttctctcccttgatggagaaagttataaggtagaaccttttcatttcacatacatgcacagagtgatatttaacactgagcctcatttgctaggcagtaaggaataggaaagaatccaaatttgttaatgcattcaggtcactctagcactccatgacctggctttaatgtaaattttcatatttgtattctgttactcctttatagcctctcctgccaaactgtactgtttacttttctcatatttctttattcatctgtgtgttttatcttacaccagggatggcaaatagatttcatcttatatgactgttctgctcattgtggcaatgagtaggtctatgttgagaaggattctgatgctcaaaaccaggtcagcaagagattgcaatgatcgactagtaatgaccatcatgggtatggaagatggaaggaccatgcattagtggggcattgcccagcgtttgccacatattttcccctcctgctttacattcttcatgtgtgattctatacatccctcaaggttcagattaatcactaattaaaagaaaacttatatttttattccacatatcttctctttatagattaccatatcactttagatattccctgtgtgaggacaggtattattgggtatgagtacatgtgttcttcttccttctatattgttagctcttccaaggtagaaataattcttaattatccaattttgttgatcacaatggaagcatgatgagaatccacaaggaaaatctcaaacagttggcatgaacacaaatggagtatcctgaactcacttttgacttaaaggtcaagatggataatggaggaagtatccatcccaggctctgctactactctgcttccatttggttgtccttcccaaaactttacatacttccaaattgaaagattccctagatctgaaaggggaaggaacaattttagtaggtctggtgaagaatatagaaacttactcttattgcaaatagttgaaacagaaccaaggaacatttttgacttgtctagtttcacagataatgctaacattaatcatggatttctgaatcaggtttttcatctttttaccaggcagtgcggcaccatatttaataattattttactcattttgagggaacatgtattggttgtgctattattttgtcacatatcaagttttatgcaattagaaattaacccatgggttttgttgaagaagtacacattttctgtaaagtaacttttcattaggaagaagcttatggacattactattttttatttttggcaagtaaacttttatttgaaatatatatacagaaaagtggtacaaacctcaaatagataatttgatggattttcaaaacagtgaacccatctgtgtaaccagcacctagatcaagaaataaaatggtgtcagcaccccagaaggagcacaccttctcccagttgctgcctcatcctaaaggtgaccactctcctaatttctgaccccgtaggttagtttgacccatttttgagctttgtataaatgagtcatataatatgcatcttcgtgtttggcctctttccctccacataatatttgtgagatttacctgtatttttgtgtgaagcaatagtttatttttatgggtgttcagtattccattgagtacatataccatattctgcatcttaaatgattcttttacacttactgtcactcttaaagtggagttgagaaactgagtataaaatgtctaagattataaggatctttgtgttatttaacttatttatcattttcattattttaatctcttcatggaaattgtggctaaggatttctaatatgagctctaaaattttagtattatattctagctatttgaatacagtgaatcaatattgtaggcctttggaaacgtttttaaagtaaatattacctgaaaaaaactagtttgttgtaggattaaactctgtgttctgttcttataacttcatatatggcatttcttgaaatgactgaaggaattcttggatttaaaggtcatctcgatttccctaggaagtcatttagacattataaatgatggtttattcagaagaaggaagatgagagatggagatttcctgtcagtgcaaggatattggaggacagacttcaacatattatttatatatattagtatcttatccagttcagctcaaggcagataataggtgatgttttggtgctgtgtgtataggttctagtagattaacaagttattcagccttatggctgtgttttcagatttgaatcagttaatatttgtagaacatccgtgagataaaaagatcaagatgaaggcaaaaaaatgacacaagagctctgaattcttacctttgaggggcggcatacaatttattcaggaaaatgacaagtcaaagattctacaagtttgacaattagctactaaaataaatattttacacacacatgctaagtgtgtgtaattgaagaggggtaaggagggaagaatatagagtatttctcttaagtagactaggaagaaagataggacatttgagttagactttggaagtaggagaaacgagataattggcatagaaatgttggccatgaagtggtgaaagccattgccatggaaaaagaaggcataaaggagcctggcaagaaaagaaaagattcactggtgtggagggagagggaatgaggacgtggtcagccttttcttgggaatttgaattcgtattccaggtaaaagaatgccaatgcagtgcttctcagtagtttttaagcccatgcctcctttagataaacatatatctttaccactccatcctaaaactctgattacctttcctccccataatatgtaggtgattatatttcctacgtatctccagccaagatgattttgttaagcttcactctctatagtatatattgtagagaaaggattccccccaaatgtaaattagatgagaatgttgagttaagttaataactacatacatcctggggacattctaacatgcctgtgtgtgtatgtacttcttcatttcttctccatcctttgaaaatcaccaaggctaagtgccatagccaaaagaataaatgagaagggtgaggtttcctctccagtgcacttgatactaattgaaattagggtccacagactaggaaatttagtgaaatgggtgtattaaaagaacgagggtctggtcgaacagtctactctgagaggaagaggggtataaaatacaatatgaggaaaaaaatctgaaagtactgttcggaactacgctactaaaataggctgtatatacactttttccaggttttttggactttgtatagaaaatgaagtgttttgttttagccatttgaaggattatgtgtctgcatgacatttggtggaagtatttgataagtacaggaaataaaagatgagctaataagagaaaacaatcaggactggcaaattagatttggagatgattcatatagagatcattataatcgcaaaggcaaattatgtttaggaggctctgtatagagaacaactagccaaaccctgagggaatgttaatggtagtacgagagaagcaaatattaggtttctgtctgagtattcagatgaccagaaggcaaatcaccaggaaaatatattttaaaagttaaaattaggaatctttttggggaggaatttatttagatttaaaaacacatttattgaggacctactgtggtaagtgctggggttgtaagtataaataggatagagtcccctaaacctcaagaagctgacaaatatggtaaggaataaagaactgaagacaattggggtgtaatgtgatgggtgagtgcccagtaatttacaaaataattattttcaaacttaatttcacccaggcaagaaaaagtagtgcaaatatttagggtaggagggtgagaaagcaacgaagtcgcacaaatattgtggttttatagtaaatgttgtcaaggtggagacatatatggatgatagatcctcagggatgttttatgggtttaatatatacaatggaaattctttagaaaagtatttgaggagttgtgcagctgtattgctgatatgagacttgtggtttcttttccacattttataactatgaagtagtaggctgggtccttgaataagtgtgtgttctttggtttgcatgaatggtatgtactttgaattctcaaaacagaactccagtttattttctcagtagtcccagtgagaaaagctgtatttcttaaatatggtcagaaagcacttgacggaggagtgtttactgtagaaacctgtgattgtctgcaggtaccagcataaacatgttcccattcctcatcccgggggggtaatctcattattaaacctatgcaaccttcaagttagcttatttttaatgtttgtttcatattttaaaagcaagaagtgaacacggaaaaaagtttaacaatatgaaagaacatataataaatggtcagccccagatcctcagtgccccagatcctcagcaccccagaggcaaatactgttaacagtttctagtgggtctttcatacaatagatgtttttattttcatagagagaatggcttttatttgacctctggaatacaaaaaggtaactgtagtttccttgcaatgcagttggcaaattatttttaccttctttttccaagcagactctgaaacatgagttttgaggagcaggattaaatactctgacctaagagacccagatatttggatttttatgtggacatgtactcactgaaactgaaatttggaggaactggaattaataacattttccctcatgtaattcatggaatttattgctttggctctaattatgcatttatgttatattctgaataatgcaaaggagaatattgaaacattttaggccgtcagaacacttttcccgctctcaagctgtctccctattgtatttgtgctgaaatgccaagctgcatgtgacagtagaagagttggcagtatctgtcttagaataagctttcacatgcagcttcaaacacctttgtggtttgggttatattttgacagttgctaggtagcttgagtcagagagtgcagctgtgcaatttaagatgtgttttcctatcctttcctctaaagagagctaaaaaaataaaactataatcagatttctaaagtgttaaacgggataaaactatttagaacccatactatagaatgaagtagatgaattctgataaagcacatatatactaaagtataccagtgaatttatttcagatgaaactaggtaggctcattgtaaacagatgagcttctgaaatttctgaactgtttcattgaaaggtaaaacaatgggtttgggagcacccacacttcttggcacaggtgagtggttggcactcattaaccaccgaattctgacacgaacatgctgtttatgaagaaaaatcagggaaggagactaagatttctgataagaaagagtagaagaaaaggtagaaattcaacttacttggtaaaacgggagtacgtcaggattagaaatgggctcttacacaacgagaaataaagatagctttttcataggcttcctattctgagagtttttcttgttgatttgtagagtgtaaatgtacttcttcctgaagacaaggactaggccgaggtagtttgatgtaaatgtggggactcatttgttatgaacccatagtagactgctgtgggaaaacattgtgaacaaaagaaggagtcaaaaaataaacaaaacattttgtggcaagttatctaagacagatcctggagaagggctgattgagaaggtaaactagaacaaacggctttaaaaataatagacaaggtcaaaatatttctgggcaagaaggacaatcaaaccacttgcaggtgttgtgttgctgcctagagactggtttggcctgacccaagtgatggtgtctggagccaaaccttttatcaggagaaatataggaccacagagatgagacaagtactaccagtcctggggaagtaaagagacggaaaattcctttctttaactagagggaatggaccctgcagtcaacctgtgtacttgcagagctatatgtctttggtattctgatatacttcacaaagtatattttatgccctaggtgctaagtgaattgacaatgaagacttggtattgagggaattaaagggcaggtggggttctgttcccaaggctacagtccatagaatattggcaaggtggagacaaacatgacataccatcttccctgccttctttaatccctgggtggatggtagcaggcaagagagtaataaatgcaaggaacagtaggtttgcagtacccttggtattctgtcatatgtgtaattgaaagccacaacaaaatagcaatagaaaagaaaatattagtgaggcggctcatgcctgtaatctcagcactttgggaggctgaggtgggaggattgcttgaggccaggagtttgagaccagcctgggcaacgtagagagaccccatctctacaaaataacaaaaaattagcaaaagaaaaaaggcttttttgtgtgtgcgtgcatgtgtgtgtttgtgggaagtcttaatttttgccttgaattttaaaggaagatttaaatgattaaagtaatgattaaagtaattgtgagatgtgcagatgacatagaataatggaaattaaaaaataaatatttattgccttttctcccctgcttacaaaagcagtacagcttaatgcaagaaatttggagaaatgtaaaaggagaatggcatttaaaaataaccttaaaatgttttttttcttgaaatattcaatggtggtggtgggtagagagtgagaggaagaagctcctcatagactttgagaaaatcaagaggttttaaagagcaataaaaggaactgagcacatctcctttaggatctgtagaactggccttaaatcaatacagaaatgtctagcaagaggcaatctctctggggagattattaaagtgagagtagattatcatttgagtgactggttcaggttctctgaggtgctcttgaagtaccactgactgttgaagcatgtatctgaaatttccttttaacacaagttttcagtgattctcttagaggttaaacacacagacacacagacacacagacacacacagacacacacacacacacacacacacacacacacacacacacacacacacgactgcagccaggaagcctggctcagtcaccaggtagtggtatgcccttgggcaggtgatttaacctttccaaggtttagcaatttcctcattagtactgcgacaggattgaatcagattttctccaaggtttctacctgctctaactgttttgttttaaggaattgatctcattttctcttcctgtctgtctcaccccaccatttccccttgtcccaaggtaattaagccatttccagttcagacagtgagctaagtgctttttggaacatacgaactcaaggaatgcacgtttttgtcaattatttgagaaagtgtgaatcctgcatggagtttagaatatatgattgtcagaattgtcttgataaatatggtgtgtgtgtgtttgtgtgaaatagagaatgcatgtaggaataaacgagcaagcttataatttttagtaatatttggaatgagaaaaattaggagggttcagtacttgataagaaggtgggtttcataagtagaataaacccgaaggccatatacatatcaggagagttactttatggcttatatgttttttcccttccagtattatagaagacaggttatattgtctgtacaacaactacacctacctacttcaggtgttcatctttggagtggggacctacgggaatccctgagttggtataaagtttatttcaagctggagacatttgagattcaagaacacatattggagcttcccttatctgactaaaagcagcaacttgtgggaaatgaggctaccataaatcctctctccaggagagtttcatggccatgaagaagacagaaagaccacttgcacctccataaacaaacattatcacaaactttcttatataccgtttgctctcctaaaaattgatttgcctttcctaaggaagcctacctgtttttcccataggagcttcctcccctttccccacaaagttaggtatataagtctcatattctaaccacccctttgagttagtcatcactgggcactcccacatgtgtgtgcattgcacgtgtaaataaactccttcttttctcttgctattttattttctgtcagtttaattcacatacctccaggaaataaacctaagagagcagcggaaaaacttttttcctccctgacatctgttttatgtaaatgcagtttttgtaaacatgaagataggatttccggaaacttcagactttgggagcagttctacatacatagaaaaaatacaacaaaacagtcagtacagatgcattttagtaattacgtagcttatcaagtaataatcaatctagaatctgaagagttttttctattgcacagtgatagaagtattgattagctatctgtctggaataaaagcagtgctctgattggctgcagtggtctttatttgaagaagcatatgaagctattggtgtttatggcaaggcatgctgcctgagccgctataagaagaaagactttcccaatgacacctaaaatctgggtacaagtgataagaaagagaagagacaggaactggggaaagtagtgaaaagcagtagagacagtgggggagaaaagacattggctccagggggagcaatttcacttctcttacccctcacctgcaggtcctggtatggaaataggcatgttagaggagaccaggaggacaagaaggtctagccttggacaaagttcaaggggcctttagaccccaacaagatgaaatagaagaagtactggcacctggccccattcccctgactccacctcacccaaaccctgatgattatatattaagattgcatttctgtaccaatgtgaggccacaagatagatggctcatggctgggcatttggatttgctgttggtagtaaaaggtcaatgtagaacaatttccaaatagctctcctctcatatatgaataaggatggttggcatttgattttgctatgtattttaaagctgcagcaaatgcagtgaatgaattcagcgacagctttggccatgtttttgatgtaccgggtggtgatagttggaggtaggagggacttaatagcatgtggaatgagggcaaaaatatcattcaaggcaacgtgcctttcaattcctggcacctcctgttgcacagctgcaatgtggtagggtgggggagggagcagggaggatggtggggagatggcactgctgtgtgctgcagcctgccctggccagccaaactcttgacaaggcagctggagagtactgatcctggctctagattgtcatctgattacacattgttttaccaacttcatgactgttatctgtttgctacagcttgtaaaaaaatctctatgcttggaatggcatggtagtgattaaaaagagataggaagcacttaatatgctcattcatttgcatttattgtagattaaaggaggagatgaaggtgtgtaactatcttttactattgctctcaggattaatatatcatattgcttctgtcatttaacatttttataccgatggatttttcttcaatgttcatatatgtatagaaatgttgatagatgccagtcactgctaattaatgttataattctaagatgctggcgggttgtaggtagctttggccaaggtcccttctttaaacctctcctattttgggcctgagggtgaaactagtcactccttttagaaaacagagctagacttgaatcccagagcagccactaggatatctatatacatctataatatgtatctatgtctgtctatctgtataaattttgttttattatggtaaatatatttaacataaaattaactattttagccatttttaagcattaagtacattcacattgttctgcaaccattaccatccatctccagaactttttcatcttccccaattgaaattctatagccatgaaacataaactccccattttctcctttctccactccctggtggccactattctgctttctgtctttatgaatttgactcttttatgtacctcatataaatggaatcgtacaatatttgtccttttatgactagcttatttcacttagcataatgtctttaaggctcattcgtgtggtagcaggtatcagaatttccttccttttaaattctgaataatattccattgtaggtatgtaccatattttgtttatccattcgtctaatgatggacccttgtgttgcttccaccttttagctattgagaataatgctgatatgaacacaggtgtgcaaatatctgtttgagttcctgctttcagttttttgggtatattccccggaagtgggattgctggatcgatcatatggtaattctagctttaattttttgaggaactgtgatatcatttcctaggacaaactttaatttctctgtgcctcaccttccttatttgtgaaacaggaataatcatccttaactggaagagggctatcagggttagagataatgtagttaaagtgccagcatttcttgcctctagagccagtagcaacaaaacgtgtagtttctgcctaaatcttgctatttctcactgcctctgctcttgctgtctctctgtttgtaatggcctttcttacctgactccctcctatgcatcctgtaagacttgttcaagggctgccttctctaggaagttgtccctgtttctacccaagctatattgccccattttatgcttttatggcacctctatcattgtacctgccacactgaatagggattatctcttcattcttccatctcctgtttgtagactaatttaatatgtactgaaatatctaatatgtggtcagtgctggagattcagtggtagcagacacttataggatctatctggagggggcttcatctggaccagttcctcagggtgtgttcctaaagaccacctcacctgcatcagaatccttggaagctttggggacccatgctgggtctgagaatctgaattttaacattccccttgggtgattcttacgcacattattagcttgtgagttcagaggttccgtgagggcaggccctgtgtcacttcaacactgcatccttggccctgagtgcaatttctggcacaaaacagttacacaaaagtatttgttgaagaaggagggtactctgaattgaaatggggctggaatttaggagtgaccagcaatagtatgaggttaagattaactctaccttttcccaacaagtggaataccaagccaattcaaacataaatctaaacatatattgatttcttactgagtgaggcttctctctgcctcagcctcatctctaggagatttcctaaaggaaggaaatggacccattttcgtcttaaattacattacattgttgactagttgagagtcttcatgcttctttagtttccagcaaaaaaaaatcttcaaatgagtttttattaagcattataatgtttgcaaaggtatatagtgcaagaatttgaaataaagttttctggatgccataatttatgttaacatttatttataaagaaatacatacataatattataaaattttgtgtacaaggactccacttgtgtatctgtatactagggctatattttttgttgaagtgtaatgaggtaagtttatttttaagcatttgtgtaaggagaaaaggagggaagatacaaattacttaagggcctgaaattactagcactcaggagttgcctgaattaattatggagggtctcagttggatggcttgtcactttttttggtactgtaatgccatgctttcccctcccccatgcttttgctttttggtttaaagcttaagctaaatattattctgaaaattacatgtttaaaataaagacagaatttttacagcttgtcctgtggtcattgtgaatattcttttggataactgaaatggtcagtcactaggataaagatccttgtgttagttgaggccctcttttggctaatattctgggagcaagtaacttaataaagctcataaatattcaagtcagtatacggatttcctcatttagtttaaggaaactggggaaagaattttgttaaactgagaggtgggctaagggaataaactgttccttgcatccgtgtttgtgactggcacctgacattagtttcctctcagcttacatgcttgcccattctactgtaagtaaatcccactcttcattttagctttgccctttttcctggcacactgctattttttttcagagctgaagccgcttaatccccacatgtggattctgccctggtttaggtttttctaccagtcctgttcttagtgacttaatctggtcattcacaacaaatcaatctttggttggttttgctatgcctttgtctgattctattaataagcctttttcttgttccttgtgaccaaaattctgcactatcactttctttccaccttttctgatagcccagctagtctggtcctgggctcctgcttggattctacaggcttctccagaacaatctagttggctgggttttaatttatctgcttccatgtctttctataattccaagagcctagttacttacacctctagctaactttactccttgcctaatgtaggtttgccaacttgatgtccttcacttgttccacatcacttctccacttgggttagtctttgtgcctagccttctttaacggggcccatcctgcttcacctgaatcctgattcagatgaccaaagaccaattcagtggctaaattgttaatgtctatgcttttaattcactacaggagaaacatcctggttaacctctgcttctcagtcagttgttcaaatgtgccattggagcaccataaaatatgtcacttcagaatgttactcagtaagggcacctgttttagcttggtcacctcctttgaacctaaaacagaggccagccatatctacagcaagtgtccccaccaaattttgtctcactgcataagctttactttctaaggtgattttgaatggaactttaagaacatatcagacaattttgagttacttgtcttgctgtgctttttattttattggtcttagaggaaacacacatatgcataatattttgtttcccaatttagggagttcatggactacttagaggtccagccccgtaggtcatagtgacactgtgatggaacgtttacttcctttttatagttgtcatatccaaccatgcttattgtaaagacaattgataaatgagatagaagtcgagataagttagaggagaatgatgctaaaatttctttagcattataggatcttagatttatgctgtttggcttactgttactacaatgacagttttctaaatgttatttttataaaacaacttaccaaaaggtacctatgcaggaaatgaacttgaaaaaaatcagaaaagcatttatctttaacagaatgttattgtcaacattttaaatttattgtatgtatgcagttacgaattatataaaagtgagttttggctctctagggaagaatcagttggaattttattaaatttcaacctggactattttacttggaagttgaagaattacagctagcctagtggtttatacaatatataagatatgaaaaacccttcacaggacatttcattgatttgtttccaagtttagttcagacaaccaaagaccaatgtataggtaaagatgaaatgagccattattttgccattatttgcaatatttgtgacttaacatttattacctacaatattcttcattacctttattctgttgtttaaaactacttttaaaaatacattatgatgaggctttttgaagttttttcaaagtggtctaactttaagacgattgtatatttagaattcctgtactttaaaaatatttattgagaatgaggggtgggaagagggagaggatcaggaaaagtagctagtggatgctgggcttaatacctgggtgatgggatgatatgtgcatcaaaccactgtggcacatgtttacctatgtaacaaacctgcacatcctgcacatgtacccctgaacttaagataaaagttggaaatttaaaaaaaagagaatgaacttttttttttttaagatcactttgataaggagaaagtcaatatattgacagaattttacagctgaagctaccagaaatggcatgtggccatctctgaacccttcctgcattcttttctctataccaggctgcctggcatgcttttaaatcaccaccagtacaacctctgcagagatcttcagctatattctccagcagcttaatttttctcccaaggttaaaccttacacagaaagtttgttctctgataggcataggtacactgaataaactactatagtactgctgatcagggcttctgactttgaaactgagctgcaaaacaaataatcagctgattgtatcagtttagtgaggtgaaaagctaggaattccttgcaaacaagcagtctatttaaatgttaaaagagaagaaatctggtttccatgttgtagtaatgattcactagttttctagtgaaggtcatttgaaaggagagtgagcagtgatgggtctagctgaacacagaatgattaattacaagttattaaagcatggtttcactctgggcttattgtgcataagcaagtttatatatgcacttgaagaaacttgatacaaatagaatgaatgaaaaaatgcaaaggcaagggcataaaataggtaggcaagcaagatggcagcactcaatgtttctggaattatataaccttgcccaagaggaagttgacatatggtgaaagggatcttgaaaaaaaaggaagccaaaagagtccctgactgagggcatttactctgcagtttcttcatctaatcagagaaatggacaggaaaccaggccctcttactcctacatcatggggctgttgaacatacctcatgagagagaagtacttagataggttttgcagtggggtatgtttcggaatactgaagtagaggtgttttcaattgatataaaacttggtgtggagtagattacaaggtcaaaatgaatatgtgatctattggtagggaggtagcctgggtattgcaaagagcacatgttttggaaacaaagggacctgagctcaaatcctggctctccagcatgctatccatgtgatcccaaggcaagtgacagccactgagttgtagctcctcttgtaaaataaagtaatgctaaccgttgaagtatatttcctgtgaagttaatgaggcttagcgaatcaagccctccaaagggcctgagccatgtgttcacatggctgtttttattaagcctgtggtctccattctgatttttcctctatcgcgttctcccttatgcggggtggtactgaaatggccatggatatttttgggtttataattatatgtttacttcctttgtatgtacattttgtattattttcctatttttatattatgtgtactatttttcctaatgaaagcttcccaaattggataaatttcatgcctcacaaccctagggtctgccatgtttattttgtaactttcttattaagattaagcaaaataatcatgtaaagcactttatcagttatttattgccaaataacagcccattccaaaacttagcagcttagaacagtaactattttatttgttcacaattctgtggatcagcccttcagcctgggctctgcttggtggttcttctgctgatctggccttggctcactcttgtgatagcagtcagttggcagagagtaggtgatctaagatggcctcagtcaactgtctggcagttgtcaggctattagctggttaccttgttactcctccatggggcctctctagtggactagctcagagctgctcacatggcatagcctttaaagagggagagagagaaaactggaaggcctcgtgacgtctatgcttagaactcccacttgtgctgcattctattcatcaaagtgaggcataagattagcccagatttaaggagtcgaaaagtagattccattgcttgatagaatgagctgcaaagaaatgtggctgtttataatctaccactagctctgcctgaaataggagatcctgaaatatgttagctttctcttcttcctcttcctaccttgcttcttatttctgctgaggttaaataaacacgaattgaagagaagcttccatggaagaagagaagaactagacataaataagactccctcagatgtgtctgatactcagttttataaattcttaatctgttgtttaaattagattgaattttaaacctacttataccttttaaaaataaaatgcttaaaaattttactgtattttcttttaaaaagtttgtatatgagacattaaaatgtcttgcctttttcagtttatatctgtgaaattgtgaaatatatacagtgatgcaccacataacaaaatttggccaactatggaccacacatacaacaatgctcccataagattgtaatggagctgaaaaatttctatggtctcatgagttgtagtggtcataaagtcgtagtgatatctattacctttcctatgattagatacacaaatacttactattgtgttatgattgttatagtactcagtacagtacatacagtataggtttgtagcctagaagcaataggcctgggtgtatagtcagctataccacctagttttggataaatacattctatgatataagcacaattacaaaattgcctaacagtgcacattacagaacagatctctgtcttttaaaaaatttttttaagttcaggggtacatgtgcaggtttgttatataggtaaacttgtgtcacaggggtttgttgtatagattattttgttacccaggtgttcagcctagtacccatcagttgtttttcctgatcctttccctcctcccaccctccaccctcaggtaggccccagtatctgttgtgcccctctatgtgtccatgtgttctcatcatttagctcccacttacaaataagcatatgtggtatgtggttttctatgcctgtgttagtttgctaaggataatgtcttctagctccattaatgtccctgcaaaggacatgatatcattctttttttatggctgcatagtatttcttggtggatatgtaccacattttctttatccagtctaccagtgatgggcatttaggttgattccatgtctttgctattgtgaatagtcctgcaatgaacacatgtgtgcatgtgtctttatggtggaatgatttatatttctttgggtatatacctagtaatgggattggtgggtcaaatggtagttctgcttttagttctttgaggaatcactacactgctttccacaatggttgaactaatttatactccctccggtagtgtataagtgttcccttttctctgcaacttcaccaggatctgttattttttgactttttaataatagccattctgactggtgtgagatgatatctcattgtggttttgatttgcatttctctaatgatcagtgatgttgagctttttttcatatgcttgttgacggcatgcatgcctcttttgaaaagtgtctgttcatgtcctttgctacattttaatgggaccgtttttcttgtaaatttgtaagttccttatagatgctggatattagatctttgttagatgcatagtttgcaaaaattttctcccattctgtaggttgtctgtttactttgttgatagtttcttttgctgtgcagaagctctttagtttaattagatcccatttgtcaatttttgcttttattgcaattgcttttggcatcttcgtcatgaaatctttgcccgttcctatgtccagaatggtattgtctagattgggatccctgtcttaagtggcacatgactgtgtttgatcttcacccagtttcctggcatacaactcctaaaatccttaaaatctccaaagtgataagcgtctctttgtttgctaatgagatgactggtggttggcagcccctgggtagcttcaggatgggggctgatcacaagaaagaccaaggcatgattatgtagttggaactgtttaagccctattccccaacctctgagaaggagagaggggataaagtttaagttgatcaccaatagacaatattttaatcaatcatacctacataatgaagcctccataaaagctttggataagcttccagatagctgaccacatgaaggtttctggaaggtggagcacctaaagaaggcatggaagctctgtgtccgttcccccatacattgccctatccatctcttatctggtgttcatcagtatcctttgtaacatcgttttaaataaaccagaaagtataaataagtgtttccctgagttctgtgagccactctagcaaattaatcaaacttgagtaggggattgtggaaaccctgattatagccgattggtcagaagcacaggtaaaataacctggaatttgcaattggcatcagaatggtggtgggtggaggataaggaggggaagtcttggggactgagacttcaacctgtgggatctgaactacctccaggtagagagtgtcacaattgacttgaattagaggacacccagctggtgtctgctgcagaagtgattgcttgcttggtgtatgggggggaacccctacccctacatttggtcacagaaatcttttgtgttgactgttgagtgacagtataggagaaactgactttgtttttttcctatatcctcaatatcaaataaggaatttgctgaagaaagcttggttttggaatgaagatgaataataatttaaaatacggaaaaagtaatatatttagcaatttgacaaaggctcacggcactcttctttttcagtttaatggaattgtatatatgtgattaagaaaaccaataaagcaaacttctagcattttcccctttaagtgataattaattgtctccttattgagtaattaaattaatctgagtctacagatagatgagttacatggattttaataatttagatagcatctataacttttaagaacctgttaaatgattatgagaatcaaccaggttctcctggtgatgccatgatcataataatctgcactgcatctaaaaacaatcatttggagaattagtttgaaatactgttctttatataactgacaataataaatattttctgataaatgctaacttgatttgctgattattggagagctaagaataataagtgaaaagagatacggaaataaaaggaaaaggaagtacatgctactacttgtctttagtttatttctagtgaaatcagatctattagtcaagacatttagttgcaaaagacagaaaatgtaaaatgggaaattattggtcatataaagggagggttaagaggaatacatttcagtacagctggatgtaggggcctgaggaggtaatgaagacccagtttttctttctccatgttttttgtctctttcttctgtgttggtgccagtctcaggcttgatgtgggaacactttagttgtaatagtttaaatccctgtattcttttggtttaagtacaatagaaaagaatggttttctaatctcaggaaaatgcctgagattagatctgtttaggactgcttgatctggtgtgagtcatgtgtctgtccaaccccagatgaactagaaggatggaataccttgattgtctcaggcctctctcttgcttcacttgttgttcttctggaacaaagtcagggaccctcatcctaagcccacagattgagactggagaagagtagattctagataacaataggagacttcaaaagtagggtaaagctgacatggcaagccaaacacagctagggtctattacaaatgtaacgtacatgttcctggaacgcagtagatgctcaataatatgtcttaaattagagacggttgttagaaaaggatattttagccttttgagtttttgtgtattttgctctcggaactctgctgggtaaatatagataagagtttgcactctctggtcttttcttaaagcgttttttttttttttaatgattatgtgcctttcacgcaattatttagcaataataatgttctgattttacagatggaagacactgaatgtgatgaaaaggcttgatgctgtttataaaattcagtgttggacaaacttaaaatgttttctccattaaaaatttgtaaattgtgtttaaaagtactcaaaacagttatatttgcatccatcagttatataaaatagtattatgactattagtctgataacagatagataaatgtgatcgattattgcatgtttctgggtagcttgtcatatcataaccatttctagaattcttggacacatttaatgtattcctttaaaaaatcagaatggatattctgatttgttctgtctgttggtaaaattcaagtcagagatgaattagctcctgccaacttggcctatttaaatagtataggggttttatacaagaagatatcataaaatttccttttattatcatagattactgtataaataggtgatcatctaatcaatagtccaaactaggacattgttgagagtgacaggggaaaattacattgtgagaccaggcagaatctagacaaaccaggacttgaagtcatcccgtgtataaacaatacaacttattacctgtacacttaatattaaatttctctataaggaacagtgtcagaggactttttttatactgcagagcactttgataagatagctgttggtcatgtgacttctttggtatggcctatttttcctttaagaattaataacatcttaaacactcatagacatgacagcatttggaaagtcccagtgcttctttctctatttttctagcagagtatttagtaggaggaataattaattttttgaatgacagatttagctctctaaccatgtccctggtcacctcttagactaaaatagatcatgccaggtaaactatgataataatgcctgataaagatatcttgatggtgtaattgacaatacctcaataaggcagtggaggttagaagaacaatgagaagtcttctactgtcccctgccaatttcagtatatcacatggaagttatttttctgttatccttgtccctccaggtggcatttaagatttgagcatcatggtaacagagggccagagaatgaaggaaacaaatctcatgtcaactctttcttttttttttttttgtttctctatgtttcatttattttttaaggggtgaactctctttgttaagtataatttctattctataatagtaatttaataaatacttaataatgtgaatgcatatttcaatagcattctttttttttttttttaacacaggatctcactttgtcacctgggcaggagtgcagtgacacaatcacagctcactgtaccctcgatctcctgggctcaagcaatcttcctacctcagcctcccaagtagctgggactacaggtgtgtgccaccatgcctggctaattgttttgtagagatggggtttcaccatgttgccccggctggccttgaactcatgggctcaagccttctgcctgccttggcctcccaaagtactgggattacaggcatgaacactgcacctggccaattttactcttttaaaaaaatcttatttcaaccggacacatttttatacagtataaaaacatgttaaaaatcagcagttacagaagcggttaagaacttccttgtgaaagcaatgttcactcagtctttattttccaaatgacttgaatgctcttaatactaatttcaccttgatctaagccactttatattaaacccttttatttaaagttagttgcttttgagcccactgcatagagaccctctaattctgtgtagtgacttgtactttagtgcccaattagagtgtgaatcaaggttaattagcaacaaatcatctttttataattgaagaatctaaggtacagcaagataagtgacctactgagggacagagttcaaaataaaataggtttcagtcactcaatgaagtgctttgctgggagatctcgcctggtcctgtggtcctttagtgaaatatggggaaaccagcaggggacgtaggtcagatagtttataatggtgagttataggttgtatattataaggagcatttctcagcactgaagaaatttcactagattccagctcacctttccaaactattaaaagcaaaacgggactgtttttcaaaaattggaaagtaaacctggcttcttgttagaaatttggaaaatattgagaagttttagacccagtccctttaaccttaaggagctcacatgcaataagatggaaggggcaggggagatcaggacagaaaactaccgatatggccgtgagagcatggaagcttagatcagtgaattcttcttgaatttacctttttataaatctttaaaaacaaatttgactttaaaaaagcacaaatataaatcggaaatgctaattagcacgttaagttagatgaaacatatcagtggaatcaaagctcacgcgtcaaatgatgtattttaatattttaaaaatcacagtttaagctggacatagtggctcacacctgtaatcccagcactttgggaggccaaggtaggtagatcacttgagctcaggagttcaagaccagcctggacaacatggtgaaaccctgtctgtacaaaaaatacaaaaattagctgggtatggtggtgcctgcctgtagtcccagctactcaggaggctgaggcgggagcatagcttgagagaaggttaaaggctgcataagccatgattgcaccactgcactccagcctggataacagagtgagaacctatctccaaaaaaaaaaaaaaaaaaaaaaaaaaatatatatatatatatacacacacacacacactatatatatatatatatataaactatatatatatataaactatatatatatataaactatatatatatataaactatatatatatataaactatatatatatataaactatatatatatataaactatatatatatatatagttagtttaagaaatgagcaaaaatgaatagctaggcagaaatttatgatagcttttcttagattaaacaccaaaaatatcttgaacatttgcgttggctgaaaatgttctttgtaaacagtgaaaaaaatctacagttttattttaaaaaagaattagttatgtttcctagtactttcacattgaattaatttgtcacttattctagtggataaacaagaatagggctacttacctgaatgttaatggggcagatgctaccagagccaacccttatccccaggacctttcacatttctcttgtgaactttctactgtcagcacctgcatctcaaatgctgatttgcccatggacagcagttcattctagggaattaatatgcttgcttttccagcagccctcatctaataactctctagaggtgacatataaatactccagctccctcaccctcagatgagataattctgaagctgtgttttgcactagttctgaaagcttccccagggaattcagctccaagcacccactctggcagctgatttattagatgcttttccttctttgtctctcttccccacttccctaccactgttccctacttggggtctgcttctggagaacccatactaaatcctaaaattaggcattattgttattacacttctatgcactacctggattaaccccatggcgatcatcgtttgggaattctcaagtgttttacataaaaggcatcattcataaagctaaagaaggaccagtaggatcaatgacgcacactaatggattgaaagagttatctagcatgacccgagatgcattagcaaacacaggaaatctgaccttgggagaaagcccctgatctgagcctggagagtaagactgaagtcagaatgataagccttccttgtccaatgtcacattgctttggatttgctgtagagctggaggttcagggaagggcatttctgcaatgccttcttttacttttgcatgtccttcctggcctgactgatgtgggcggtgatctcattttattctttctccctaaatcttctacagcagtatacacatagatagtgaatacttgttgattaatgggctactgtgctgtgctgtcaggtgctatattaaattctgttatagcagttacttctaggatctgtaggtattttttttttttgtactataagtccgctggtctttgttgctattacattatggagcattgtcaaatattccattttctcttcgaggagtacttggcaaaattagcatctgatgatttatttttgaaaattagtgataagatattgatgaaatagacatagtttctaatcttttgtttctagtcccatttagttctgtgcatgatcttgtgaatgagaactttcatatgctaaggaaatctcttccagccttaaccaggagcaatcaagccagttgttgctgacacatccctgctacacctcgcttctctggctgtggtttgctgggatccccagggtagtagttagatgaacactgccatcatcttgcctactctgctccaggatttctagcgtggctcactgtccccaaccagacgtccttatcagcaattccttagagatgtcactctgactcttgtggtgatctcacagaaatactcataaaaaaaattgagtatgctgctgtgtgctgtaaattgtctttctcaacttgaagttatacctctttaaccactgttcatcatttctgtgacaactgtatgagtatactgtatactttaaacatgacaatgattgatcctgtaggtaaaataccaaatggttgaaaacaaatggcaaggatttttacaattgaaaggcctatccacccggtgaccactgtattattcattagaaataggtattatcttagctattataactgctggaagttttgtgaaccttttatgtccagtcaaaactgcaaactctgcatatgcttgcttatgaatattacttctagctaaagaagtgttcatatagtcttttccatttaaatacatggctaggcatttactgaaatgtgagctatttactaatggtagattactgcagtgtctttcatatcagatgttgcttatctgacaatctcaactaggtggaaactaggcaagaaacaggtaggaagctgaattggctcgtgagataacctaagagatatcccagtgtctatgcagtacctattcttgtgtactttatctttattcactggaaaacccttctacaaccacatgcaaaatcagtttgtttttaaaaaattttacactttttttttaaagacaggattttgctttcttacccaggctggagtgcagtggcacgatcatagctgactggagcctcatctcctgggcgcaagtgatcctcccacctcagcctcccaagtaggtgggactagagatgcatgtcaccatgcctggctaattgaatttttttttttttttagtagagataaggtctcgctttttttttttagtagagataagttcacttgaactcctagattcaagtgatccacccacctcagcctcccaaagagctgggattacaggcatgagccaccatacctggcctttacacatacttttaacaggtttggttcagttatataatttcctggttagtagcaaacaagaagggagaaaagaatagactaccagagaaaaatactaagaaattatactttattaatacctaaatgattaaacttagtgaaagagtgagttttagtcacattttaacttaaaaactgataattgtgttagaaagcttcagacagtttgagtgcctgttatacgctgagcaatgcaatgcaatgtttaccagagtcctctctagctcttacatcttgtctgtgagacagacattattattgccattttaaaaattagagaacaacttaggctctgatgagtgaaatgatttgcacaaggccaagcagtaagtaactgagtttgaattaaaaccaggactgtccgatttaaaggccctattgtttctatcatatcaaattgcttccacatgggccattccacaatgtacttagtgaaattattattttaagagcaatacacttcttagaggaacttaataataacctcctctgactcccctgaatttacgtatctttttcttttttttttgcctaaatggggatataaacaaaaatagtgattattttgatttatatttacataataactttttcactttgtatagattcagtttgtgactctaataatactatttctggcttcaggcctgttgatgttcgactcatgcagtcacatacttgttctttaaatggttgtggtgaggatcatgtgaaggaaggaacagccagaaaagcatcaagataattgtgacaactgccacgggtggtacagtgattaaagagaacagatatgtaaaagtaatttctttgctgagccatcactggtgcagagagcaaaacaatggggacagatgtgactgaaagaagttttgatgttatcctagtgtttggttttaatccctcctcacctcttgacaccatcaatttttatctgtcatgtaaaaacagcagcaacagctcatagtagaaggtatgctgcaacggtaaatttcatggcaagacttcttacgtaattcagggatcacatgaaagaaaaccacaacattatcttctagcttcttatctgattttgtaaaaaggtttcaagcatactttttttttccataagtgttatttatcagaaatcttaaatggtagaaaccaaactttgtgaaacaggaagggtaataaagattcccgtgtatctgggcggccacgaagcatcatggagtttttgttttgtgtctccgtggagttaactggttttagcagttctactgaactttagctaaaatgaattacacaaataactgattagaattgactcatgctagaatttgaattactaaagcatgcagaaataagagtaaatgctaaggggagctttgctgcttttagggtgtttgatgtgaattctgatctggtctcctactaccttcaatctatttgataccacagtacaagggacactcaggtacatgtaggctccaaacccttatctagtcacatcttcatgagccacactgacctttttaacatagaatgtaggttagaggcctatggttcgtttttgtggcgttaagagtcccacccacccaagacccagtgaatgagaatctcttggtgtagggactagagatggacattttaactattcttcctgggtgagtctgatgcatatttgggaacctctgcacaggcctcctaagtatcattaccccttctaaatatgtggcatctctaccctcagagagtgttaccatatttgttagcgggaagggaagagagaaaagtgtcaggcttgaacagaagagaactttgaacatctattcaaagagtggaaaactttgaacctctttattctactacccatacctccaagtccagctgccttggtataattatatttcttgaatatgcacattttcctttgagctcgaatagaactgcttctccttggatgtggaattgatgtgagtagataggagtgacgctcttccttagagctgagattcttactactggggggaaaagagaccaggctgcccctattccttatcacactcccttaccctgatcattccaattcactatatctgataccatccgtgattcagatgctcacctcgggagaggagctgtttttctggatattaaactacatgagcaagagtgaacattttgtattgtgtaaaattccgtgtttgggatggtgttagaggcagagatacttcctgggtctaatgccatacagagaggcttgatacttaccctcaagcaggaatgagaggtacatttaaattactagactgattagactcctgaatttagaatcctaatttaaactcctgaagagttagctgagggatgtgaggggcctgtacagttgcagacacatctgtttcaccccaaacagatcctgtactgtttggagagaaacccctagtcttccctacatccctggctttagattttttggggcctgttcttagaatgaggttcataagggaaggggcagtgtggccctcctgagaccagagggaataggataaggcagaagttctcaagtgttgaaacgcctgaggttcttggtaaaatgcagattccagacccccacctggatccactgaggggagtgccttagtttcctagggctgctgtaacaaattaccacacccttgttggcttaaaacggaaattcattttctcatggttttggaggccagaaatctgaaatcagggtgtcagcaaggggtggttccttctggaggctctgagggagaattcgttctatgcctgtctcctagttttggtgactgtgggaaatccttggcattccttggcttataataacatcgtaccccaaacaatacaaaacaaaaataacaaaataccacctaaattaagttaggtgcactccttagtgtccccctccctgagtgctttgagtaaatctctaattttgctttgattgctctggttaacacacaaccataagaacacgaccagcactgcaacactcacctatctgacaaggacacctgtgctttcccctttacaccctctacaaagggacttggaggctctctaataaacccaaggacatgctttctgtgggaaagaagtgggggcaggtacttagctcctgggactcctggtgaatggctagtttgttcagctgtgctgtcactttgttgctgtagacactaaattccagtctggattacaaaccttttgtgagtaactcggactaatatttacaatgctggaagatgtaaaatttaaaaagccagttgacctgaaataatttgttagttttctcccccctggcctaatccaagagctttctgcttagctcatcaggtcctctggtgaccttaatttacttttaggtagcaaatttcctgttccatgcaagcagaggaagttctctcaatgaaatatagccaaatcagcacaataccaatcacctatcctattaatttctttatactaagtctggaaggcatttagggccttgaatctctttgcctgcctgtgtcctccctctttctcatttgtaatccgtctgttttccccattaaactgtaggcatcaatgccaaccataagttttataccaaacatatgattggcatcccttccttggaggcactgtaccctaatggttaagggctgtgccacagatccatgactgtattcagctctaccatttactagattgtgatcataggcaagttattgaactgctctaagcttcatttttcccatctgatgaatgggggcaatgatgacaatgatcatgatacccactttattggatgattgagagaattagattatgtaagttttataaagggcttggtacacaataaattctcaattagctatttttgtgattacaattgtaattatattattattatttgtttaaaatgccagtaagataagcttgagtaaaagatttcttatactaggaaagaagacaataactacaggatgacaggctgagtaaaattatttgcataataacccacattgattaggctcttagtaggcattagcacaatccaaagttcttacatctatgatcttatttgatcatcatggcatgctaagaactattactattaccttattttcctgatgagataactgaagcacagagagattaagtatcttgttcaaagtttgtcagcgttaacaagggtctaagatttaccacacactatgttatagtcactccactggcttcaaaagattaatatagggaaggtttctaaattgctcatttttataatataattattcaacatgtttatgtgtattcaatacaaattgtttactataacattattcaaaaaactttctattaatacacatatcacaaacacatgttcctttagggtgggggtaaaaagccccagcatcttagcttctaggtgggagcctgcaggcacggagtgctctttttctctctggtggttgcataggttacagagccagcaggaagtccagtgcctgtggccagtagaggaatagcatggaccctgcagagagactgtcatcaagctgtgctgggcaggttcttacactttgtggcggggaactttcttgctgggagaggttcttctgggctgtggctgctcacagccatgctataattggcttctgcaaagtagcaagcatgctggctttgctacccccatccatctggctgagttttatgcacatgcaaataacagaacccttatttgtggctatccctgggactcatgagtcacaacgcatgcatccatacggtctacaatgtcatacagccaaagctgggggtggggattagaacatttagattcagccagtctgactttattgtctctgtgcctcaccaatatatcaggccaccttcctccaataggaaaatcctaaaaaagtcctgacattggtgtctcaatctttgccagatttttggcacaccacaatctgagcttaaattgcgatgcaaaatatttcggacaaggctcagcattgctacttgtttgtttgcttattttttgttggaaacccagtgtagttcatttcatctccacactcagctgttcactgatagcttttcttcttaaaggaaatattttttagtacttgttgatgttgactttagtaacgcaatattatcaatagtatttagaatggttctttaacaaaaatgtaatttcaaagcaaccttatgaaattttacttataagtttttcattttatagcacttgctctgggaaatggctacttgtcaaaataatgacggattcaaatctcaatggcgtgtagtcacatttccatagtaaatatgcagtcacaagtcctttctggtatttcaaattttcccacttttttaacatcaacttactgatataaattctattttctttagattatttttgaatattgcaatttgaaggctgatgaaattatcttcgttatagaaaaaagtaactttaaaaattataatatagtttagaagctttggaatatgtagataaacaaaaagaaaataaaaataattaataatctcatcatccagagatagccgttgttaaaatttgttttttataatgaaatgattttttaaaatttactgcttattgcaggaaaatatactgacagaaaattaaattatctgtttacactaaccttgatagatttctttaaaaagaagcccaagtcctccaaactatttaaaagtaagcaaataaacactttatttgaaattttaaaaggtgaaaaagcacaaattaaatattaagtttgatacacaggtgttttagatttagattgtttatgatttaatagacttttgtgttatgtagcataattttttgttgggattcaatttgcatatggtacactaaggtttcttatgcattgatagcatatagtatattttatgcttgttttctagggtttgcagtgtaattttatctatttaactttataatagtcaaaacaaccaaaatgttctttaatagtaggatagataactaatagtttacataatgaaatactatgcagtgatgaaaatgagtgaactatagccatgttcaacaacatggataaatctcacagccataatactgaatgaaagaaaccagatgcaaaataatacatatactcaggccaggagcaatggttcatgactgtaatcccagcactttaggaggccgaggtgggcggatcatttgaggtcaggattttgagaccagcctggccaacatggtgaaaccccatctccactaaaaatacaaaaactagctgggtgtggtggtgtgcacctgtagtcccagctgctcgggaggctgaggcaggaggatcacttgaacccaggaggtggaagttgcagtgagccaagatcacaccactgtactccagtttgggtgacagagggacactccatctcaaaaaaaaatactgtattaatgtatttatgtaaagttcaaaaatagatataactaaactatagatgggataaggacagtcaggaaattataatacagttaggaatttaggacatttgttgcttttgaaaggaggaagagggtagtgattgggaaaggcaggaaggaacatctagggtactcaaaatgatctatttgttgacctggttgatggctagtaaggtgcactcgcttttaaaaagaccgcattgagcttcctttatattttgtgtactttgctgtgtgtgtgatatacttcagtataaaaagctaaataattactacagaagtcatatttatttgatatctactctttgctcccgacataacacccaatcttcctgttatttcctcagggaaatatggtttgctttactgtcatggtttccaaggatgcattaggcttaaaaaaaaaaaccgtagaactgctaccatttgttttgtctctattgtgataaaatttccaagtcatttacatattttctagatagttgatacattttattagttcttgttcccagcagatgtgtgagacaggctggtattgcagtccctattgttcagataaggaaagtagacacagggagagtaaatgtttggctgagcctggaattgaaatgcagttcttttaacattcctctgtgctgtctgactatataacactgctacagtcatagataactcagaatttccccaaaacttggactcccagagaaaaaagatttccatgaacacgaataggcactaactataaaaacatttttgtagatgaaatttacatttgtatctaagaagtatggttaagcacattgaggggagttactcactgattcaacaaacgtttctgagcattgggtattgtgcctgcctctgcaggagatggagctaggaatattactataacacaaacgtgataagtgaaataatagagaatcccacagtgttttgtggaaaatattggcccagaagaggggctggtaacgagcttcttagaaaagaagcatttggaaggtcttttggaggaggggatcccggaatctaatctgaaatatacagggatgcattttattttatgtaaaacttgataggtcagttagatttcctacatttttcccctcataatattttgacctcccaattttaagaaactttgtattcttagagaacattttttttttgaaatttaaagaacagattgaatttccagagatggcaactggatggtaaactccttgaagataggacatcttatactaccttgttttttttccagggtccagttgcataatagcctgttcattaagattattgcaggattgtttttggagggggctatttttggtagaagtgagttcttcattttaatactacacttgccttctttgtcagtgaatctaaagtgctgagctgttagatttgaggttgttcagatattttatttcagctgaattctaacatcatcaagtcttgcatatcaaaatccatttacaaataaattcaactgagctgcatacagcctgttggtggtattaatttttaaaaataggttatgctatagattttatttataggcatttagatgagcgtaaagctctaaggcagcaaaatcccatgtacaatactgatgccagcataggccacttttcaaggttgacatttttgtttttcagatatgatgtgtgcatcatcttattctttatgtgaggttcaatagatgatcccttgtttgtaaacagaggtcaggcctaaccaaatttcagcaaagaaattcagttacagaaagagaatgtaataacatcaaaacctttatgtggaaacggtattttgcatttcctgatagacatatcctggcatctctgatgacatccactaaggtggttctctaaaatattttataattgctgatgagtcattaggtaatatggagaaaatgccttagatcctttctcttttttatgagaggaatgcctgggaaaataaatgaaagttcaagtgggagacagcagaacattagtgataaaggaagcaacatgaggggcctgtgtttataagggcttttaaagttaattataccattaaaaaaatttgtgaaatgtaaaatattggcccatagtataggatagttgtgggaaatatctcctggaagtgatactctcatagtgtgccacttttccgcatcatcttaacatttgtaataacctaatgatggaaaggaaaaagcacttatggtccagaaataaaaagaaataatatattttaccaagtgaatggtaaactattcttagccaattagtagcctaatgatctgcccaggcctgactggtttaaaatgatggtaattctaaaatataaacaattgcttaaatatatgtcaaaaagaaaggaaatgaacgcaagtccactgccttaatttcttagagcaaatcctaaaataaatgttttgggaggttagaataaatgaaataaaaatgaaattaccgtagttttgtaacagagttctcaaatgagggcctttggatgtactttttcagggggtcctcaaacctcttaaaattgtgtgcaaatgtagtaaatcaaagccatttttcaggagtaagtaggtcctacacttttatcaggttctcaacagttaagaaccattgattaaaccaattcctagtgtgtgttagttagagacagtgggtaaatagttgggaaatataacaagcctgtgaaatatgcctatgtatatggtaacaaagatgaaaggaggctatatttctgggaatgcaataaaatggtatctatgttattaaaatgtttgcatagagaactttattcttttgttgagatgcaaaacttttatttccctctgtactatgttgccttgtcctgcaaacagacaatgagaaataacattctccatgattagagctgtgcttagatcagaagtttggacattctgtttatttttctttagttatcacactttgcttgtaccacatcacagattgaataatgaacaaagcaagggtggcctggtagcagcaagcatttgacttgttactgaaaatgagcttactggactttgaattggttacttcatatccccaagaacaatttgcttccccaagaacaaaatgctatgtacattttgctttttgttaagagcaaggtcaactgtgattaaagtcagcctatcttttggaatatgaatgcattttaaatggatttccattttctaggatacataagcaagatattcctcaagtcaatgggggatgaaagtgctccagaaattatctgtgatcctggatctgtggaaaactgtgtgtgtgtgcatgtgtgtgtgtgtatacaaagttcattgaacaaagtataatagaaaagtagtgtctaccttaggatcaaattgaagtttccacaccattttttcaccctcgtttgactaggctctcacagtggtctccaagattgtgcattatcaggttgggggagggagagtcaaggaaatattttactctgttctttttccatagtttccctgagctctcaaactggcagccagctggctgaagcctgcccacagacatgttttatttggcccatgcagtgcttttacaatgtttgtgccaacattttaataggaagatttcacatatggatctgcatttctgcattgtcttgagaaatcagaagacatgggaataactggctggagctgaggggcagttgtcttcctcccgctggggcacagcttccttctgcagttccttccatgacttcatgtgctcacacccagcccaagcagttatttacctgcttgactgctggaggcagtttgagattggcttaaggctgcctttgagattgccttagtcttctgattaataaccaggttttgtataaagctatcttcttggtcccagagagccttattacttaataatacatagatatctgaccatcaaatctaataattttcaggttcaaaggatttggaatttctaatttgggcttgaagttggcaaggagtgcaaataaaagagaacacaaatgcctaaaatgcttatctgtccttacaaacattcaatttctgttgtgtatcagagctggtctgaagctgtaattacagtagtgctgtaactaacttgtgcttgctggttctggaatttgatgataaaaaatggattttttttggccttaagacaaagagttgattgattaaaaaggcattatggtatatgtagacttctaggatgttatgatttctttatgctttggacaaaaccctgaggaaaatttaatagatttgggttgtctctttaatttgtgaggctgtaaatttctaattttaaatgttcaattattttggtcaggataaagggctgtgcaaattcagatagtcttcctttccaattgttccaaacaaccctttctggttatggataaatctccttgccaaaactcatattcaacttgttggagggctagcctttatctttctgcctaaggtctttggaagccatttttaatcccactaaattctgcagtttgattaagatagagtggctgaaacaaggtatttagtaatatcatgaatgtgaaggtaattagtatttaatgtccaaaagagaaaaataaaagcttgccagtgtgctaacttggaacgattatatttctttcgaaacaattttgttttcacatactgctagcctagcaatgaattagaatgcataaaagctcaggggatttgaatgtgggaatggataaatgttttataatgaggtagagaattattgcccaaccttagaaataaaagctacataaaattatgaatgtccagatcaatagcattttttaatattataaatcacttttggcagtgcttatgtatgagcagagcagtgatctaatgattatgaaattagattttttttccctctctctctttttctcttctatttttttcctcatagaggcagccgaaggactttgggtaaaccactataacttgctacatttccccaacagtgaaatttttagaaatatgtttgaatgttctgagtacagactatattacttctgtgatttttttaggctgaccagaggtgacatctatttttatgtgaaaagtaaaaatgagatgatctgaaagagttaattttgataactgcttttttactttttaagtaattttattgttttacttgtcttcaggtgttctaagacacaatggaaaacataagaaaaaatgaatttcctttcctggactataaggaaaaaggcaatctactccaaaagaaatgagaagatgcttcgttaggattttatctagcacatctagagtctagaatgaacaacattatgtataggagaaaagtggaatatttatagttttttgttttttaaagagatgaaatctcactgaaggttctttataaagctccattatgggaagaatcacctggacagatgttcagaataaagtcatcatggtcaaaagcaaacatttaccaatgcatgacagtttttgtcttcttttaggcagttgccttacctttattagtgcctgacaatttgctagttagaataaaaccataccttatgctggtttattgctttaaaattatgcccatctgaaaatgtctaaatgtgcagaaatgtaccttttaaaggttagtcaatgtgaatttagagctgtagggaatttaggttgctaggggactctgtggttctccttcagaattgttaaaaaattctctgccagcctgtgagctccctgagggcaggcactgtgctcatctctgtagtatctcctactcctaacacagttcttggcatgtagtatatgctcacttttcttatctaactgacaagtgaaggggtaatcagctgctagtgtttctgttgctaatatgtgacggtttcagcaccttgcgaggcaagtgtgcgactttgggagaaacagaggttaaccaaacaatcttgcaaattaatgtaaaattcctgcttcactaatcagatttttatctctgttatagggggacagccctcttagttttgtgagcagagcatagtttgtgaaagagcccatggttttcaggcccaggtggtgtttcttttgaattcttaggcatctagtttggactagcttcatggtttttgccatatactgctctgtattggagcagtctgtctggaagaaggaacagtgctctgtgtgtgtgtgtgtgtgagctagtttttagtatcccctctgctactgcccatgtgaccttggcaactcacttaacctctaggcctcagagttatcatgctaagattgggatttataactgctatggcccctttaaacttcagtatgctgtttgaatgcatgttttagtgcttttattagtctgtatgttcttatgcagctttttggtgtgtgttttaaaaaactttttattatagataactttgaccacacacaaaagcagacagatcagtaatatgaacctgcaagcattcatcacccagctccaacaatcaatccatcaactcatggccaattctgccccattctgccccatcctcttactctccttattatctggaagcaaatcttagatacttgttatttaatctgtaaatattttgtatttatatgttttctcacctctcaggcaggcacctaacatagaacctcgtatacattaggaaacaagatgatggttttgaataaatgaatgagagtgggttgggaaaggtaagagatgaggcacctcaccccccaccccaaattataaatatttaaaacattttaaaaattgttaacctatagttcctcagggcagtggagggggaggagccaaggcttccagttattgggaatcctaatttggtgtggaatattaaagggcaactttatctattacatgtaatcactgtatcaccagggagccccagcatgttccaagaagttaaggtacatgccaaagataagcaaaaaaaggcatgcaaccctatgggtgcatcttgaggaaatatattagcattaggagatagcacaacctaaaggccaaactgtgttcatctaatttaatgggaatttaaaaatttatgggaaggacttgacacttgatgcttctctttattttatactttctattacctgttttctaaacattttttatccttcacaatagtctcttttccttctttcttttcttttcattattttcccaacaatgctaaagcactcaagggagttttgttgagcactgaattatgtgtaatatattttagccaaagtatgcatacttactttggatgtattactcccaaatgtataggcaacatagtctgcataccacaaataaaataaaaacaagaataaaaaattctaagtaaaaaactttcctttatgcactaaaagtatttggtaagactgttaaaagcagcattatgtacagtaaatataaaactgcaaatatatactatatgtatacttataaggtatagcaaatataaaacttcaaataatctaaatatcctttaacaacagaatggataagtggaatactatgcactagttaaaaataataaactatggctacctgcaacattatggacgtattttacagacataatgttaagtgagagattatatgttgcactattccatttacatcaggttcaaaaacaggtgaaatcaatctgtggaatcagaagtcaggataatggttaacttgatgggggagtaggtgatgacgggacagagcttgagagaggattctagacattgcagatgttctatatcttgagttgggtggtggctacacagttgtgctcattttgtaaaattttatcaagctgttcatttaagatctatgtacttcacagtatgtaattatatttaaatgaaaaagtaaaaggaaaaaatccttccttttgattacttaggaacacctaaagtttaaacctattgtcagcctgaccatataaaaaataagacttgccttactaatcagattttctctgttgtatgggagatagacctggtagactgaggaagaagttatagacacacgaagtttttactgtacaaagtatttgtttctctgcctcgtgggataataatcatcaataaactgtgaaatgattgttacaataaagtactagttggatacatcagtgttggcagctgtggaaaacttattattttcctacagggtgcataattaatgggtcatgtaagggaaggtcctgactcagggttggagtatgtattatacttgccaaaggagtatgacaagaggacttcagaatgaagttcagcatatatttagttgcaagagcaactatacatataagtagtattttaatacaatggaaataaacctagggctgaattgataggtgaatacagtaaaaaatgtattgcctttagaaaagggtaaaggaagtgatactcacatgatataaatagtaacacttttagataggagataattcttccttatatcaagttgagtaggactattttgggtatcatgtgcagaacttgtcctagataggattttgctactgggaacatttggctctggtgccttttttcttctctttgttttaagtacagaatggtatcatatgagaacaaaacacgaactttggagttagactgctattagttcaaatcttgtctctatcttaagttgtttgactttggcaagtaacttctctgacactaattttttcatatttaaaatgggggttctacctaactgggatatttaatagatatatcaatctatctttgtgtcaggactcaaaataactgtaaacacacagtaatttattccacttaaaagaagtccagagatagacggtctagcaccggtacatctgcttcctgaaatgaccagcaacttaggctccatttaaactcttcaatctgccattctcagcacgagttctatcctcaaagtggatgttggagctccaagccatcttcctcattccagacagctggaagaaagatggggcatagggcaaaaagtttagctcccagttgagttctctctcttttagttgtcctagaagtcctgtacaatacttccattttgtttcttattggctagaatttagcaatataacctcacgtagcaacagaaggaggctgggaaatgtagtcttttagctggaataaaaatggggattggttactaaggaagaagtggaaagtgattttggctgtcagccaggaatctcagacacgatgttctcaacaaaactcttcatggcccctctccttagcaaattctatcactatccaccagatagatagctcactctgaaaatttgaggttcattcaccaatccttttttcccttcattccccatatgcaaattagcagcaatcccacaattctaaaatacatcctgaaatcggaaccctctatcactactattaaatccacaatttaaatcaccatcatctcttatctggattctttcagttacctcctgattaattccctgcttcttgtgttgctttccacagatcactgcctgcatagcaaacagaatgatttcctaaaaaaaaaaaattgagactgtattgttcccttgcttaaagccctccaacagcttcccattgcaataaaaataaatgtcaccttcttatttggcctataaggcctgacgtggtttggctcctgcctctgtaaactcatcatctaccccttgtccccaggttctcatgctccagccacagtggctaccttcctgtcccgcgaatgtacccagtatatactacctcagacttttgctctggaacattcgttctcatttttgcatggctaaccctttctgaattagtcagggttctccatagaaagataatcaattggttttttatatttttaaggagattttattatggagaattagcatatgcaaatatggagaccacaatgtgccatctacaagctggagacccaagacagctggtggtgtaattcagtctgagtccgaaggctgagagccagaggaactgatggtgtgaatcccagtctgaaggcaagggaagatgaaatgagatttcccagctcaagtggtgagacaagaaacagagaaggggggacaaattcctctttcttccatgttttgttctattcaaaatggattggctgatgcccacagtggggagggcaatatgttttaccgagtccactgattccaatgctaatctcatccggaaaccctcacaaacacacccagaaacgatgtttaatctggacatcccatgcaaggtcccgtcaagttgacacaaaaattaaccatcacactttcccgcagtttgggtttcagctcaaacatttttccctcagataggccttctctgaccatctttctaacttcatgtccaagacatcctttgtttcgctatctaattatatttgattcagggcttgacatgtgcttccaccctgctcctctaaatagacaaaaattttggccatgtgctgaattgaccacggtgtggaggaagacatattctcctgcatcatcagtggggaatgcatgcattggctaaaaacctctttagagggcacttgtacagtatccattagaactaaaactatagcttcatgagggaaagagactatggccatagtaggagttcagtaacttgttgaaagaatggtgaatttgaagattaaatcacagagtatctgattccagttctttttaacttcctttttttctccatagctttcatcccatatttaaaatgtcctctgctaagatgccaacacatatcctttaaagtaaaattcctagctgggagcagtggctcacgcctgtaatcccagcattttgggaggctgaggcgggcggatcacttgaggttaggagttcaagaccagcttgaccaatatggtgaaaccttgtctctactaaaaatacaaaaattagctgggtgtggtggtacgtgcctgtagtcccagttactcaggaggctgaggcaggagaattgcttgaacccgggaggtggaggttgcagtgagccgaggtcacaccattgcactccagcctgggcaacagaatgagactctgtctcaaaaaaaaaaaaaaaaaaaaaaaaaaaaaaaaaaaaaaaaagtaaaattcttcaaataggtgcatcccagttcctgggggcaaggcctcaaaataaacctagtgcatctccctggattgtcagtttatttgaaggtttgtggaaaaaaaaattatcagattgtcagtttatttgaaggtttgtggaaaaaaaaattatcagaaagagtatggacatattaaaaatgtgagggcctttcgatctactttctaggtccctgggggaacaagctcagtgtctttgacactaagggctatttgatgaagtttgaaaagcaccatttaaaggtcttagctcttgggtggatatttgcattttgatagagaattcttcaatccatcataaagttttcttttgaggaattatgcttactgggtttagctcggggcagtaggtgctggatcaatcaaaagtcttcccgaaatgctagtgataaagcaatatccaggaagccttaggtttttatattctgttattctcttcagtttgcaagctgctttaacatacattattttatctaattggctcctcacatcaaccaagttgagtatagccatgcaaagaattaaacacttcaaacaatattacattttaaaataacttaaatgtaattccctagagacctgcatccttagttccattctctaaaggggaatttcttgcgtatctttccagacatattttattaagcatataccatctcagatctttgggtgtgatctccatgtatatttttcataggcaaatgaggagtaaactacaatatattctgctttttaaaaaaagcatactgttttacattggagtgtagtgttttattgtatgaagtaccccaaattcagttaattctgagggaggggagacatttgagttgtcttcagtattttgctgtaatagctgatgctcttaggaacatcttttacaagatgatcatttttttctttgctcacataaataaaataaataacaaattccaaggagaggaattgctgtgtttaaggctgtgtttagttctgctaaatattgtaaaatcgccctcaaaaaacttttaacacatgcactccccactgatggtatatgagagtaactttttcctataccatggtcaattcggtatatgaaaaattttgatcttattttaaaatattgttgatttgtataaatttcagaggtacaagcacagttatgttacatgaatatattggtaatcgtgaaatctgggcttttagtgtagccatcacccatactttgtacccattaagtaatttctcatgcctcattccctcccaccattccgagtctccagtgtctattatttcatactctatgtacaagcacatgaacaatttaaaaagttttgttaataagatagggaaaaggcctggctcagttgctcatgcctgtaattccagcactttgggaggctgaggatcacttgagctcaggagttcgagaccagcctgggcaacatagtgagaccctgtctctaccaaaaattaagtgcggtggtgtgtggctctggtcccaggtacttgggaggctgaagtagggggattgtttgagcctggaaggttgaagctgcagtgagctgtgattgtgccactggactctagcctgggcgacagtgagacactgtctgaaaaaaaaaaaggaaaaaatcttatttttactagcggtcatttaattgagattgagcattttccccccaagtgtttcaaagctattagcaataattttttttgtgtgtaaactctctggttgtatttctcacctaacttcattgaattgttggtctttttcttttcttttttttaatttgtaaagattcctcatatgttaaagataggtaattaaccctttctgccatatgtgtttcaaatatttgttcccagttaattgttatggtgtttatgagcaaccgtctacattaaattaggtgaaagtgggcttcattagaaacattaagggcttatgaactggcagaacagcatggagagagagcaagaaattgagagaaaaggtcagaggttgagtcatggagctggggctttctagctttatgatcctggacaatcacttaatgtcaggagacctcagtttcctcaactatagagtgaggataattacaatacttcctcatagagtcataaagatttagtgacatcatgcatgttaaagtgctctatacataagactaagtgaatattagtttttattactgaactatcttgcatattggaatacaatacttcaggaaatagaaatttctgtcttcaattattttttgaaagacaaaactaatttttatatttcagatgtttttctgctgttagcatatctcatgattcctgctgattccataattaaggaagacaaatttctttctaatattggaattagaaataaaagatatgattattaaatgctaatgagtaataaaggattatatgatactagtattgaaaagtaaattaattatattaaaatgataaggctaaatcttatttcctttttcaaaatgtcagtggaaaaatttgctaaaatgcagttcttttatttgcagtttttttagatcataaaaatagaatgttttcagttttgtatatgtgtaaagtgaatgtgtagaattagagctttaaaaatttttgatctggaaacaacctagacatcatctagccccgggcttgtttttacagatgaggaagtgagaaattccgagaagcatagtgactagtgagtcatgtggccattgcagaacaaaagggaagaaattttctgtctcctgtctcccagtgtagggcccctttcactgtcctatgtcatttggatgcataggttgcatttctgctacatgtttggggtttatgacactagctatactccttaaacttgttaaatgaacagccatggttttctagcctagagggaaataagttgtactcaaactctgctcttttggagatatgattttgagctgctttaaccaaaaaaaaacaggctttaaaagctcttcctatacttctgcttacactgagttttaatattctgtcaaacattttaaacttttttctccgatttacttcaggttttcatagagtaaggacattttagaagaacccaagaagcaaatatgttcaagtttttaggctacaccaacacacattttttctgttgatattcaagcataatatatatttaaagcattcaaagttgatccaaactataataaaatcctagcatggctagcaaatttatttcagtttttttttcttgcaaatcttagttttgtttgtgttttaggctaaatgttaaaattaaggaaataaataccaataaattgacatgttcttcctgtggttggtgtgattttaattttaatttatttttctttaagctatcttgagttcatgtaaaatattaattgaaatgaaagttgcttgtaggtttcttatatagtataagaaaaaagactagagatatccctccacctccccattcatctttcttatagcagaagcagtgccccaatttggtgatagtaagagaaggtcattgacatcagcttgcatacgcagctttggtatcatgctaaatagaataagacagtatttaataaattcatcttggacagtgaacactttgaaaggtgagagaagagccaacagggaaggtgaaatgagtttggaagctgattttcacaactgaaaaaattgacaacagatagtttctttatgctgaaactaattggtattgtcaaaattgagctatatcatttccactggaagccacagttcttattagaaaagtgttatgagataagatatttaaggctatttaaatattcgtatgaatcccagacagtaggaggaacagttgtgagagccagttgctaaggacaacccatttcctactttcttcttctccctcttagcagcaacaccaacctttggatcactgccaacctttggaaatccctgtccttggaaggagaataaatgaagccatcatttactgtaacagcatttattccctaagcatttaaaatgggaaaagctttaaaatgtaaaaaagatatacatgcttattatacaaaattcaaattaagaaataaagaagagaataaatgttattcataaacctaccacccagagataaccaccgttaacattttggtgtatattctccaggatcattatagacttatgctgcaattggcttttttatttttttgctatatatatatatatatatacacacacacatatacgtatatatgcatatgtacgtatatatgtatacgtatgtatatatacatatatacacatatatatgtatatatgtatatatatatttgctatatatgtgtatatatacatatatgcatatatatatgcacgcatatatatgtgtatatatacatatatgcatatatatatgcacgcatatatatgtgtatctatatatcctgggtatccttccaatcaataaataatcaatgtcatttttaatgaatgcatattccactggatggttgtactgtaattaatttaggtagattccaaaggatagagttttaggttgcttcaaaagttttttttttttacttagtataagtaatgctatagtaaatcagcaactattgaacacctactctgtcaaggatgtgctaggtgttggagatacagagatacatagcatgcatctcctacatttaggtactgaaagaggaaacaggcatggaaacatgtaattgcaatactgtgtgaggtggacaacaacagagccacatataggcccatgttcacactaaggatggagtgaccccttctgtgtggttacactgagaaatttgaccaaggatgagacagtcttaaagcataagcagttgtttcccaagaatcacctgggagagtgattaagattgctccatcccagttctgtctcccagagagcatgattcagaaggtcaagggtggggcctcaggtggtcctgttgttgcaggtgacctgctcttgacactttgagaaacagacattgggcgtgtgaaggggctaaggtggaattggaaaggggattattgccagatactggaggagcttgactgtcatactgagggctttagattttttttttttttttgataggtgaagtcattgaaggttttgaatgtcatgattagaactgtgtttgagataagctaatctgacagggagagtattatggaaatgttttcccagcttcttgtgcagaggtaatacatttttgttttgctggttatttttatcaacaataaatcaaactaagtgctggccgggcagtgttcagtgcttcccaaacttgaatgtgcttatgaattacctggaatcttgtgaaaatatacattcctacttgatagttcagggttaggatctgagattctgcctttctaacaagctcctaaatgatgttgagggccctaatctgtgcactacacaggagtagatgtgccaaaggagggtttttgattaaatgagaatttccactttattctttacacgtgagtgtgctttatgatcttaagacttcaggaagctcactttgcgatctgttatggtaatatccctaacaaagttctacttccgttgacccctttctctgtgcaaataacatcctgtttactcacgatttactatgtgaaagcttcaatgcagagccaaccaatacatacataactcagagccaattttctagttaagtcttaagtgttttcataaaactgaaaaatgcggctgggtgcggtggcaggtaagggaataggtggagagaaagggaagggcctagggaggagaacgtgagaactccaaaggaaacagtaatgctgtgcttcctaaactgactgtctgatcctaactgactgtctgattcctaaactgagtgtctgatcctaaattgaatgcctggtttggagtccagtgtgttttcatctcagcatgcaaatttaaacccaaagaaagttaggtgcttaaatgctctagggtagctgggctttaagtggctacttatcatagtgtttatttgaatgttagagaaatagcttcaagcaacagaaggcttgacttagagtggtttaaacaaatagggatttaatgtttttgtataattagaagctggcggtagacagatgtttgttttgttgttcttctttgtacctttgtacctttcacatatctaatgagtatttatgtaattaataactaaaacaatgtttaaagattgtttttggaccaggtatggtggctcacacctgtaatcccagcactttgggaggctgaggtgggcggatcacgaggtcaggagttcgagatcagcctgatcaacatggtgaaaccctgtctctactaaaaatacaaaaattagctgggtgtgtggtggcacgcgcctgtagtcccagctactcaggaggctgaggcaggagaatcgcttgaacccgggaggggaaggttggagtgagctgagatcgcgccactgcactccagcctgggcaagagaccatctcaaaacaaaacaaaaaacaacaaaaaaacctgaaaaacgcttttgagtaggaggaactttcacagaataagaggtttgaagttagttaactgtattgagttacaaagccaccattgcttatttcttggtatagttgttccttaatcaaatttcttaatcagatataaccaacagatgaattataaagcagaatttggaatatctgtaactttagagtacctcttttgtctgccttcactacatatatactgtctcttattagatttgaacctttttgcttcaaagtagattctgtgtgttggctagaaagcataaatatcctttagggaagaatacttaaaaaaccagtatcttgtgtagtgttcttgagtaaattcagtgccatagtatatttgttgtcagatttgggagtgagataggtggcaactaaatatatatacagggagcataatacattcaaggagtatacaacttttacattcctatagcacgttagggtttattcaaagtgaggtccttcatttgaccctcagaacagtcatgtgaaataggcagcacaggcatcattacaaatgtgactttacaaatgtgagaaggctgaggctcagagaagtgaaatgatttggctaaggtcaaaagcaagtcacagtgaatgcctggtctggagtccggtgtgttttcatctcagcatgcaaatttaaacccaaagaaagttaggtgcttaaatgctctagggtagctgggctttacgtggctacttaccatagtgtttatttgaatgttagagaaatagcttcaagcaacagaaggcttgacttagagtggtttaaacaaatagggatttaatgtttttgtataattagaagctggaggtaggcagttgctagtgctgattctgctgttcagagacccaggctctttgactttttgctctgccgttttgcatatgttgactttcgttctcaggcttgtctcctcctacttgccaaggtggctgccctagctctgggagaagggtgatggagtgtgtgtgcagtaaggggtggggggtagtgccagcctcatctgtctctcttatcaggaaaagaaaaagctgcccagaaattccaccagctgacttctatttaagtcatattggccagagagttggtacatgtcatcttgtctatcccctgtccatgccccgttcctgccttatgaaaaggcagggaaagtgaatatttagctttgtcaaccttaaaagtagaggcaggcaagggagacaggtggttgacaataggtgttgagtgagccagcctacagtgcctgtcacagtcttaccgtaattctatttggagcaaatagcattggataaacattgagtgcacatcctcatagtttcctgccactgatgaattttgtgattattgcttctgagtgctaggcagctcttttctgctcacttctggggaaagtcaaatttaaagaactataattacatgggagaagagaaggggtgctggattcttaatagttctttgtcagtataactagctcatttttttttgggtgcaatagttacacatctaccttatcatcctttgtaaatgtttattttatgcatgcatgtaaattagttaagaattggaattaaactgtggccgcttgtcttaagaatggtgtaggatcagcaagccttggattgtgtgtgtttgcctagagctgagtgtttttatgaagaagcaaaaacctattcatgagtgtatttaaagctgcagccaagtgacgatgtatattctgtttctcaggtaagtgaaatgtaaagagaagttttggagtcagatggacttgtgctataatcctgggtcacctcctgaaccatggtccctccttttccaagtgaggataggggattcatgacatggcacatggctggcagcaccacagagctgggctaacttcactgtgttttaactctctttctttctagttctttgttttccatacaacaccatggcttgttgaacttggaagctgtttatctatttcccttgataaaaaggtttagtttttgtttcttacagaaaggggaagtaatttaaaagtgttggcccagtggacttcccttttgattaaatacacagcaattatgtttaataaaagagatacaagtgccagataaaattgtcataagttatcactttggagagagcatactctctaccaagaataaaagtgctccctcaaaatggaatccactgacatctctccccatcctccattcgtctccatttcacttcagtaaaccatcttgagtcagagaaagtaaaaggtgccattctagagccattttgaaaggaaaatattaattaagatgtgtgcatctaagagaagaatataggtaaataaaagatcaatcatttttatttttctttttgttatatattttacatatatatacatataaagcaaatttccatatgtagaaattcatgtaattcttaatgaagtcaaggagcgctactttcctgacgtagttgcttttgtgatatttataaagcaggttgtaaaatataagtatatactactatcattttgggttgctagttataatgaagaattcagaacatttatatatatgtactttaaatagtgtgctctggaaacagtttttttgcatacacatttggtaaataatcaagaagcatttccatgataagttggatcttgccatactagggccatttgtgtttattagaagcaaaatgtggaacttcgcaatttagtgttgtagaatgatcatgagaatcaacattaacatgtgaaatatgggccttgagttagaagccttgaaggagaatggaacacatcagtgaagctctaaggcctgttggttttgaagcttattggaaccataccctgcaattcctgttgaactgatcatctttcgattatactgtcatgtataatgatgtggggttttttttggtaattgctgtcctcattcaacattatatattattctttgttttaggggctaaaatgcatttttggaatgcctggctgagattagaattatacatttgagagacagaagaaagcaaactacttcttaacaaaattgaacctgtaactttgacctagtagtctcaggctttcactgaactaaatgaggcagattataaactgtgtattgtttagtggagactttatgttctgttaatactctgaattttaaattgttgtatagattattctatctagtgtacaaattaataccaaattccgtattaattcaagtataattgtactttacaaactcttagcttaaaaacagttttcattatgtgacatgtcagaaatatgcataagtaagtagagtagtataaataaaaaacaaagagcatcctagagcaaagccctatgtgcccatctctcagcttcaacaattctcaactcatggtttcccttgtttcacctgctcctctttccactctcttctttttccaatctggaatcatatcatttttattttatccataaatatttcagcatatgactctaaaagataaagactaatctccagtattaaacagtttgaaatggctattttatatggtagatgtgtaaaatgtgagaatggtgcttaacatcaggcataataaattgcagatcgacgtggttttggtacatgtctgcgttcaagctcattttctataagccaccagttttgctgcttaaagtttggtaatctttgtttacatgcaatttagttaaaatgctaaaagagttttgcatttgctttcctttcattggtggcttttttccagatagaatttgttttgtgtccacagagtgattggtctctgttttacatgaaaatgttatctctaagaatggttccatgtggccactgatgattctccagttgtgcttttctgtcttaaaattaccctctgtattttagagcagatagaaagaagataaaaacccctaaatttgagatttggggtttatgacagacatgtcattttcattagaaaactatatactgcttttagtattttgtgattaagccaaacagtatagttgaacatttccataatgatacctttggggatagaagtatgactccttcttcttcttcttcttcttcttcttcttcttcttcttcttcttcttcttcttcttcttcttcttcttcttcttcttcttcttcttcttctccttctccttcttctttcttcttcctcttcttcctcttcttcttcctccttcttcctcttcctcttcttttttgtttaacttgttatatgttgtatctagttgtgctgaaatagaggatttaatttgcagattaatatgtaaggatgtacattataatgaatttgcattattgtagaagacaatggaggcaatatagagtgtttgtggttcatagtgtggcttctgaggccataccgtcagggtttggctacctgctctaccaactaatagccatagtgtcttggctaagtcacagaacttctaaaatccttagttttcttatctaaaatatcagaataataagggtacctaacttatttttttaatatgcattaaatgagaaaaaaacaaacaaaaattattgtttgctttaattaataagatatttatttgttaatgaacatttttaatgctgtaattacttgtttagtgaccaaaaacataaagattgctggtttctggatgtcaggtgaatatgcattaaaggatttaagtgttaaagcattaagaggcaaatttgttattctgaggtctggtagctactaaatattttatatgagaattttcacatatgtcagatctgtgatccattcagctctagtatcgcatatccaatgttacctcaagaagcatgtgacaggagctgaaactgatttttgttatgtcagaagtggccctagtttacctgaaatcccatttggattcatgatcatgaattcattaaaagttcttatgctacagttgtattttcagtttgtgccatatattatagtaataagttccacaggctcaccatctccgtgtagagaagccacgcattttagctaaaaggcgtctgtccagtttgagaaggtacagctgagctgagttgtagtcttctggcatttgttcccttgcagactgggactaattagatctttctgattggcagggctggatgtcctgatctgaacaccaagtgtagttagttcaaatttcaggtcttggctaactctatgagttcttgggggccttcttgccttaactatgccatgaggtaggttactgggctcaagggtcttgatagatcagaggacagtggaatgctctgaaccaggaaagcaagtactgaaatggaaatcagaaagacacctacctgcttcatgaagttgccagatcccgttcttgggctctgtgaacttatagcttgtcattctctaagtgtactttgttttatttttatcaggttggcatttcacaccccaaagatgcttaatgtgtcatttgcaaaatttgaaacatcagattactcagtctcttctagtccatttataaaatgtactgcaaggctgatcttggcatcatgcccaagagaaccctcatgttttgcccttcttctatctgacaagtacctgttcatccttaactttgtgctctgttcctagttttgtcttcctgatagaacatttttacaatacttataatttattaatataaatgtgtgtgtgtatgtatttcctagtttctttagtccttgactcaaataccctgtgttcgaacctgaactctgatgcttgcaaattggtcatactcaccttttcagcctctgtttcctcaattgtagcataaggataataatagtatttacttcgaaaagttgttgtatacactgcatactgcactgtagagcattcagcacagtacctgccgttcgataaagactcacacaatattactggttttcttattgccatcacctcaatgacataggctgtctttaaccaaagtaacagcatatttctgtctcctttttgttgtattcctgtttgatcttcaatattcattgagtgtctagtatacaactcaagtactgttttccagacactgggaatagtgttaaacaaaacagattctctgctctcatggaatttacaatccagtggaggagaatgagagcacataaataagaataatgatgctagtgattaagtatcgtgaagaatttttagacacatatttcataatttacatatatttaggttgtcatttcatttacttagacagactaaggataagaataagaataagactttggaggaaatgaattactatcacacaaagtcattttcacatctaggatgctttagagccagaaaatggttttgtccatctgtcactgtctgaatacctactggtactcagcaattaattcaagaggacagtgtagtttagattattttgtttcatgtgacaatttctatttggaaagtaatttaaataatagtagaaggtttatgaaccttaattaaatgaagtcttcagctagtataatctgatgggctatagagttttctaactatccattgctattccttaaccagactaagaaggattctgcctcagggccttggcacatgagttctttctttcttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccacatgagttctttctaccaagaatgttcttcctgtagacttttgtaaggtttgctaccccactctgcccttcaccatgctacctaagctagtactttcctcacagcactttctagtcccatacctgcctcacttttctttatagcacttaacacctcctgacatacatgtgtttattgtttgtccccaccactaaaatgtaagctctttgagagcagtaatttgtgtgttttgatcactgctgtatttccagcacttagaagagtgagtacatatagtaagtggccaataaatattcactaactgaataaatacatgcaagacagcttaccaactttacagaggaaatattttagaatctattaagtaggacagtaaattctaagtttaggtgaaatggagctaaagatcatgattgttttcataagaggagtcagaaatagtgattaagatggaatggaatggactgagaagaaataaagtgaatcttgggaaaattaagaaaagaataagaaaacagaatttaatgttgtatatttaaatatattgtccaagagtataaatattcagaaacatttgagtgcagaagatgctgtgggtctcaccaatgtgtgaaagaatagtccttggacctcgggatcattgtctaacttagccctagtacaaaatccctggagaatctgggcaaaataaattgaacacttgacttctcatttcagtttttattactacctcttagtcttttgtgctcttactgttaagttgttttcactcaactaattatttattgtatgtttacaaagtgaaagggttgtcataaataatgttttttcaaaacaagaaaaaaatgctaacttttgacaagcagtaaaatctaagggcttttctggagggtttttcttggaagatgcaagagtaagttgtttggagtggaagtcccattcctacctcaaggctttcctgtctacagtgatttttcttcaaagattgtaagtgttttgtttaagcctttgttgccagtctctcccttactcaactttacttcctgggattttgaaaaaaatctctaaactagggaaacagaaaaatggattaggtacatacacattgagaagtgatgtcttttgggatcgaatttgtgactagctgataatttactcaataataaagatatgtgtttctaaagtgtacccctttcatgataagggctacagacaatagaagtgaagctttttcgaatcagaatccagaatcagtatatgaggagacttttaatctactttattcatcattactcagtacaggttgagtgcttattttgtgtaagacattataaggcataggaagttaactaagaaatgaggaatttataatctagcagaaaaggcaaaaatatacaatctttttgatacaggtcagtactgtaataaataaataaaataaaagctggtgagatgcacaggacaaagggatcactaccagtaaagattcagaaaaggcaagaggcagtaagtgggatttctgttggatcttgcatgagattttccgatgaagtaggatgacaatatatcatgagcagaggcatagagatcgaatattatgggtcacgttcaggcaacagcaatgttccagaagagacagaaggggagccagcgtggaaagtgtaccttaagaaggaaggatatttccaactgagagagagagaggaagcagagaccgagaggataaagattcagagcaatttgaagtgaagacatcaaggagtttctttcaaagcttcaagctcattagatttgggagcaaagttattcattgaaaggaggcagatgagagttatcttcagatcacttattccaataagtttacttcagaaaaatatgtcttgagaggttaggtgcctttccagcttgatacaaaaaactagaatccaggtcctctcatttcgactccaagtgttctttcttgcccaaagtcaaaattccctaaagacctatataccaaaatagtttcctatgttaagcacttcttatcaaacaagtaactttgatctatgcacatgaaatgcaggctagaaaagaaatcatataaaccctcataaactcttatttttagagggaaaaaaggagatttgttgctttcagttaaatgaaaataacagaagcactatgtgtcaaacaaggatggcatactggctgtggctccagagactgttggggcactgagcagccccattttctgcattacgacccttttgtgggcctgatacgcagctatcctaggacagccaaggaagggaattctgggcttgttgctcttgtgaatctatagaccctggaatggatatagttccaaccaatgtcttagttttagttaatttcatgggtttttcagaaccagaagttaggtactcagagtggtttccggtcattcatgctacttggtcatccaagtaattgttggactttaggcagcatggcaagtttgggtttggcagctgtcagtcccaagtgtgaacgtgacattggatcattgatgtcacaggaggacatcaaggagaacaaagagctacagctatacaggaaaaagtttgaggagaaaatattttcctgttttttatctctggaataggcagttccctaatagttttgtaggctaatggattgtttgcccagatataaaagtgaacatactggtatgaagaacaggatgaacttaccactcttggcatttaaaaatgacaaatgccaggcttttccatgtgcatacatgtgtatgctgagactaaaactctccttgagaaaaccctgggacagcatatggggagttctgggaatgaacttctctgattctaagtgagctgagagtcttcacaagagctggagtgtcttgggcttcagagatttcccagcccaggttttcagttacaagctttagtttcagagacagatctcagcatccagctcaggagagtgctgattctgcactcctgttactattgatacactgtacaaaatatatgtttaaaatctgttgatacagttcatgagattttacaaatatggggcatttaacctaaacaaaacatttatggaaagtaccaaaaataaattttggtccatcagtgagccaacaggtgttagcgtgttttgatactaccatttttccccttaatattagcctttgttagttaggcgaaaccacgataattccccagcccaaggttgggaacctttcttaaggatcatataataaatgttttaggattttcagaacatatgatctctattgctactacttaccactagctactgttgtaaaagcagccacagacactatgcaaacgcatggatttgcttatgtttcaataaaactttatttataaaagcagctgatgagccccagtttgcctactcctgctctagtccaatgcctgtattttactaaaataaatctcagaggaatatctggctaaaggttacacagtttcaggcttgggacaaaaatctatgtatcttcctttttactccatttaaatttttttttttttttttttttttttttttttttgagacggagtctcgctttgtcgcccaggctggagtgcagtggcgagatctcggctcactgcaagctcctcctcccgggttcacgccattctcctacctcagtctcctgagtagccgggactacaggtgcccgccaccacgcccagctatttttttttttttttttttttttttttgtatttttagtagagacagggtttcaccgtgttagccgggatggtctcgatctcctgacctcgtgatctgcccgcctcagcctcccaaagtgctgggattacaggcgtgagccacagtgcccggcctttttttttttttttttgagacaaagtctcgctcttgtcgaccaggctggagtgcaatggtgcgatctcggctcactgcaatctccgcctcctgggttcaagcgattcacctgcctcagcctcccgagtagctgggattacaggcatgtaccaccacacccaactaatttttgtatttttagtagagacggtgtttcaccatgttggccaggctggtctcgaactcctggccttaggcgatctgcccacctcggcctcccaaagtgctgggattacaggcgtgagccaccatacctggcccaaaaacaatctttaaacattgttttaggtattaattacataaatactcattagatatgtgaaaggtgcaaagaagaataaaacaaacatctggtgtgaacatcagacagtcagtttaggaagcagagcattactgtttcctttggagttctgcatgttctcctccctaggcccttccctttctctccacttcagaggtattcccttaactgaattttgggttctttattccgttgtttttcttcatggtctcatctcatgtacttgtattctttttgcagggtttaaaaagtcgttcccttagatggttttatttcatttcttttgtattagaaagtttagaaaaaggcagtaaaatttggcttaatggatagtcacagatttcctttattggttttttcttggcaatacactgagcaggcccaggaagtcggagtagggtgcctacagtatatgactttaactcatttcatggcctattcttgggtttcttgtgccatcacagagtgtcatgggctgacagacgagtgtaggagtttagtggctttctactcccaccccacttcctgaggaaatagttgtggtaaatcagggctgtttctagggatggcaaggtatattggtctgacagtgattttatctttgaactaaatgcatatgataatatgtgcataattctgttaattagaaaaaaatttttgaagaaaaattttgtttgttgcatataataaaaatttcaatcttaagaataatatttagtcaattatcaaaagtattattagctctaatatttatgaatatcacatatgtaaatattagatcttagaatgtgatttagatggacacattccttgctttgtaggtagccaaaacttttttagcatctaatttttcagggcatgccataggtgactctgataaagcattttgttgtcttcttgcacaaatgcttcattttttttctccttttttaattttaaaattcttttattatactttaagttctgggataaatgtgcagaatgtgcaggtttgttacataggtatacatgtgccatggtggtttgctgtacccatcaacccgtcatccaggttttaagccccacatgcattaggtatttctcctaatgctatccctcccctagcaccctatcccccaataggccccagtgtgtgatgttcccctccctgtgtccatgtgttctcattgttcaactcacacttatgagtgagaacacgcagtgttcagttttctgttcctgtgttagtttgctgaaaatgatggtttccagcttcatccatgtccctgcaaaggacatgaactcattcttttttatggctgcatagtattccatgctgtatatgtgccacattttctttatctagtctatgattgatgggcatttgggttggttccaagtctttgctattgtaaatagtgctgcagtaagcatacatgtgcatgtgtctttataatagaatgatttataatcctttgggtatatacccagtaatgggattgctgggtcaaatggtatttctggttctagatccttgagaaatcgccatactgtcttccaccaacagtgtaaaagcgttcctatttctccacagccttgccagcatctgttgtttcctaacttcctaataatcgccattctaactggcgtgagatggtatctcattgtggttttgatttgcatttctctaatgaccactgatgatgagctttttttcatatgtttgttggctgcataaatgtcttcttttgagaagtgtctgttcatatccttcacctactttttgatggggttgtttttttcttgtaaatttgtttaagttctttgtagattctggatattagccctttgtcagatggatagattgcaaaaattttctcccaatctgtaggtagcctgttcactctgatgatagtttcttttgctgtgcagaagctctttagtttaattagatcccatttgtcaattttggcttttgttgcaattgctttggtgttttagtcatgacgtctttccccatgcctatgtcctgaatggtattgcctaggttttcttctagcgtttttatggtttcaggtcttacgtttaagtctttaatccatcttgagttaatttttgtgtaaggtgtaaggaaggggcccagtttcagttttctgaatgccagttttcccaatgccatttatcaaatagggaatcctttccctattgctttttttttttgtcaggtttgtcaaagatcagatggttgtagatgtgtggtgttatttctgagttctctgttctgttctattggtctatatctctgttttggtaccagtactatgctgttgtggttcctgtagccttgtagtatagtttgaagtcaggtagcatgatgcctccagctttgttctttttgcttaggattgtcttggctatactggctcttctttggttccatgttaagtttaaactagttttttctaattctgtgaagaaagtcaatggtatcttgatgggaatagcatcgaatctataaattactttgggcagtaaggccattttcacgatgttgattcttcctatccatgagcatggaatgtttttccatttgtttgtgtcgtctcttatttccttgaacagtggtttgtagttcttcttgaagaggtccttcacatcccttgtaagttgtattcctgggtatttttattctgtttgtagcaattgtgaatgggagttcactcatgatttggctctctgtttgtctgttattggtgtataggaatgcttgtgatttttacacatttattttgtatcctgagactttgctgaagttgcttatcagctgaaggagtttttgggctgagatgctggggttttctaaatatacaatcatgttatctgcaaacagagacagagagacatggaacatgtctcaaaataataagagctatttatgacaaacccacagccaacatcataccgaatgggcaaaagctggaaggattccctttgaaaatcagcacaagacaaggatgccctctcttaccactcctattcaacatagtattggaagttctggccagggcaatcaggcaagagaaagaaataaaagatattcaaatagtcttttttctttttctttctttttttttttgacagtgtcttgctctgtcacccaggctgaagtgcagtggtgtgatcttggctcactgcaacctctgacttctgtattcaagccattctcctgcctcagccacctgagtagctgggactacaggcctgtgctaccacgcctggctaacttttgtatttttagtggagacggggtttcacatattggccaggctggtcttgaactcctaatctcaagtgatctacctgcctaactcagtgtaggttgttcctcagggatagtgaaaagtttgagctgatccattcagatacctttaccttcagttactttgggaagtaattggttgctgggttatttctgaccatggcatgggatgaaaagaactgccatgagaggttggcactgtgttccagtatctctctcaattgtctcaaaatatttttcaaatttcaattccaattgtaactaccctagtgcataatttcatattttgattacttcaattcagtaccttcttgtctggccttcttgcctctttttcaatggttctcagttctggctgcacattgaaatcacctgagagctaaactgctaatgcctggtctatcccacagagatttgtatttaattggtctggggcacagcttgagaatattaaaatcaccttacattctaagtactctctagatgattctaatgagcagctaaggttgagggccactgctcttgtacaagagggtcatcttttttaacctatcatctgacgtgagtgatatttgagagggagaatggataagacttgggaagtgatcacatatttagcatgagaaagaagatgagtataagacattgcataggctttgagcttttgcaatggatggatgaaggtgccttttactgagatagcaaaaatagacatgctgcttaagagaaaaaataaggatttagttttgaacgagagaatttgagcaacccatggggaaatccctttgaaaatcacaattgttaggaaatatcagtgctgactagaaataaaataggaatgtattctctattgctaaaaatagtaaagaatccctgccaggtgcttaactttcgcttacatatttctagcaaaagagaatgaattactcattctatctttgggcagctaaaatagtttgaaggttcttccttatattgaccccgcatctgccttgctcctaacctctgtccagtgatccttttgatgtctttggagttattcacaacaagtctactttctcttccatgagatagtcttcaagcctcagaagaaatttactctcaagtgttctcttccttgggcccatggccaccaggtcctcatttaatatgcttgcaataaccatactttctaactcatcttcttatcaagtcagctaaacataaatgttaatgaaataccttagacccgataagcatttcctaatcatgtctttatttaatgacatttaatatcctaacttaaaaaaacctcatgatatatttgcagtatagaagaggtgatattgtctgaaataatgctcttcttttttcttttatactccattatatatttttaaaaattacatttaaaaatagaaaatgtgtgtaaaaatactttatattttgttgaataaaatattcttataattgatttaagaattagctcaacatggtcaagtatttgattgttttgtttcaagattgatgataatggttatttaaaagtctgtaaagttatagaagagaggagtcactcaaggaccaaacacgagactcatgctatttctcttgcagaagatttaatcttcaaggataaatgcggcattcagtttcccactgctgctagtccagaaggtatgcacacatttggataactgagctcccttttcttcccttggaaactgttttgagctcggaatttgttgtttagatcatgatttcatacgtcagaggattggaagtctcctttaggtacttggcagagccaggacatttttccatatatagctggaaaaacctttcttgcccattctggtttgaaagaatgttattaaaagttcattcctgctttcttttctttttctctttttttttttccttttttgctaaggaacagaagtgggcactaaaaattcgtgcctggaagaactaagacttgctccaacatagaggactggctgcgtgttctgagaacctcccctaggtgttctcggtcattccctttatagcactcacaggcacatctgtgggtggcaattattgattccttcctggcccacttcctcctcatggctctgggaagccccacaggctgactttgcagagatgaatcaaggcagtggctaatctcctgagtcatggccagaggctctttggttactctctgaagatgggatctgtttacctcagagttccctctctgagggtatttggaattttggatggtggcctggaattctggagagtggagttctctagggaaaagttgtgctggtagcagtcggcttataaagtttatgctgtctgccctttgataagggtcataggatgtagtaaatattctttgggaaaataaaaagtccagtggaccctcaattctggctttgcaggtactgtgacctccaggcatcagtgtagggaaatgggaagtgagctctctttgaatctctccttcatctgcacctattgtggttctactcagatttcaagctgatcttcaagtgagagtgaggcagactttgtttgaatctttgactttggtcaaagtgtggcgctttggtcaagttaacttgcttatttggacttgctttcttcatctgtaaactggggttaaccatgcctattgcacagggatttaggtgaggattaaatgagattaggtgggttaatgtatacaagatggttagcatatcttcttaggaaagcaagtgtttttagtgaaaaggagatggattttggaaccattcatacttcatttccctggtggatctcttctttcctagctgcacgattgatcactgaagatgcccaagcattttgttctgtaacctttggtttcatcttctgtaaaactgtaccattctcagaggactgttttaagatttaagtggaccatcttgtcctacttgggcaggaattagtagacactcaacaaatattagctcaccttctccaagggctttacccaagccctccttttaccccacgaccatctcagagatgattgctccttttcttgccctttcaggttttttgtttgtttatttttgtttatcagctcacctcaatatctgggtgagaaactctgtttcttactgcacatcagtctcttctctacttgatggtcaattgctttgaagcagaatcttcatcctattcatctctgttctcacaggcttctgatatcaaaccatattcctttattcccggcaacccgaaaatatcccctttcccctcaattcccttaaacttgaattccaggttaattcagagttaatttcttaaccttttctgcctgactcaaatatcctgcaataaatgatgtgagaagtaaatagcttagtgttcaatgtaacgcatattacatttagtatttacttcaaaataaaataacttgtgtttctattattgttctataaaatgtaagagggaagctagaataaagatgatctagaagtggaagctttatattttgatataaaattaatggacaggatgtttatttaaagtaaactaagcctgaacacattgtgaaatgaatcacaatccagaatgttgatattttgggtataatacaccttattcaaaaactccaaaagcacactgattcagtcatcttttaataatactttagttttgggaggctgaggcgggcagatcacttgagctcacaagtttgagaccagcctgggcaacatggggaaaccccatctcgacaaaaatacaaaaattagctggttgcttgcctctttagtcccagctactctggaggctgaggtgggaggatcaactgagcctgggtaggctgaggctgcagtgagctgtgatagtaccactgagctccagcctgggtgacagagtgtgaccctgtctcaaaaaataaataaataaataaataaaataaaaaataaagtttagcaatttagaaaagaaaatatttttttcttgattttcggatattcccttttatatttgagggaatatctgaaaatcaagttttctccaagaatagaaaaaataatcaggtttgcttcagaaattatggtttaaatattaattagaactgcataaaatattgtactttatttacctttggaagatcaccctttgcttccaggcattaagagtatgaattaggccaggatttgggagttgctaatactgttaattattcccctcttttccttctcttgtttctttagcttcctgtccaatttgtgaggaatgcctaataccctgagtctggcacctgaacacttttagcatataatattcactaggataatagatcaagagttttcagtaaaaacattgggcatttgctcagtgacctgcaacatagcctgtgccttttgtcccgagttccagtttatgctgcccttgagtccctgtcagaacacagggagaaacattcccgaccccctggaaagcattccttgcatgcataggagtctctggaaagttatacttttgaagaaaatggagagagccgctaccacttcatacatcttaatgcttccaggattattttctaatgccagtccctttagacctccttaaaaatacatttgagtcacagcattggacacttccacagggaacactgaatctatattaactgccttagctatcacacgaggtgatggctgggaagaaggtgctgtctggaatccatcaacttggttttctgactaggcaagaaaaatgaaaagcaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggaatataaatcttgctgctataaagacacatgcacacgtatgtttattgcggcattattcacaatagcaaagacttggaaccaacccaaatgtcctacaatgatagactggattaagaaaatgtggcacatatacaccatggaatactatgcagccttaaaaaatgatgagttcatgtcctttgtagggacatggatgaaattggaaatcatcattctcagtaaactatcgcaagaacaaaaaaccaaacaccgcatattctcactcataggtgggaattgaacagtgagatcacatggacacaggaaggggaatatcacactctggggaccgtggtggggtggggggtggggggaggggggagggatagcattgggagatatacctaatgctagatgacgagttagtgggtgcagcgcaccagcatggcacatgtatacatatgtaactaacctgcacaatgtgcacatgtaccctaaaacttacagtataataaaaaaaaattaaaaaaaaaaagaaaaatgaaaagctttctcttatgctggatcttcaaattttggtttggaaaatgccttctgactccaacaatgtaagctgaaatatgtagagataaaatgatgggaccaaagctgaaagtgtacattttggcttaatgaataggaaatgaatagcttcccctgtcacacgacttcatgggtgttctctctggaggcagaagtcacttttagttactaggaaaaaaagaaagtcaatgtgaaaacacttggaagatatccatgtatatgttaaacatatttggactccaagggccagtttgccaagttagagtcccgtatgctaatgaagttgctaattctagtctccaccaatgatattcagctgtgggaaaagactgcttcatcactaaagcctttttagcataaaatgcaagtaaaataatagcagcagcaaaaagcaaccagtttacaggggtgttgcaaactgacctaagccaatgtgtcatgagaaacgattaggttctttcaataaataacatttacccatagttagaggtgggcagaggttagctattccactacgcattcccctaccaggttacaataaaagcaagacttgatcaaatttcatcatacatacaatgtttagatatttttaggtaaacatttatcagacagcttgctttataaacttgaggaagtctcaaatgatcaaggaagaaatgctttgtctactcattgcatgaaagatttactcaaggcagtaagaatactctaggggaagaactcaattaactttttaccagaatcctccaaacctatggttggacacaaactatggtagtttagggttcagccttggaccccatggtggaggcaaagttttctctttccttttcataaaagggtagggaatgtcttggttttatatatatatatatatttaaacaattcacccatctcgaatatacattaattttgccagtgatagtccatttttaatatccattatactaattaatatgttactattttaatcaagaaaaactcatttctaacattcattgtgttaattagtaaagcctctggccagactagaaatagagagagttgaagcatttgtagtaaccactgatagtgtggtctttctgattaaatgttagctaaccatcccaggagtatggatccccaattagggtaactgaaacactttagggtatattaagttaatttacacattcgtaatgttggagcatttaagagtaaatcacagacatcatgacatgggtgtaaagaaaaagcaaaaagtgaatatctgatttatatggtagtgaaaatatataggtcctatttgctttcacattaaatttttatgttattttttttttttttgaaatggagttttgttcttgtagtccaggctggagtgcactggcacaatctcggctcacctcaacctctgcctcttgggttcaagtgattctcctgcctcagcctcctgaatagctggaactacaggtgcacgccaccacacccagctagtttttggtatttttagtagagacggggtttcacaatgttggccaggcttgtctcaaacttctgaccttgtgatttgcccgccttggcatcccaaagtgctgggattacagatgtgagccattgtgcccggccatatttttatgttaaaatagtcagcacatgaaagagatactgttaaacaactttatcaaatagcagtcctgtgtcgcagggtgatttattaaatcagttaagtcaataaacagttattgaatacctactgtgtgagggggttacagagatgagaggacacagttcttgtctttggctcactttaactgatgtaagtaggaccacaacataaggcaattgctgcacaatggaagggcgcaccatttattacaggtgaacaggaggctctgcaatagtggcctggaagggagtaacacagtgtctgagaagggcatgttgtttcctcataaataacctggaacatgattcatattgttggaattaagagttggataaagaagcatttatttaaaacgttgtcagggacatggagctcttcccaaggagccaaaataccatttagagttctagagatcctgcattcttgttttgactgcatgctctggacagtttgcagctcaggtaagaacaattccaacttccagatgagattagagcctagaaggggtttaatcttcaaatcatctgctaacttaaaaacaaaatttggaaacagtaatgattaacctgattaaagctgctctcaaggatcaaccagtaaaagaagtgatagcggtgtcaacaataccacataaagtagcaggatttgtatgtcagcagtcccatttttcaagatgccaagtctaaatctatttcctacccatatttaaatgaggagccagttttggaggaattttacttgtcaagtgtgaaagagaggaagagtcagaagacactctttccaagaattctgtggataaaaggagggtttttttttttaaaccaaacctcaaaattttactcttcagaaggagattttttttttttttgaagtccgatggcagcaggatgtgagattcccagttcagtggtgctgggagttaagcagaagaaggtggagatctttcttcttcatagcatgtgctcctttcacagaagcagcttgttaatcgtcaggaaggatttcagacaacctagtgatgatttccagctcaactgcttcccttccatgaggcaccgataccctatttgtgtgtgataaggtgatgatttccctttcatctcaaagctctgactcaagtggttggaggggcttggtgatgcgaaggctgagagagatacagagatgaaggatgatttctttaccaatgacacttctttaggtatctcagttgttattgtttctagaattagtataagatttttcagaggacaataggagaaatagctaagttagcatcagacaatataccagctttagttgctataactaagagcctggtaggcatatgtctgtgattgcttgtggtcatattagtgctgcaacttggagatgttgaaaccttcctttgtcctaaccattaaattcttgaggcaaagattgcctaattcttctctgtgttttacttggtaggagtacattttcagcattcagataacattattttgactacttatcagtaatttgtttcattccttttccacagataatatttgtttttggtagtttccaaaaatgactgatttggtgtttcaagtatttttaagcactgggaaagaatataagttgtttttagctttttatctttctagtttctaggcagtgtggatattccatactggttaagattataggctctggacttaaactctctggattcagtagtggctcagttactcactagctgtaaacatgggcaagtttcttaatgttctctagttttcagttttctcatttataaaacagagatactgatagtatttacatttagggttgttgtgaggaggaaagggaataatccatgctgtacacttatatatgtacaatgcagtccatgcaatggcacatagttagcactcaatatatatcatcatcatcatcatcttcattaccagcagctgcagcagtttagagaccaggacagagtcatggttaagagagcaggctttcagagaaggccaattcaaattgcataccagatactgcccaaaaataagagtgaagggaaaatcaaagatggactctgatgcccggtgcccagcaaaatgatgtaggctaaaaagttattacctgctcaaataaaaaatgggcaaaagaactgaacagatacctcactaaaaatatacatgatgacaagcatatggaaagatgtcatttttgtcattagggaattgcaaattagacaagattaggcatgttcaaggtagtatggctgtagatgagaattgcaaattaaacaacaataagaaaccactgtacacctattagaatggcaaaaatccaaaaaaactgacaataccaattgctggcaagaatgcagagcaaaaggaaccctcattcattgcttctgggaaaacaaaatggaacagccactttaaaagatagtttgacagtttcctacaaagctaaatatagtcttatcacaccagaaattgtactcctagttatttaccaaatggatttgaaaacttgtctacacaaaaacctacatgtgaatgttttgacagctttattaataatttctgaaaactagaaacaacaaaaatgtcctttaataggtgattagataaattgtggtatatcataaaataaaatattattcattgataaacagaaatagctatcaagccacaaaaagaaatggatgaatcttaaatgcatattgctaagtgaaaggctacatactctatggttccaattatatgatattctggaaaagtgactgtagtaatagtaaaactattagtggttgctggcagaggaagcagggttgagtaggtgaagtacagagaattttttagggtggtgatgctattttgtatgatattgtaattatggatatatgatactatgtatttgttaaaacccatagaactttatagtacacagagtgaaccttaatgtatgcaaatgaaaaaataatttaaggggttgggggatcctaggattgaatgcagaatgtgacaagacgataaaaggaaccaaggaaaaggaaccaaggctccttatgtaagtggatgattctaggactgggcaggagatgtacgcgatgaacctgtagtatcttgtagtgccatgaagtaaggaagagcttaaaacaaaacaataacaacaacaaacaaatccacaagaatgggttatatcaaagggacccaggagccaactgaaagagcttccaatggccaacactggaactgtttgagcaacaacataaagtagtactggaacctgccccaccgccaccccaaataaaatagatccgtgagtccatactgatataaagagtacagtgtggaaaggtgggttaaagtaactttacagtggagaaacccaacaaaaactagccaggtgagcaaggttaacctcaacagtgagaaatcatttgatagtatatattctctatacatacatatttatcacttgatatgataaaaatggcaccttacctctgttgtcttcctcctccaaacccataaccccagtctgatcatgagaaaaacatcagataaatcccagttcagggacatgttatataatacttgaccagtactcaaaactaataaggtaatcaaaaacaggaaaagaatgagaaactatcacagccgagaggagcctaaggcggagacatgtcaactaactgcagtgtggtttcctggatgagagcctggaacagaaagagggcgttaggcaaaaactaaggaaattagaagaaaatatggattttagttaatatatcagtaatagttcattaactataaaaacatgtaccataatatgtaagatataaataggagaaacggagtatggagtatataggaactctctgtactattttcattatttttctacagtctgatactgttctaaaaattaaagtttattataaaaaataatggtccatttaaaagaagatttttaacaagggtaaagttggccaggcacggtggctcatgcctgtaatcccagcactttgggaggttgaggcaggcagatagcttgagcccaggagtttgagaccagcctgagcaacatggcgaaactcaatctctgccaaaaaaatcccaaaaaacaaaaaacgaaaaattaaccaggtgaggtagcatgcacctgtagtcccagctactaggggagcctgaggtgggaggatcacttgagcttaggaggttgaggctgcagtgagctgtgattgcaccattgcactccagcctgggcaacagacggagaccctgtctctctctctctctctctctctctctctctccctcacacacacacatacacacacaaagtaaaataatgactcacatacagatataaaaattattatagtgttaaaagattttacttaattcataatgaaggaacaaggcagatgctacaactagtttaaagataaatccaaagatcagatatatttatagatcaaaaatattgaaatgaacatgcaaatggaggcaaaactagcttcttttgctgggaggaaagcaagtcagtttaacctccactggacaggacataatgtgcatgtctatagacaagaattgttttgtattgcaatcggttacctataatttatagagttgtaagacaacacccatagggtcagaatcagatacccagaaggatgttttctagacaatgtatagttttgtactgaagcacaaagattttcttacagggcatttacccacatgtcgtttactatcatgatgttttaacataactaaaaaaatcaaaatcaagatagttattggaagctccacctccttgacaattctaatgatgttcctgtgtcttcaaaacccccactcattgacttcctttatagttgtcattagttctgctccaaaatattttggctgtctgccttcctaacacagagtaagaatgcatttcctagcctctttgaagttaggcatatgacttgtaatcaccaatgatacaagagaggaagtgacttatgttctatccaggaggacattttaagggctggtacaaggtttgctacatttccttttcctgcctgcatgaatggggaaatatgtgtccaaatggagcttctgtatgcctgattctctgagtgactaagaagagcagagcactctcctgatgacctgtgttgaccttgaagcatgaatgagaaataaactcattgtattaagtctctggaagaaaatgacaagttcttagattgcttgggtttgaatcctggctacacaccatttactagttgtgtgatcttgggcaacttccctaacctctttgtgctttgatttccttatctggaaaatgagggtaataataatgcctagccatagggtggtcatgaaaatgaaataagatcatatatattgtcttctggcacaaagtcaatagcaactgggttattgtttatccattggtctttttgactctgcaactcaaaatttatcagtggtccgtcaaattaaacttttgaatatgaaacattaatcacaatgctgttcagaatggcacagctatttctgcaggggagagtgaaagggacagctgttccacagactgtctcagaatgctcattggaagacttgtgtgtatcatctttctctccagtgcttttgatgttgagtggtttgtgaaacatgaagaaactggacactaccatgtagcatgggatgctacatcagtgacaagcagaggacagagtgcctgaggaagactgagatttctttcttggaattggaaattattactatttttctagctcctttgaaatggtaacttcatattttgaaaaaattattaaccaaatggctgcttcattttattgtaacatttctgatgagtgaaacaattgaaattaatggaatgattgcaaaatagagtaagtatataataacatatgcaaaagtacctaaggttgcttgcataggtttatgctgctcaaattattatagttcttacagacagtgtctagtgtaaaaagatacacctgctgtggtcttgtgccctctgaagaatatatatagaactaagggtgaaatgacttggcatattttctataactttgttgcagctgttttccaaaagtgggcaaatatccagcattatttgcaagccaatgtaatgttctttgcaaaccatgaaagcctttcgtattttgatttatgagcaagttaatttcccagctcaatgagaaaggccatggagatgaaattgaatgtatacttatgcctttagtatctagtgattgtacagtcatgtgtcgctaacgacagggcattgttaggcgattttgtcatcatacaaacatcatagagtatactcacattgacagacttagacggtgtagcctattacacacctaggctacatgatacaacctattgctcctaggctacaaagaatgcagcatgttactgtactaaatactgtaggcaattataacacaatggtatttgtgcatctaaacatatctaaaaatagaaaagggacagtaaaaaatacagtattataatctgtcatatatgaggttggttgttgaacaaagcgttatgtggtacatgactgtatttcttctgaaaatttggtttatattgaatgatagcaaaccagcatctatcagttgctgagtgttacttataatggcatggaacctatgaaataggaaaacaagaggcacctctattaattaataggggtccttttcaaagtttcgggtgaaaaattactggttgtggtaagaatgtatgccttgattataaatattggcgtggaaaaatgtcctcatacttaattcaggcggatataagcttttatagttgaattaaataaatggataaaagttcaaaaaatacaaatcaaatttaaataaataaataaataagcatttctttacctaatacttggagaaacaagcatacctgtacttacccaccaaaatctctattttcatgacttaatttctatgcacactccactcttgttccacctctgtacctttgatcacaccgtctctctcacctgacatacacttctttgagtttaatgtacaacagaaactgcatatcttttctgaaatatcagaaaactgaaatccagttcacactgttatttctctcatcagaatttttacaactcttttactgggtatctcataatataacagtcatgaaaacttgtgttattatctttatatttaatgtttctatattttctccttttgtatttgggtggtgttagtgaaggaaagtgccctatctagcagaattctaggtacagatagagacaagtgcaggttgattgataaattcttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctccttacttcccagtaggggcagccgggcagaggcgcccctcacctcccggacggggcggctggccgggcagggggctgacccccccacccccccacctccctcccggacggggcggctggctgggcagaggggctcctcacttcccagtaggggcggccgggcagaggcgcccctcacctcccggacggggtggctggccgggcagggggctgacccccccacctccctcccggacggggcggctggccgggcagaggggctcctcacttcccagtaggggcggccgggcagaggcgcccctcacctcccagacggggcggctggccgggcggggggctgacccccccacctccctcccagatggggcggctggccgggcggggggctgacccccccacctccctcccggaccgggcggctggccgggcagaggggctcctcacttcccagtaggggcggccgggcagaggcgcccctcacctcccagacggggcggctggccgggcggagggctgacccccccacctccctaccggacggggcggctggccaggctgaggggctcctcacttcccagtaggggcggccgggcagaggcgcccctcacctcccggacggggcggctggccgggcggggggctgaccccccacctccctcccggatggggcggctggccgggcggggggctgaccccccccacctccctcccggacggggtggctgccgggcggagacgctcctcacttcccagatggggtggctgccgggtggagaggctcctcacttctcagacggggcagctgccggtcggagggtctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagagtcgctccccacatctcagacgatgggcggccgggcagagacgctcctcacttcctagatgtgatggcggctgggaagaggcgctcctcacttcctagatgggatggcggccgggcgcagacgctcctcactttccagactgggcagccaggcagagaggctcctcacatcccagacgatgggcggccaggcagagatgctcctcacttcccagacggggtggcggccgggcagaggctgcaatcttggcaccctgggaggccaaggcaggcggctgggaggtgtaggttgtagcgagccgagatcacgccattgcactccagcctgggcaccattgagcactgagtgaacgagactccgtctgcaatcccggcacctcgggaggccaaggctggcggatcactcgcggttaggggctggagaccggcccggccaacacagcgaaaccccgtctccaccaagaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagagggagagggagagggagagggagagggagagggagaggcccccttacatttttgcacgcaaggcaagtgcttcactagctttaccctagccgtaggcctgatctttgaaaatcaagaccttgtctctgctgcagcttcaatgtctttgttcctcctgagcaggctctgattgataaattcttaattgagagcagtcatatcacaaatacacaaacatcttttcaggtgaaccctccactggtattgacaatggagaaagctctgagaaattcacctttagatttgagttaatttgagttgtggtaaatcttagtaacaacaacaaacagtagcactaaaatgtatgtagatgcattaggctaagtattttatgtgtatcactctatttaatctttacaacaacccatgagcaatactattattattgatacagcactttatagaccagggaactgaagtacagagggctaaacttgtttaatgaagcgctcacagggtcgagaccggctccagttcactgttgagcactgtgcaggcctgcctgtcagcacagggagagcaacagttgaatttagcatccttcttatctgggggggtcatgagtaggaacgtattcattatattctgaggacttaagtggttgactgaaaacccagagcatttcaggtattacatctagagtttttaacgttacatttagatattacatttagggtttccataatatttgagaataatctagaactgatcatagaataaagtgaaaggaatgcaaatttctagctgattccctacccatttgttgaataaattcgggcaatcaaacaatctgaaatgtagcataatattatggctttggtttttaagatggaaaaagtgatttataaatgaacagattaagaatcagttttttacttttcctgatgggcttttgtggacactgttgtagttctcaataatcttgaatttatgaatgtgccggctaggaaattatcaacaccacatgctgtttcccacactgaaaacttttaagtattgagaaaaaaaatctgtatttatatgggtgataaagtgaaaaatataaaataaaattttcagagttgtgagggatttgtttatgtgctatagaagtatattggagaagttttaaaaactggttggttaaaaaaaatcagttagcttgaattttgagtggggtgtttcagttctagctagtggattgcttaatcatcaacattcagcttctgagaagaaatttcttcccaagtgaatacagtagactcttggctttcccagatttaacattttcagtttctattatttgggaatgaactttaagctcttcaatgtggtgatttgtaattgggtcaaatcataaatatgacagtgagaatgcaagactaatttgttggagccactcctagccaaggagaaagcctgtacccacatcttctcaagtgtgtatcttatggaggaaatcatatgttgtagtggtatttacaaaagcctgaggacatccatcataaatgttaatggtctgctagttgtacttaaactacaacttttctccatgcactcactaacactccctccctccctccctccctcagacctcctctacaccagagcctcctgccaaaccttcccacacctttgtcattaaccctttttatttcaatctctcttttagctggagacctgatttttctactcagttttaaatgctcttaagtatcatattttgtcactctatttgtagcacatctgtcctttcttctggatcttaaatacattctgaatgaaattcagtcttgttttgaaggtcagctttccttctattcaaaccatgtttgtcagttatggcttttggtttgtctttgagggggtcttgttttccctctcatctttatgaatccttacttgctgctctgcaacatgtgtaaatttcttgttcacagcatgtcagcaaataacttgtcaagcttcagtggctcactgtgatttttttctacctccaaagagtatatgagtagattcaataacatgctgtagagccccaaaccaaccctgtgggagaggtcagagttaccctcagattttgtagtagagactcaggaataagtagtgacacatagacagaaaacatcagaatgtgacaagcaatggctgaacccacttgtggattttgcactgccattttacctctttaggcaaaataagaggtttctgtttctgagcctagtctattcccttagaacctttccatgttatcctttatctttatgcaatgtttcccatatgtcagccattcatggccattcaccatcccattttttgttatgagctttcaaactcaaattataatttacgtgatatttaaaaaatttgtctctttaactttgtattcatttgatgttgccttttctaaccgtgaccataaataaaaacccactatcacatggcacaaacataaataagatcaaaagtagtatttttatcatttgtctactattggcctgcgcatttgctgaaactgcagcctattgtttctttcttgaaactggggagtaggaagccttctggttatcagttgctgcaaaacaagccacccaaaacttagtggtttaaaataatactttattactatcactcacatttttgtgggttgacttggctatcctgtggtactcgtttgggtttggcatgaggtttcatttgacagctggggcagggattatctgaaggcttgattgggctggatgttcatggtggttgtcttatttggctgggcaagggctgctacctgttagctgggaccgcctgaagctatttcctgtagtgcctacacgttgcttcttcatatggtttgtcatcacatgtggcagctaagttccaagagtgagtgctcaaagaagtcttcgtggacactgaggtttcttaggatctaggctctgaagtcccacaacatcttaaccactttctattgatttagtctagttcagattcaaggaaaatagtagggaagaatttgtggccatctttttatctatcacagttattgtcagaggggtgttaaagaatagcaaacttaaatgttctttgtgatgtaatcagagggattgaaagagaactgaaaggggaatggcattctaccatgtcatttaatgttatttaattctgtctccattcattgctttaactcatcttggcaccaccaatgtcagtgagcccctcctcaatgtattcaccctcttctgtgatgcttcatatctctttcctttgggatttcaagaagaatttggttgatatgttcttctatcattttgagggttaccttctgtcttttcctaatgctaaaaatacaaagaagaaaggtagaaaagcaaaagtagcattgtaatgaacaaaattagtgttttcaaggcaaacagccaagtattacataagccaactcacagggcatttttacaaaaattctggagaaatggctatgctggtttccagatttagaaacctctctggctcacttgaaaggactacttgggaggagggatcctatcactagacaccttccttcatgggtcaaacttttgattcaagtgtgcatgggtgagatactaagatgaaataatttgagtgtcaaaatctatgtttattatggaaaattttaaggttatattgtttctcaggaataacccaaacagacactgatgactagcattagtgacgttatggccagattatgtgaaaattgacaagcaaatatggtgtagttttcccctcttttaggaaaagcacaaagaaggatccattttgtgaaaaatgcacaaactcttaaggttaaatttagaaccaagggtcatttttaaatgaagtttgatggtatgatttttttgactggtatattgctttatatctgcatctagtcattatatgcatatatttcaaccaaaggtatacagttttagaaacttcctttcatcaagtttcaatttttccttttgcatttattgctcaatacatgattagtcatgagtaagcatccagaatgatatatgtattagctcttcactttggacaagaaatttcttccaatttatataatcactcaacatgacttaattgtcatggttaaatctccttgactctgtactcagtggcattaagcaagcaaatgttgcttatttttcactaagtactaactatgaagagctgttaggagcctctaggaagttaacttacatgaaaattctctcttgaccccattatatttttaaagaagtatagatactagccaatgctgggactatgtcttagataaatattcaagatgctctgagtggaatctgtgctaacattattaccactggtatagtttttgctctgaagatttatgaaatggattattattttgaaagtgttaagcactgttaggggactctcttttttttgacttggactggatcccacaattctaaaagtatttatgaaaacaatatgatgaaatgttaatgatggaagtgtatccttgaactttgattttaaaaaggtgttaaatcactgatgagtccttgtcttcacctttgcttagttccaagattaaactcagtcataaacatgatatttataaagagtttctcataacttagatattacaatagtaaatgaagcaacagaatcgattcacaattatgtatacaactcagtacaacaattcaaaaataaatatgcctagaaaaatacctggaaaaatataccaccatgtcaatagtcattgccttctgtttggattatattgtttcccctttggtaatctttttctttacacttttctttaattttttcaacttttctataatgaaaacattttagcattggcatgtgtcacttaactaaatgagattctgtgattgctaatgtatatgcttcagtgaattgttagtttttaaattatgttaatgaataaacagtttccaggccagtcattttctagcctcattaatgccatagtgacatttgttatactgtactgaacgattttatataagagacttgagcattcttgaatttggtatccttctggggtcctggaaccaatcccccatggatatggagggccgactgtaaacgccttctcctgatttgggttttatacatttgtatcagcagtcttataaacaccctagaaggaagctccaccttccagaagatgaggcagcatgctccttaactgttgaatgaagattctttcctgtttccactctttgtttggtgggcaggaaggctcctgctcttcagttggaagtggctgcagctgttattagcagataagcaggagtggcctggccatttctgtgactcacagtgacttagtgggattcatatcaagaattccttccttttctcttgacagttttcaggtacttcagaaggttaggtagaagggatatgagtgattaagatatattttataggaataattgaaagctgggcatttgatgtgttttgattttagaacagagtactggacagcttcacatttggattctgggcaggtatgaattctaatgagagagttaaaaatagtgctaggtaactagtaaagtaagtgacacagagactttcctttagttcttcgtccatctttgtttctcattcgttgacttgcattgcctcatcctttatctactctatcagtgtgaggttatagaataatagagagaaaaagaaaacaaaaataacatacttaatttcaatttatttattgaatcaaacattacctaaagttgttcttttgacattttttctcctgtgatacacagatgtctcactgagtatcaaatagtgagagggaaaaagattcccatggggtgaatctgcatggaagagtgtgcattaatctgtgcaaatgcctactaatcttggaacttctgaagtaaagaaaaatccattactactgctctatataaatattaacaacctaaaagtaacttaagtgatctgcaatggaatatgtgccatttagatcttttaactacttcacactttcataagacttaccacatatcccaacctcccactttaaatagacgtttttgaaaatatcagtcaaggagaatctttaattactacattgcttcagggaaacatacaattttggtaataagaaacactacttcaacagatctgttcttcacaaaatagagtacatgcaaatgatatgactgaactcaaattcagatgtttggcagttgagctatttggtgaaatgtcttgagggaaagatctttgggttcttttatacttgatgactttaaatctgtgaaaactaaggggctaaaataaaatgaaataactgggtcttttgtttttcttcttaatagtttattgtgtaaagaggcctcgttttcctactataccttattctttgatgcttttcatttccttgtatgttttggaaaaataatgtatgttcatagaactctaggcaccatacagcgacaattggtcaggccttctgagctgcaacacactgcagatgtgaggaagaattgtaatcagtaggtcatctgcctgcataattttcagggagccatcttgctcctaccaggacacatatggaggggcatgtttgcaattttattaataacatttttaactcacaaaagttcccacataaggaggccagcactgtcaaagttcttttttctatctgggaagggcttatttggtttattgtgccttctatgatcttgttttctataaagataggctgctaaaagtggtagacagttactctttactctatgccctattctacatcagtgctgaatgagcaggggctgtggacagaaggtcatgagggaggggtcagttggagggtggcagggcaggtaagtgaagggtttgggctaagtcacattatatgctcaccctcttaagtttcgtgtggtaaattccagctggaataaaaataagagccaccttgattgggaaaagaaactgggaggtgtctcggaagggaagatagagcctaagaagcagtatctattgctagcaagaaagcctgggctccctttgcccccataaaagtgtttagatctggtcggtgaaagtcagacttaaactttcctcacccacctcagagcagcattctggaatagttgctatcatttatagtgctctgaggatatttcaggttttgtttttttctttaaaggataaagtcattgatagaactataattacaaggaggctcagctgttgctgtaggtggtaacaacttataaggcagtctacaccggctgatcttcaattaaattattcatttctgcatgcaaattccacccattcttttcctttttatggcagaagctaccagtacctttatacaaatgatcttggtggggttcctgtcttcctgtttggagatggccttattgagtatgattcaagaaatagacagacctcttgccttcctcataccaacctacaaccatccaaccaaccaaccaaccaaccaaccaaccacccacccacccacccacccacccaaccatccaatcacccaaccaaccaatgatctaaccttttcataggacagaggcctttattcccagttttaaattcagtgggaagcataaaggactatgataaaattatttcttgaatgtcttattactacacaggtcagttgaacatgaaaggggaagtggagaggtttaaattgttaaggttaaaattgtcaaaattggagggctgtggtcattttacataatttacatatgtatattcaattttgtttaaggctagattgtaaaatatcctgcatagagcagaactggactattttaaaggaaattcttttgaatgggtaatgagcaagacatgatgtgaccaaaggacctgaaaaactgccaatttctcagttttaggcttctgtgatcttccccatactttctctgttgggtcattgctactcatattgattgcacggtcctctgatactcactcattccacagttaccatctgatgagatgtggctagtttcagtgctctgattctgttgaatgagattatgcagtgaacttgggtattttcttcagcttgtgatggtttaggaattgctgtctaggacctctttttatactgcactgaacacagttatttcccattttgaggtacttacacttttttgacaactattttttaaaaatttaatttaattttaagttctgggacacgtgcaggacgtggaggtttgttacataagtaaacatgtgccatggtggtatgctgtacctgtcacccaccacctagattttaagtcctgcatgcattgactatttctccagatgctctccgtccccctaccccccaaacccagcaggccccagtgtgtgctgttcccctccctgtgtccatgtgttttcattgttcagcttccgcttataagtgagaacatgcagtgtctggttttctgttcctgctaactcactattttgcatgtgtatagaaaggcgtttttaacttacttcaactcaagatcaatttcttagtcacctactatgcacaagacactattccaggtattgcaggaattaaaaggtaagtgagacatgggctgtggcagtaaattggtattaaagcaggattgggagatggcattcagaatggtgaagaaataggagagcatgttaggtacttcactgtgagtgttaaaaggaaaaagagatcacctgaaactgggaggcatcctgatttgcttaggtctgctggttttgttttggtgaggtttagggccaatcaacaaaaacaataagttagaatttcataaaggaaatagtttaaagtatctactcctagaaacaaagtatgtgtgagaggagcagttattggctgtctgctttttaaaatgcttgcccttgacttaaaggtatgaaaagagaattttaaaaaatttcagtgagtgtggtgggcactatatcctagttgattcttaattattcaggagctaaatatcaagttggagaattatctaagttgttctctttttctctttcttttattcctgactcccatctgatgtttgtgttgtttcttttttttttcttttcttttttttttttttttgagacggagtctctctctgttgcccaggctggagcgcagtggtgcgatctcggctcactgcaaactccacctcccgggttcacgccattttcctgcctcagcctctcaagtagctgggactacaggcgcctgccacgacgcccagctaattttttgtatttttagtagaaacggggtttcgccgtgttagctagtatgtgttgtttctatatactaattgcctcagagctggtagaaaggaaataacaagattaatagattaattgcaaatctttagctatattagttaaggaaaaggctgtgatatttgggcaaaatgagggtaattggtgaattgactatttgttctggttcattatcatcgtggataattgagagctaatggaagtcattggaactgggcctgcagggtgatttaagatcagaatgtttcttaagggtgggaagaaggttcttgatgtgatacagtacagagctctttcttattctatattaaatgctcataatggtagactggataattgtctatataataattgtctatatatatataatggcctctataataattttgtaaagtcttactttcttcctttctatatattttttgggtacagtatttaagttactgagcttaaaataaacttcctgaaagagtaatctgggttaaaaatggttatagctgcagaaatacatactgtgaattgctcccggaaatctgtacggcaaatgtaagagcattttggctcaacacacttaactctaatgcatctcatccaattagagtttatggcaactgtcattcaatattagcagctatacttaaaatatgagtgttttaaaatgattgtgtttatggtttctttcttatctcagtaaaaacagtttggtttgccagcaagtttttttgtttgttttttgttaggtaccttctaggttgtaaatggacaggaagctgtctatcaagagatttctttcttcagctcttttaaaagtagtgtgagctggggatgatatataatatgataaaatacctaatggatccctgaatccactttcattgagttcatggaagtttgtaaatgtgcagctgtagtggcagagtgtttatcagtgctgagaatatcactgttcttgcttttgactttgtgaagtcggcatattcacatccacaacgcctttcttgtaaccatagcaaccaagacagaaggtttctttttttctctctcatattcaaaagcactattaagatgatagattttatttgaatgaggtatttgcagataagagaggcataaacttaaattctgacctctggataagtttttttttcttcgttaggaaagaaaaatattttatagttgacaaaaacattttataggtgacaaaaattgtatatatttatggtataccaagtaatgttttcatatatgtatatgttgtgaaatgattaaatcaagcaaattaacatatcagtcacctcacatacgtatcattctttgtgagaacatttaatatcacttttacttctgtacagcaaaagaaactatcaacagagtaaacagacaacctatagaataggagaaaatatctgcaaattctgcatctgacaagggtttaatattcagaatctaaatgaacttaaattaacaagcaagaaacaaacaactccattagaaagtgggcaaaggacatgaacagacactttttcaaaagacgacatacactcggccaactagcatatgaaaaaatgctcaacatcactcgtcatttgagaaatgcaaatcaaaaccacaacgagataccatcttacaccagacagaatggctgttatgaaaaagtaaagaaataacaggtcctggtgagtttgcagagaaaagagaacacttatacactgctggggtgggaatgtaaattagttcagccactgtgaaaagcagtgtggcaatttctcaaagaatttaaaacagaattaccattctgtatacacccaaaggaatataattaattctgccctaaagactcatgtatgcttatgacaacaatattcacaatagcaaagacatggaatcaacctaaatgcccatcagtggtagactggataaagaaaatgtggtgcatagacaccataggatgctattaatatgtaaccataaaaagaacaagatcttgttctttgcagcaacatagatggagccagaggccataatcctaagtgaactaatgcaggaacataaaaccaaatactgcatattctcacttataagtgggaactgaacattgagaacacatggacacaaaggggaacaacagacacgggaacctatttgagggtagagggtgggagaagggagaggatcgaaaaactacctatcgggtaccatgcttattaccggggtgacaaaataatctgtacacccaacccctgtgacacacaatttacctatacaacaaacctgcatgtgtaccccttgaacgtaaaagttaaaagagaatctctcttagtgaatttcagctataccatatgttattacagaccatagtcaccatgctatacaatagatctcccaaacttatttattctatctgacactttgcaccccttgaccaacatctcccacctatgccagttcccagtgtctggcagctgtcattctactatctacttctaaagttcagcttttttagattccacatataagtgagatcatgcagtatttgttcttctgttcctagcttatttcacttagcataattcctccaggttcattcatgttgtcacaaatgacaggatcccttttttccagctgagtagtattctattgtgtgtatgtatacatatattaaacaccccccccctcacattttctttatccattcatgcattgatggacacttaggttgataccgcatcttagctatcatgaatagtgctgcagtgcatggagtgcagatatctcttcagcatattgatttcatttcctttagatgtacaccaacaagtggtattgctggattatatgataattctatttttaattttttgataaacctccattgttttccatagtggctatattaatttatatttccaccaacaatgtacaagcctttccttttttccgcatatctttccagcacttatctgttgacaataactattctaatgggcatgaggtaatatcttattttggtttaatttgcattttcttgatgattagtgatgttgaacatgttttcatatacccgttggccatttgtatgtcttttgagaaatgtctgttcaagtcttttccctgttttaaaattgagttatttgttttcttgctattgagttgcctaagtttcttatatattttgaatattaacttcttatcagatgtacagtctgcagatattttctaccattctgtgagttgtctcttcactctgttgattgtttcctttgctgtgccagaactttttagttttatgtaattccgtttgtctatttttgcttttgttgcttgtgcttttaaggtgcttaaggttttttgcttgtgcttttaaagtcatatacaaaaaaatcattgcctagaccaatgtcacgtagctttccccctgtgttttctgctagtagttttatagtttcaggtcctatatttaagtcttcaatctgctttgagttgctttttgaatttggtgtgagataaaggtccattttctttcttctgcatatggatacccagttttcccagaactatttattgaagagactgtcctttcttcattgtgtgttcttagcacacttgccaaagatcaattgaccataaatgcataaatttatttctgggatgtctattctgttctgttgatttatgtatgctactttatgccagtagcacactgtctcaactactgttgcttttaggatgttttgaaatcaagaagtgggcttccagctttgttctttttcaagattgtttttgctatttggggtcctgtaatatcctttatgaattttagaactgctttttctgtgtctgtgagaaatgtcattgaaattttggtggggattgcattgaatctgtacaccatttgcataggatggacattttaacaatgttattttttccaatctatgcgcatggataatctttccatttatttatgtcttcttcaatttctctcattaatcttttgtagttttcattgtacagatctttcacctccttgggtaaaattattcctaagtattttgtttctttgaagctattgtaaatgggctggataaattttgttaagcctctttgtctcatctccctcaccagctacttctgttgatttgggtcaccaagcacactataatgttttctgccatatcatccttgaaatgttgcagagattgtttggacaaagacattttaaaaataaaccttagacatagaattttgaaaacaaacataaactatacacagctacaatgaaagattaaatataaatcagtcaggtgctttacaaaaggattaaaagaacttacggtccattagtgccaaagagaaggctataaaataaaaccaagagaaggatcaaggattttttttccatgtacaggaatgaatgaaggacttggggtcccataatgtttcctaaatatttaaggtggtattagtgtggctgtgctcactttgtgcattgtacttgggacctgttgggcaacaacccaagtctggagatgaatagagaagttactcccacgtcactggcacagaccttcaactctgacatgatcacatctatgtctcacagatatcttacattttacaagtttaaatttcttaatcttcccctagaattatagttcttttccagtcttcatgagtcaataattcttctatcttcttaggaccttgggagccatctttgacatgttcttttacattcagtgcatcatcagtttatgttcattgtacttccaaagtgtatgtttaccaacttccacatccacctccattgtcatactgtagtattccaagccactgactcttgcatttgaacttctatagtaacctcctcattgctcttgtatcttccataagagtttcttccaaaattccagaatagtttcctcaaacttgtctccacagaagcgaatatgtagaatatggtacaagctttgctgctgtgatgtagtattctctaaatagagtgtttcagacaagatagacatttaattatccctcaaataatatccaagctaggcaaggggtctttagcttttttgggttgtcctaccatcctcaaaacacggtttttatcttgggcccaaatctccacttgttgccatctcctaccagcagttggtggggaaagggccaggggaacacatacctagtcctttcaaggggaatacctggaagcttggagagtttatataacttcctgaaggtcacacagctgtttagtggcagggctgattggatctgaggtttgtgtgattcagaagccactagatctcttttatggggaaagaaagataatgcatagctgttgcattccaagttgacactgaagctattaaaacccatattttgaaataattgtgcaaagtttcattaatctcaagtggagacaagaaaatggcaatattaagagtggaaagataaatagaaataagaacatttgagtttgtgaacacaaatggttggaatgatcctgtttgtaagttgtgaattatagggaacagatattaaatatttcataagaaaataacataccttccattaatgggggtggtggtgagaaggaggatcaatggcactatctccagtgggagttcttaactgggatgaagcaatgttctcaataaaatacttaattttctatttattttcttgattacatccatttaatagttttagtagagagatgtcggtaagtataagcaactgctgctttcctaacatcaagtagaggacaggtgaaatcagattttaggatacctacagcagtgtctcttaaccctgaatgcacattagaatgacctgggagcatttaaaaagcccagatccagggttgcctccgcaattacaaaatcagaattctgggaatgggacctgtatttgttttccatggctgccataacaaagtaccacagtctgggtgacttaaacgacagaagttgatttttttcatagttttggagggtagaagtccaggatttaggtgttggcaggtttggtttcttctgaggcttctcttctctgccatcttctcctcctggtttcttcatgtggtcttccctctgtacccatccgtatcctgttctccttcctttataagaacaacagtcttattagagtagggccaccctaatgacctctttttacctttttacataacccatctccaaatacagtcacatgttgaggtactggggattgggacttcaacagactttttttttttttttttttttggcagaggaggggacacacaattcaacttataacaggattaaagcatcagtgtttttaatcggccactgtcttcccccaagtgattctaatatgcagccaaatttgagagtcaatgccctaggtgggattctcaaacctggctgcgttagaatcacctgggtaacttaaacaacccccaaaaacagcacataccaatacttaggcatcagcctcagagatgtgatttgatccgtgtggggtgggatgttgttagtttacagagtctcccaggtgattttaatgtgtaaccaggtttgagtatcactgcactaatatgtgtttcttaactgtataaatggaagcatatttcttacctttctccaaattgttttttttgaaaatttttaataaatgcaagttattttaatgaaagatatatatttaatgatgtagtattcaggtctaaaaaatgaacaaaatacttttaaggtgttatgtttcaaatcaaatgtgggttttgtgatataattttctttgtgacttatagtccttttttgcttaatgaaaataaatcaaaagaacttgggcctatcactcagaaagcaaatgaagtgaagaaactgacactttaatgattaagttgactaaagtgtcacagcttttagtgaggtaatttcttgattaaagaaatgatgtttttcagctttcagaaggaggctagactttcctttccagatgatatcaaaatctgataacaattccttgatttattcaggccaatttctgtgttttgaagtaaagccacttatctggcatttttcattaaggcttgacaacagctggctgcttcccagaatgcagtgctgtgacagagattatgttataaagccatggatcagctgcctttgtaatttgcttaaattgattatgtgtacatttcttcactctctggacttaaaagaagcctgcatttgggtgaggaaacagtattattatttcaatgacaaaagaccatgtctattacgccatattacacatagacacactgccttttccattgtgctctaatagtatttttagtttcaatctttttggaaagttattttaaatactatgatttctatttcggctgaattttgtagctttaatcaaataattaaagaagcaatatttaagatcagaaaagcattatttaaatgatgaaagtatacagtcttaggaaagtagttgatttttatttgtcctttctgtatgttaatatctgatacagatacttgctgatatgctttttaagttaaaaaaaaactaataagtaatcattatctaaagttgcagggagcccatatcttgctgaaagttctacaagaattccaagcactgagattaaactagacatctataccaataagtttagataccttgtttaaaaacaaatgttgccctagaagtacactagcaaagtacccaaagagaggaaccaaattatgggttttccttttattgaactaagtagtgacctgggaagcaagtgcccccatgcactgaggtaatgattttatcaatgaaggggaatactattttttttttttttgagacagggtctcgctgtgttgcccagcctggagtgcagtagtgcaatcacagctctctgcagctttgacctcccaggcttgagcaattttcccaccttagcctcccaagtagctggggctgcagatgtgtgatatcatgcccagataatttttcatttttttatagagatagggtcttactatgtttcccaggctggtctcgaactctgggctcaagcaatcctcctatcttccaaagtgttagattactggcgtgggccactgcacctggctgggagctacttttggttgaaaattgattaaataaaaaagaatgagaaatgaggttttgtgttttagttttaatcattttcaccttggaacaagaaggtgcgatttggccagcaactcaaagctgctgtaattcccactaattatgtgggttagccctcaccattctgctttctctctctctctctcccattgttggagcattaacatcttagccccactggtgcctttaatactgtttggaattattttattcatatcttggggatccctatacagtggcatctaagcttagctacccacagagatcccctggggaacctgttagtcatgacctcccaggttcatcctcgacctactgaatcagagtttctggggatggaactggggagtctctctgtttcagttggtgattcttggtgcagtcagccttccttcactcttttctctcattgatttgtcccatttcattgatttgtgccatttgctagaagaatcactttgtttttaactgtttgttctggtatttacctcctcatgtgaagaatatttccttttgttacattagaaacattctctagatagtcattgtctttctttgaatttcacaggaaagggctccctggtcacaaagcaaacccctccacttttgcttttcaatcagtccatttccatctttagttttccttttcaccaccatttaacttttttaaaaaattgcatcttgcccctttgccttttaacaaacgtagatctccccatctagaaaattcattcctccgtattgccactaccactgaatttctcattctttccccaccaaacttccagaaagaatgatttatttcttccattccactaaaatttatggttcttgttcttaccactctaagcctgctcccattgctaatttccccctgtaattatgaaatcaatttctccctatagcagttatattggcatttcaaagcaggaaataaaaagtatgacgagaactatgaaaggaaaaggtttttattgatcttttttagaaatgaaatttgaaatacacaagggacgcatgaattttatctttcatgaacatttgatgagtaagtgtgggtgccccagtaaagattctggcttcctgcaaaggataaggtcagaagtactgtcctgatttatccttgatgtgttcatcacaggttctcttgtctaatggcccataactaagtgaggctttgattatggtatctaatgatgaataatcaaagtttattgcaagatgttttaaccagacttctcctgatttggaaattttttcctgttattacaatgcagtaatccccttataatagaatatcaagccaggtgtagtggctaacacctgcaatcccattactttgggaggcccagctgggaggattgcttgagcctgggagtttgagaacagcctgggcagtatagtgagaccttgtctgtacaaaaaaacaaaaaattagccaagtgcagtggcatgcgtgggattgtcgggggtgggggagcctggaatcacttgcgcccaggaggtggaggttgcagtgagccagattgtgccactgcgctctagtctgagtgacagagtgagaccctctctcaaaaaaaaaaaaaaaaaaaaaatcagaattcccacattctctgcagttgtctgtaatttataaactatttttatttttcattatttcttgattatttaaattttaaaaattatggtgaaagtattacatgaaaataattattaaatacttctataagacacacacacacacacatacatatttcttcactctcttctcccattgatttgtcccatttcattgatttgtgccatttgctagaagaatcacttcgtttttaactgtttgttctggtatttacctcctcatgtgaaaataatattcctcttgttaaatcaatttactttctataggatatgttaggatttttactcatttaaaccttatacttcctatacctttcctcacttcttccatatataattgattatgtctaaatttttggttacatctttttttttttttttttttgttactttgttgtgactacataagtgctttccagtgttgagtgatctgcactggaatgtgtggctgccttttgtatttacttttgttgtcagttttacctagagttagtaattgcctcattttttcctttgtttaattttctttgaatgtctaagtcttctaatatccccaaacagttctgtaaaatatctctcattacagtgttctgtgtggtcaaacagtcagataatttaccagctcctttttcattcctcctccttggagccctttgcttcctgccccagcatgcactgtgctctctgggcataaggcacagctgtcactctgggaatgtccattgcctctcttctctgtttcctaaatccattttctcttcttggtttattcctttgttttggaggagtatatcctttagtgacttcttgagaaaggttacttgtaaaatgaattctttagagtttgcgtatctgggtagatagcttgcatagactagttcagtgcaggaggatcaaacaagttagccggatttttcactgaggccctctcaacatatcattctgcataagtcttttttcttttttctgaagagacaattttgtctcttcagagaagaattctcagtttcctgtcaggggaatgcaacctgaatgctgattccggggttgaaggaacttagtgatcaatatacagattttcacacagtgtctctattttcagcagtggatcttttgcttgccctcctttttgactgctgtgcctgagtctcaagctcctatggctcacattctctggagaataaaccccagatttctagtgggtggtagaggttacaacttgggagcagtggtgtgctggtaaatgtttaacaactagctctctgaaacaaaacaaagcaaaactctgatttgtagcatgtgcagtttgtgttgtgtaaatactttcactagcattgatttcaagctaagaatgtgaggtcactgcaaagttggaaagaaacgttaacaataactcttgcaagccggtataagccagctgcagctcaccaatgatggaaagtctaaatacccattcattttagcaacttcccttacctttagcttctaaagtatccagtatctcaatttcttaaacatttccagggacaaatcagcttgcttcttgtagtcactggcttgacttttcttctctctgctgtttcctccaactactttcatcttcagatgttagactgcagtcacttctttatttcattgaaactggagtttgtgtttttgtttcctatcatctttgtggttatggaattttgaaagaagtaacaagagcaaaagtatctttcttttgccatcatgaaactgaaagttttactcatttttctaaataaaaactatagagttgtacaatgacattccttattgttcagagtgttttaatatcttatctaaatgtttaaaatctaatttatagcataagatcctgggaagtactttttgaccttgctatatagaccaaattagtcacggcagctttgtaatatacacatttcagatcagaggatgcttgggaattacagcagttcatggcaggattttgaacttaaaagatgcggggagaatgtgggttggtctagagagatatcagtttttgagttacctgtgttggaccctcataggttctttattagatattctagccaaatgcattgagctctaagatacgtatgctttttaggggaggtaggtgagggtggggatgagggcatgcttattcagttttcagattagaaacacagaattagaaatgcagaatgtcccagtaaaatgtatacaccccttagatgttaatagcacaaacaaccaattgctttttctatttcacggtcaacagtgttcttaaagacaggataacatagtggtgaaggcatgggatgctcttgagtgccgtggtcccagattgctgctctgtcaattgctgattgtgggaacttgagcaagtttcttcaactcgtggtgcctcagtagtctcatctttaaaattaagatagaaatagaaattcctcatcagtttgttttgaggattaaatgagttaatatgtttaaagctcttatactttgtgaagcataataagtgctagataaacagtagttattattattgtttctgttgttatagaacaagtgatgaccaaattggcattggttaacacctgtccagttattaaaatttatattaatacactttaatattacattaaagtaatatatgtatatgtacacacatttttattagaatatgttgttgagtgtgattcataactattttgtacctttgtcactcctctgataatttaacaaatataaatttaatgtcaaccatgtacaatttgactatgctaaatgctgaggttactgagttttaaaatgaaactagaacatttcttcaacgttaacactaaaaaagacctccagatagataagatttaaacctttaacaaaaaaaggagagccatagaagtattggtgggatatacgattgaatggttttatatatttggagtagaagaggcttttctatttatttatatgaaaaatcagaaaccctaaagtagaagattgacatatttgactaaataaaatttcaacttttgcctgaggggagtctccaaaacaaagtcgagaggggaacagaaactgggaaaaataatgacagtacatacgatagacaagagtaagtttaattaccaatcagttggaaaatggcaaacagtctaaaagaaaactacaagaacaggctgtttacagaaaaagaagtgaaaaatggcaagcaaagataagcaaaagtcctcattatattttaaagaaattaaaaacaattttttttatttattggaaatgagggtgctagtggaagttagaaagatatatgaacagataactaacatttccagagttctggaatcaagggagaatatactctgggggcaggattgtcttgacctttgccctgagtacctggcctcctctctactttcaagatactctgttgagtagaacgctcctgcaggctcctttccttggaaaaatgccttggcagattacctgtgatttaatgaggccttccagctgtgcattagtcacagctagcaattacttcacattcatatgagccaagcatgttcaacatttaaaaagcctctcttctgaaagagcctgaattggctggtgtgtggccgtttggttgggttttgagattgctttctgagaccttctactgcagatccctgtgtacatcttcctcaggggcccccactctagaggagaacaaaataaagcaaatccttagggcttctggaggagaagggactagatgggtttgcttatgggttcatttacccagtaaatatttattgagtgcttactgtgtatcagatagtattctgatcattgggcaaataggggtgaacatacgttttcatggagcttatcttttaggggagtgaggacagataatttaaaaaattaagaatttcagatgactgctatgaaaaagatgaaatcaggtaataaagagtaaagggtagaggtgcttagataaatatatatatatatatatatatgtatatacacattatgtatgagcaaaatagtgcttctcaaactttagtgtacatcagagttactagcaggacttattaaaacacagattgtttggccctgtccccagagtttctaattcagtaggggcctggtgtggggcgtgggaaacaaattttcaggtgccgctgctgctgctctggagacactttgagaaccactggagctgggcagagggtgatcctggaaagcctctgcaaagaggtgatatttggttagagaccttaatgacgagaagcaaccattcatgtgaagatgagcagtggtggggaatgtaggctgggaatgtgcaaagtagagaagctgtttgtggtttgaagaaagcaaaaaggctctgaggctgcaatgtaatgaatggagacagtggcagcagataaaagcagagaggaagatagtctgaagatctgccatgcagagtgattatcctctgctctgagtgcacacttaacaaaaacctccaaccatactggagcccaccccaagagagagactcagatttcattaatctgggtggcacttaagtatttttcaaaactcctgagatgattctactaagcagcaaaggctgagaatgatggataggggtcctttgcagccatgggaagttaagattttatttcaagtgtcatgaaaaccattggggagttttaagcagtagaggacataattagggggtagtttctggctgctggttgtagaatggattttgtaagagattaagaatgagtgaggagaacagtcagaaaatgtcataattgtccaggttaaaagtgatgttggcttattttatgtgatagtgatggggatgatgagaaatgagaaacaggatggtagatgggattttgggggtagaacagaaaggatttgctgatggatgggaggatatgagcagtgagagagtgagtgaattcaaagatggctccaaggtaaccttttaactggtgaaaggtgacactgttaactaagaacgctggagtagaaacaggtttatggagaaatgacaaaattttgttttggatttattaactccaagatgcctttttggaacagttaagaaccaggttgtttttagagaaagggagtgggactgagggtagacagttgccttactcctttgacaggcttgtgatagctagctgggataggattattttttatgtggactttatatgcattttgaaatatgtaaactttcctgtaatgtgtggcttaattttttttttttgttttcactcactaccacccatggcaaatatttggctttctaaaggggtaaatagaatcagagtaggaactttctagaggtttaaacctgtgagcatagtggaacatggtaggcactcagtgtatagttgttgaatgaatgaatgcatgaactcacttttatatatcaatcccatttagcattttgatgaaagatgtgggttcagatcatattgtatagggaacatcaaatatccagtggttaaagattatgtctcaattattaccataaagtaactgtagaatgaatccactgaatcaaaaggggcagagggttttggtataaacggtgttgtgttccttgggttatccttggtaaaggggcagtaaataggatctaagacccctgtgggtttctagtcccatgtctctgatcatatgtttgccctttgtcatgagccagtataatctgtgtgatttcagcaaaatcagcccaagtttgggatctgccttcacagaaagtcctcctgcttctctgcatgccagagcctgccagggggaatgttcagagatcagaggcaagaactcccataagccagcttggtgctgtgtatgataatctagttgggatcatacctgattatctgagatttcacagatgatgaacatctgtctatgagtgccttttctgataaaccagaagtcagaatttgtttttggagaatttgttaaggagaatcaattctacaactagggagatcagagaggctgctgagaactgttcccagactatattcagatgcccagatttgtgaatgagcaggtggaatctctccctagtccaggatgctgtatctgaaggttatgaaatggacatctgcactcatttgtccttatcaaccccatccagggacaagtgattccacttcaatcttgtgtaatggggtaaaaagttaaactcatgatcttaacagctgtcactcaagttcttctcaaggaggaaaaaaccctatttgtgaaaataccttgataattcacttagggatacaaaaggaaaccagagaacaaatcagaagctagactcagggtagcagaggagaatggctaggttgatacccttacataacaaggggaattcattgttctctttctaaggaggtaaacagagggaaaggggaggagagagaaacttcagggtgaagggacctgaggaaataacatagtggtaggatggctgaaaactaatttaagaagggagatgttcaatgttcagttggaaattgtttactttgctgaaatgtaaactcccttatgcttccctttaaataatttataaagtctcttatattaatggatgcattgtgtgcgtgggatttatgagtggggaactcaagaaagtctgagcttcatatccagtgtaatggtggagaatagagagggctattggaagtgggagttgagatgactttgagaatgcaagttctgcctccacctccaccattgcatgtacctagggaatcctcagaaacttggggcagagctttggcagaagactccaaatccaggtcacatttgcattataacattttggatagcaaagacaatttctcttgacaaaatttagggttctctctctgttaaagtgatttggctcatcttcagctttgctggatgtttcattaaacccgtgcttctgactcaggggcctctccactggctgcttccaactagtagagtgtcctttgtttgacttttctctgttttggatcttgttctccttctcttgcccctctcagctttgtgggagaccagttcttcagttccacagctgggggtctctcgtaccccgtccagcacctgaattcagccagacctctaataaccagggaagggagatcagacatgactaatattcagggaaattgttttcctgagcataagcatgggtggggcatttgtttttcaaagaccatatattgcatgatcagatagatttaaaccagaaaggaatatggtatatcaggtaactttaaaaggtcaccgaagagaggaagaagcaatagaagattcactagtagccgtattgtaactcctagaaccagtgccttgaaagtactctacatgacgaaaacgtcacagtcagcacacatgtttttggaggaaatatttacaattgctaatataatagaattaaaaaatatattttaatatttttactgagtctattttgctacttcagattttactaaatctaagtaggcagaattgtaagataggaatgtggtttatatgtggatattaaccttttgacttcactagagcagttgcctaatattctcctataatgaagttgtttccagtaataaaattgcattgcaaaaactgcttaggttatctgaggccagaattagacacctagaatagcaggaaaataattctcgcctgagggctgctttagacaggagaagcatggttgtgaaatattgtattgtgttcccttctgtagaagttgctacttaggaggctgtttgtgttctagctaagagtctggagatgggaatgatggaactagtgggctaagaaggtcagggatacaataggttacatgactggaatggctatagaacttatggtccatgattaagtttggtggaggtataattacaaaatgaacaaacatacatgttttcatgccatacttatctctgaaataaaattgcatgtaagtacctataatggtctgctattgtctgtgcagcccttcctccagcctttcttctggcaacagcactctcttccctttgggaatgactcgagtgtccagtggatactgccttgtgcttcacatgaccctgctctttccctgcttccatttgctgtcttaccagggccacagtggactgtgcaggttgggtacctgaattaagctggctcttcccctgaaattttcaagcgtattagaaaagagtcagttcctttggctgtggaatttataagaggtgaaacccaggagcttctgacagccaggtttgctgccagaggaggaagccggtctgcagtgagaaggtcagactgtggagagaagcatacctcctgtagtttgagtgttcaatcccttaataacacaggctattttagcattcttctaatatattttaattttgctttaaagtaatctaatctggatttctgtcactttacaacaacagaaattccagcgaacacataggcactgtccataggaaggacgttttattaaagactagaagactgttgtcatcaaaataattctgaggtttaaaacactctgaactggttgcttgtgggacgtgactgaggaacatgaacttgtgttggtagaaatcccattgattgattgagtgatttattgtcttctgataaatatttaattgttcacaaggccagtccagaaacctggagactaatctgtctcttttgattagcaggacagttgtcgaaactcattctgtctttgtaataagcattcgtgattaatttaccaggactgataggatcctgtcactgtgacccctaactgagcaaacaagtcctttctcaaacctgaatgagaacagcctgggtgtttacactcaagactatttattggcaacataatttagcagtgaaagttttctttacaatccttctatcccgtgatagcctcttttcttctctgtgggattccctggtgttcaagaaagtgctctttcaggaagtcaagggacattctctagacttttaactttatttatgtcctatcttaaaccttcccagccctaagttagtaccctgctagtgattagttcaagaatgtgataacctgctctgtgctgaagtgaaattcatcaataatggcctattttgttggtcttttcagttagcacttggcttttaattcaccagatgagttagttgtggattgaaggtgcatagcaagaaggaaaatttttttgtggaagcagcacccaggtgccagcagtaaacgtcattaaatttattgatgctgaaattcttttattggagagcctgtccataaccattcttggtaagcagtattttatctcaagtctattttcttgtggggatcctacatcattgcacttgtgtggatgaatcatgcctaatatggttggcaaatctcttcttgagttgtagttcccataattctcacatgttgtgggagggacccagtgagagataactgaattatgttggcggtttcccccatactgttcttgtggtagtgaataagtctcatgagatctgatggttttgtaaggggtttcccctttcacttggctctcattctctcttgcctgctgccatgtaaggtatgcctttcaccttccgccatgattgtgaggcctccccagccatgtggaactgtgagttcattaaacctattttcctttataagttacccagtcttgggtatgtttttatcagcagcatgaaaacggactaataccatgccttcatgcactgtaagaataggcactatttgtagagagctgccctgtgccagatatagctggtgcctccacactgtatctcattgaattcaattttgagaacaatgttatgaagtaggtattgttatccttagagataacatacagagaagttaatcaggttggctgaggtcatatgactaatgcggagatgtaactcgggtttgctgactctgaagcttcttttgtctatataatttccaaagtttggttttccgtaccattctaataaacccagaagacacttaccagtgctgcttccttcaaactggactccttgcctatatgagttaccttcttacctgcctttagttgtggtgtgggcagtgggtgctgtgttaatcccaagggaacagaaaacctctggaagccccccatggatcatgacttaacctagctgtggaagagtcttgatatcaaccaagaatcactaaatgatgatgcacaggctgagtgcaagttgcttgtctgccattttgctcagaggttaattcctcagggtaattgggaattattgcatgttaccttagggtggttgagttattgattgagaacctgtgattctgattcctagaggcatattggagttcaggtctgaaggttctaaatggaccacaatcatgctcttacttatatattaatatatcagtaatgaacatctcatcatttactcaattttagaagcatctggattgaaaaatatattgatattctcctaccaaactgaattatatctcagacatctaaggatcaacattttttctatgtgtttttgttatcttttctaagtgttttaaacagttcttcgtgtattccagagttttttttttttctaaaatattgctctatttttgctagcttcctgagtagtcaccaatgccacagtagaataaatctgcatgtatttttactggtctacaccttggcaacaatacacatctccatgatgggacagaactgaaataattttgccctgtgtgtacatggctgtttgtttttaaaaaattttctgactcaactgtgactgactacataatactgggactgacatcctatcatttggatacatggatatttagaactgaaagctcatgagagacaatatggagggcaataaactggcatgaaatgccttatgtttttccataccagctaaaggctcttgatcctctttttctcttggccttagaatgaggtgactgagtgaagtgaaacgaaatgcaagtttcatttcaacttaaaagctggaattctcaaatgccaaataattggagatttgctttctgaggtttgatcacaaaacattttgtaaatagcagaaaactgaccacactttatgttgttcactgtgttggaatagaatttaaagacaggaaggcctgcagagagcttcaggttagtttctcagatgtcttgcctcctgtttccttcaaaatgatcaggagagattttaatctctatggtttttcagcatctgtggtttctttcatgagcaagcatcatagtgggtgtcaagaattatatgctaatttagtataatacgatggcatcatgtaatgcgtgtgcacttgagaataatagttttggaggcgcttctttgctgaagtatgattatattcagaaacgactagctttgtaagtgatagtagctactgacttctatgaatttcacacttaagttcattaatgacagggactgtttttggtattctgggatatgcactatttctaaccatctttgttctttctctacatggcagttaggaaagaacctctgacagaatctaggaactaacaatcagtgataattttgatttattttaatttggaggctaaagtgtattacaggaaattgtctcttcaagaggaaacatttaaaaagtattttaagaatttaagaggaagctatgtggagaattatcatcctggaattagaaacagtttctaattccagagggcatgatatgtattcattttctaggcggtgtatataccagttactatcagaatatgctacattttaggaacaggtatcatttccatcagtcttttccttcccattcctatacgctttaccttagtttaagcatctgttaccaccactcttctagatagttgtaggagtctcctagcttttctcctggctctcagtcttttcttaatacagctttgcagacactcatcagatagatcaaacccagatgggatcaggtaaaagcctttggtggcttcctagtgcctaccaaataaaacccaaacactgcagctttgcagtgatggtccttgacagtctggtgtgagtccagccttgttcctataactctagccagaactctgtgtcctggttgattcaactactttatttttattttttatctaatttttttctttatttcttctaaaaaaaaaaaaagaaatgggatacatgtgcagaacatgcaggtttgttacataagtatatgtgtaccatggtggtttgctgctcctattgatctttcctccccttactcccccatcccccatcaggccctggtgtgtgttgttcccctctctgtgtccaagtgttctcattatttaactcccacttatgagtgagaacatgcagtgtttggttttctgttcctgtgttagtttgctgaggatgatggcttccagcttcatccatgtgccggcaaaggacatgatctcatgccattttatggctgcatagtattccacggtatatatgtaccacattttcttttttttcctttccttttttaaactttttattattattttttaattttaccctaagttctgggatacatgtgcagaatgtgcaggtttgttacataggtatacatgtgccatggtggtttgctgcacctatcaacccgtcatctaggttttaagcctcacatgcattaggtatttgtcataatgctctccctccccttgccccccatcctctgacaggccccggtgtgtgatgttcccctccctgtgtccatttgttctcattgttcagctcccacttatgaatgagaacatgtggtgtttggttttctgttcctgtgttagtttgctgagaatgatagcttacagcttcatccatgtccctgcaaaggacatgaactcattcttttttatggctgcatagtattccatggtgtatatgtgccacatgttctttatccagtttatcattgatgaatatttgggttggttacaagtctatgctttgtaaatagtgcttcagtaaacatatgtaccacattttccacattttctttatccagtcagtcattgatgggcatttgggttggttccatgtctttgctgttgtaaatagtgctgcagtgaacatacatgtgcatgtgtctttatagtacaatgatttatgatcttttgggtatatacccagtaatgggattacggggtcaaatggtatttctagttctagatccttgaggaatcgccacattttcttccacaatggttgaactaatttacattcctaccaacagcgtaaaagcatttctatttctccacagccttgccagcatctgctgtttcctgactttttaataatcgccattctgactggcatgaggtggtatatcattgtggttttgctttgaatttctctgatgatcagtgatgtcgagctttttttcatatgtttgttggccatataaatgtcttcttttgagaagtgtctgttcatatcctttgaccactttttgatgaggtcgtttgtttttttcttgtaaatttgtttagttccttgtaaattctggatattagacctttgtcagatgggtagattgcaaaaattttctcccattctgtaggttgcctgttcactctgatgataattttctttgctatgcagaagctctttagttcaattatatcccatttatcaattttggcttctgttgcacttgcttttggtgtttttgtcatgaagtctttacccatgtcaactactttctttacttggttattctctgtttttcccttcataggcatttgcttgtgccacctcttttgatattgttctccttctatcttataatcaagtcaagcccaactattcaggcctttttaaaagcttttaattccatacatttttttccaactcacttccactaggaattatcttttctttctttaactctgctagagtactgaaactcacttaaagcactgtgattgttcctttgtgttataattatttcttgtgtgtaagttctttatgttgtatccttctactagattatgactttttgaggcagaggccatgtcttttgttttgttttcctttggatagtaccttgcagagggttgacctttataattgctagttgaatgggccagtggatgaagggttttagttctggtgaaatctctttttttgtagcttctttattcttgcttctttctttgttttagaagcctctcactagtataaagttggtggattttgcatgatattggatacatgtagatatgttagtctgaccttaggctgttaagttgtgaccattggcattctagtcttggatatagttgccagtttgctgattccctcacatattctcagaccatctcatctacagggaacagcctcccgactcggagcctattggcctctgctcaaccaggataatccctcccagagagcccctcatcctgcttcaagctctaaatggaggaatgttactttttatgccaaatgccttattttgcccatgcccttccttattttcttgagcatattccttctatccaaagttaaattctgtgataattgttggtttccattatttttattttttatcctcagtgatttaattttatcatacaagatctatcaaatattttccatgttttaagttgtcctgaagcagatccacgttattaatagactaattttaatcttgacaaaatcaaatgcaaagtgatcccaagtttatttctggttctaaatgatcaaaaagaccatcatatttctggcttatctcaattttctctcatgtggcttcccttgtctagtagcttttatatttgtatagtttcattttattagctgataacaactctttggttaagggtttggtgggataaaaagtttacatatgagttaattagcctttttttttggtgaggaagaaaacttaaatattctatgaatccatattatttctagtttccttttgtaccaggtcaccaagttataaagcaggggtgtctaatcttttggcttccctggtccacattagaagaagaattgtcttggaccacacataaaatacactaatattaaccatagcttatgagctaaaaaaaaagaatcgcaaaaaaaaactcatcatattttaagaaagtttacgaatttgtgttgggccgcattcaaagctgtcctggaccacatgcagccacaggccatgggttagacaagtttgctccaaactaaactatacaccttattctaaaattgcattaaatgaaacacatggcatctaaccacattgatctttgctttagaaagtatttcaaaatctttcaagtggcacacttcaagatgtgacactctgatggtcactataaatgtcaagttagcatgatagtgaaaatatgccagaacactcatagcaggagagtttagtaataatagctactatttattacatgccaactatgtatgaatatttacacccttacctcattcaatcctcacaccacagagataatgtgagctgtgaaatgtactctactctcaagcacaggagctatgtaacttgtccaaggccactcacatatctagtaagtggtagagttgagctttaaattcaggcattttggtttcggaatctgtgctcttgtgcactaatctgtattgcctcttaattactacaggattctcaaactttggcatgcataaggatcatcttggggagctgccaagatatatcatcactcactctaccaggattactgttctagtacagtataccgaaatatactctagaaagggaattagaaaatttttgtgtgtgtgccccaaactagctatgtgacttcagccaaatcacttgtattcgtcagggttctccagagaaacagaactaatatgatatgtgtatatacagatatagagagaaagagatttattattaagaattggctcatgattatggatgttggtgagttcaaaatctgtagtgttgactggcaggcagagacccaggagaactgatggtgcagttgatgtctgaaatcagtcttctccagaattccctcttgcttggggatgctggtctttttgttctattcaggtcttctactgattggataagacctacccacattgtggacggtgatctgctttaccccaaatttgcagacttaaatgtgaatcccatccaaaaaatattcaccaagttgacacataaaattattcatcatttgactcaacccctctgagttccatagatcaaatctcattgagaagatcaccagggattgggccagatggttataactacataatagatgcaccaaagtggtgaccagtggaacacaccctgaaaagtgatgactttagtttggctcatctagagttgtttttttaaagcaaccagtgtttaaaaaaattgtttgaattaccagaagttgctaacaagttctacataaaaatctgtatttctagtttcttgggaaaaaaaacaacaacaaacaagtgatgatctggcaacactgcatgacaacagtgtagctgagccacagatgctacctgtaggagtggcttgcaacctcccaaatgcctaccactcctcccatttcattcgcctggttcattgcacttatttctgtgtgcttcagagctcttgtaggcgtttaagtttttaatccttgcctccatagctactaaacatctgtggcacctccacctctcaattataaatgacaaagagagaactaggatttctgtaacacagtgaatgcccgagcttgggctggaaaacagagctatctcttcattgtgagtgtgtgtggtttatcaccgttcccagagttcccttctctgggttcctcagatcactgccttctttcacattaataaaaaacatgcttttatattcctgcatacttctttttcataggaggtgatagaaattgtgagctgccttcttcagagtcactgagtggggtcactagataaaaagatggaggaacattgatgtaagaatagaagctgctaattttgcatggagttgagttagttcatgaagcaatttcaaatgtaagaattactttccttttagcaaggctggctttataggaaaacagaatgatcagtctaatagtaagatttcattttacatagcctcattacttccccacttgttccctgaatgctcaaattacttcaaccaggacaaatagcagttcatatagcagagattgagagtagcaacacatggcttaaattgacaaaggaacaaaatggtgatattagagccatactgcaaatacattttggtggggggactagggaaaagatgaaaccaagggacactgtatagtctgaaagctgcagaagggaaaagtgtacaataatggagaagcttagaggaccaagatttgctttaccatctgtgcagtatgactggcacagccacatcttttcttttcatgttaaaatgtctatggccgtttttggggggacaaaacagatacaaattgtcattagggaattgagaattaattcaatcagccatatggtttgcaaacaagctttatttttctgtgtttaaaaaatgcatttaagatgtatagcattattatggtttctctagaagtcatccttcataaaagtaattcggtaatgttagaatctctgtcagtttcttggcaaatagtattcgattataaatttatgctccacaggacacacaattttagaaatgttctggaatgtttccaaattttattttggaacttggcatttggtttctctttaataatctcaatcaataatggtttatactagtcataaatgtattagctttaaatagctgccatattccatttcagtagaaatgcttttccctttcccatagtgtgtatttgaatattcatttttgtgtgcaaagttttttccttgatacttggattcctgtggataaattatttgaaggtcatttgggaaggtggagagagagagagagagagagagagagagcgagcatgcataggttttaatgtctaacattagattttttgcttgggaggtgtatgcttgcctctagatttttcattcttagaacattttctattactttttatttctattaattttgaagatatcaggatcattattaactctagccagttgcttatttaaattttgaatagatttatagcttttttatttttaaatctacttaagagtttatttatatatcccttttccttgaaatcatagaaagagaactattatacttaatactagttttgtgcttcctatggtatcttttggaataaccttagtaaaggactgactatagctgctggaggattgcttattatgcttttctgctaggaactgtagtcttattaatatttggctcagacaaaataagcttaggtcctagggccatggcagttaacgtcttttttctccaaccaaataatagactctatgtgagaggtggttttggaaatgaaactttagaccttaggggttgttttgatttacaggataggtgataatggtgctttctcctggaacaaaggatgagatatttcctgcctcttcaactgaggtaaagaatggaaagtaacaagaaatatactgtgttttagaatataaataaatggactgggaggaaggctgtatctgtttgaagtagttattctattataattagtaacaaaaataatttgtatttgagtaatataagtgatcaagctatccttggaatgtatatggcatagtatacagtaaagttgtttttaatgagagaaaagtatattgtaaaagactctatgccctcagaatagcttgcagagtttgttcataactcctttatcttaactcttatcctccttctccctttaaacatctctaaacacaaaaggaatgatggtacatgtattaataagtcatttaggatgccaatgtagagaccacccagcatacctatgagcagactgctgatgctcagagtcaccacttgcagtttgggacatttaaagtggagtaaaatataaatggcttatctgtgtgaccacttgattaaccacaggtggattatccttagtgacttcaaaatttatcgttagtttttctcttcaactcagagttcttctggatcatccatcactgtgtggtaactaacgtaaactaattgaatttctttttaatttttaatttttgtgggtacacagtaggtatatatatttatggggtacttgagatatttcggtacaggcacacatgcctaataatcacatcagggtaagtggagcatccatttcctcaattatttgccctttctttgtgttacaatggtccaattatacttttagttattataaaatgtataatacattattgttcactgtaggcactcttttgtgctatcaaatactaagccttattcattctaagtatgattttgtacccattaatcatccccactccccattcccccattacctttcccagcctctagtaattatctttctactatctccatgggtttgtttttatttttagcttccacaaataagtgagaacatgcaaaatttgtcattctgtgcctgacttaacataatgccctccagttctgcctatgtttttgcaagtggaaggatatcattcttttttatgactgaatagtacttgattgtgtatatgcaccacattttctttatccatttgtctcttgatggacacttatgttgtttccaaatataggctattgtgaacagtgttgcagcgaacatgggagtacagatatctctttgatatactgatttcctttcttctgagtatacacctagcagtaggattgctggatcatatgttagctctatttttagttttttgaggaacctccaaaccgttctccatagtggttgtactaatttacaaccactatggattgtaccacctatggatgaaggttcccttttcttcacatccttgtcagcatttgttattgactgaatttggttaaaagccattttaactggggcgagatgatatctcattgtagttttgatttgcatttctttgatgatcaatgatgttgagcatctttttatatgcctgtttgccttttgcatgtcttcttttgagaaatatctattcagatcttttgcccatttaaaagtcagattgttagattttttcctatagagttgtttgagctcttacatactctggttattaatcccttgttagatggacagtttgtgaatattttctccccattctgtgtgatgtctcttcactttgtgggttgtttcttttgctgtgcagagctttttaacttgatgtgatcccatctgcccgtttttgctttggttgcctttgcttgtagggtattaatcaagaaatctttgcccagtccaatgtcctagagagttttcccaatgttttctggtagtagtttcacagtttgaggtcttagatttaagtctttaattcattttgatttgatttttgtatattgtgagagatagggatctaatttcattcttctgcatgtggatggctatccagttttcccagcatcatttattgaagaggagatcctttccccaatgtatgtttttgtcacctttgtcaaaaatgagtttgctgtagaggtatgaatttgtttctgggttctctattctgttccattagtctatgtatctgtttttaaaaccagagtaccatgctgttttgtacagtaccattactgtagctttgtagtataacttgaagtcggataatgtaatttgtctagttttcttctttttgcttaggttagctttggctatggtgtgtcttttgtggttttatataaattttaggattgttttctctctgtgaagaatgtcattggtattttgatagagatggcattgaatctgtagatttctttcagtagtatgaacgttctaacagtattaattcttccaatccatgaacatggaagaatctttgagttctttgtgtccttttccatgtctttcataaatgttgtatagttttcattgtagagatctttcagttttttggttaattcctgggtattttattttattttatttgtagctaatataaatgggattgcttcattgatttatttttcatgttgttcattgttggcatatagacatgctactgattgttgtatgttgattttgtatcctgtaactttacaaaatttgtttatcagttctaatagttttttgatggagtcttcaggtttttctaaatgtaagatcataccatctgcaaacaaggaaatttgacttcttcctttccaatttcaatgccctttatttctctcttgtctgattgctctagctaggagttccaattaatggtggtaaaatgggcatccttgtcatgttccagatcttagaggaaaggctttcagtttttttgctgttcaatatgatactaactgtgggtttgtcttatatggcttttattattttgaggtatgttctttttataccctgttttttgagagtttttatcatgaagggatattggattttatcaaatgctttttcagcatcaattgaaataatcatatgttttttatcttttattctattgatatatcacattgattaatttgtgtgtgttgaaccatccttgcattcctaagataaatcccacttggtcatgatgaatgattttttaatatgctattgaatctggtttgatagcattttattgatggttttattggcctgtagttttcttttattgatgtatctttgtctgatttttgcatcagggtaatactggacttgtagaatgagcttggaagtattccctcatcctctattttttggcatagtttgagtaggagtagtattagtttttctttaaatatttggtaaaattcagcagtgatggcatcaggtcctgggcttttatttgctgggagactttttactacagctttgatcttttgtttacttgttactaatctcttcagggtttggatttcttcatggttcaatcttcgtaggttgtatttgtctaggaatttattcatcttttctaggttttccaatttattggcatatagttgctcatagcagcctctcatggtcttttgaatttctgtggtattggttgtcatatctcctttaacatctctgattttatttatgtaggtcttctgtctttttttcttaatctggctaaagttttgttgattgtttttaatcttttcaaaaaatcagcttttagtttcattgatcttttgtattgttttcttcatttatttctgctttcatcttcactattttttcctgctgattttgtgtttgggttgctcttgcttttctaatctttaagatacactattagattgcttatttgaagttttacttcttttttgatgtaggcacttataactatacatttcccttttagcactgtttttgctatatcccataggttttagtatgttgtgtttccaatatcacttgtttcaaaaaaattttcagtttccttcttaatttctttattgacctattggccattcaggaacaggagcatgttgtttaatttccatgtgtttgtatagtttccaaagtttctcttgttaatgatttctagttttattccactgtggttagagtctcacccaaggcccacagcatgtactacctggctaccactcttgactattcagggcccaagggctctttagtcagcagatgatgaatcctgccaggactgggttcttcccttcaaggaagggtttttcttctggctcagggtgtgtctagaaatgtcatctgggcatccaggagatagggcctcagaactctgcctcatgccctatcctactatggctgagctggtattcaagttgcaagacaaagttctctttactcttccctctccactcctcaagcagaaggaaggagtctcttttggagctgtgagctgtgttgcctgtggttgtggaagagatggtgcacatgagctggtctcactaggtcacatgcccccaagttcactgtctctgagcccagcacagcaccaggactttcccaagaattgcagtccttgtggcctagactgcctttcaagtttatttaggacctcagagtactttagccagggtgataagccttgccagaattcaggttctgacttctgggatgggtgattcccttttggctagggctggcctgaattcaccctccattgagttttgcctgtattgctttctgctgtgacagggcaagactgagtttcagtgtaaagtctaacaatcactgtgctctcccttccccaggcacatagattctctctttgaacaatgcagctgctgcaggggatggggaagggatggcactggcaattcaagactgcctttcctacttcttcagtgcctctttcaccaatatgaagttaaaaccaggtactgtggtcacttacctgatttttggttcttatgatggtgcttttttttctgtgaatagttgttcaatttggtgttccttcagggaggatgattgatggaggctactatttggccatcttgctctgtctccatccatactaatttttttttttttttttttttttgagacagagtctcgctctgtcgcccaggctggagtgcagtggcacaatcttggctcactgcaagctccgcctcctgggttcatgccattctcctgcctcatccatactaattttttttaaatctgcctgggccctgtagctagagtaaggtcagagtctggggcagaactaaacatggaagcagagtctgctgctccagctcagagactagagggtcagagagttgaatgggtgctgacattgtggatccccagtgagaacttgctcctgcaaccttacaagaaaaactgcttttctacaggagaatcaccacgttacattagcagtttatttatttattttttttggaatggagtcttgctctgtcttccaggctgaagtgcagtggcataatctcagctcactgcaacctccgcctctcaggttcaagcaattctcctgcctcagcctccaggatagctgggattataggcacgtgccaccacgcccagctaatttttgtatttttagtagagatggggtttcaccatgttggccaggctgttctctttctgatcacttattgataatcttgacctaaatttagaagtaacttgggtatcactagatacatatgggcaactggaatgcattctaaactgagtaattagaattgaaataatctgctcaaaagtaggaacactgctttccattttatatttctttatttactttgggggtttctttagtgactcttccaggacttgtatgtgggttcattatttacttgacagttaaaaagttggtcagaaaagttatgtctgcctcctagtcataaatgaaaaggtaagaaatccagaggaaaaaattacatattctctcttagtttatttttattatcaataaaatgtcagtgccctttaaatgctgaactttatcatgcatatgaactttgaattatttttgttcagaagagagaaacatggaaagaaattatatgctccctcatataactcaaaggcctgatccatcaaagctagaaaagttattgtcatcttgggtgacttttgatttctcccttgttcttgtaaggcctactctcttccactcaccaatatcttctagtagcttccccctggtgatgtgtggctggctgagtagcttcttgagaacatagccattattgagcttaattgtctttcacttattattctagtgacattctattacctcaagataacatacaagtctaatttacctaagtggatactgcttttgtgtgttacattatgctttagaatttcaaggttctgaaattattttatgctttttaggaatccaaaaattaagctgttttctgttattttctttaatcttcactagtaaatgagattaacatgcatggaaatctggccttgggagaactaaacccaagtggtcacataaaacccaggaactatgtcagccttaaaaggccaatccatcattcctagcaaggtgaatgtaccacacagaattatcagagatccccccttacaaaatggtaataacaaaaatatttgtcatttttggggtactttctaggtttccttataaaatgataataacaaaagtattcatcatttttggggtactttctaggtttccaactctttagagatattattctaaggcaattaactgggaaaatagaaatagttaaaaatcactttctttgcattgaagggcttccagtataccatggtgctaacttaattctccagttttagtttccattcctctataaaaaattattttatctaatcagaatggtctgtttctcaacaaagcagtctctcaataccagtacaggatgctgattaggaaattaaaattgttcttctggagactatctttggtttttcactgaatttcttattctactggacgttttcagaacatagtgcaggtattagtcactgcagattactccccttacccctcttctgagatcttagaatgttctggatgatctgatggctggttcagagatggctgttttataagttaagagtaattcatttaaaacagggtccccaacccccagaccacggtctggttaggaaccgggccacacagcaggaggtgagctacaggtgagtgaacactatcgcctgagcagtccacctcctgtcagatcagtggcaacattagattttcataggagtggtaactatttgtgaactgcatatgcaagggatctagattgtgtgtgccttatgagagtctaatgcctgatgatctgaagtggaagagtttcatcctgaaacaacctcccactctggtccatggaaaaattatcttccatgaaactagttcctggtaccaaaaagtttggcgaccactgatttaaaaggacaatttacacaaaatcaccctcaaagtgcatgtgtgagtctagcatatgttgtagtgtacattttttatagggtgtgcatagtggcaatatgtcctctataatagagttgagatatctgctttctcaaggctagactctgagttaattaggtggagtgatcctcctgatgtgtaagacagttccaggcaagtgctatttatgcctgcttctccattggtgccagcagtaacttgactctccccttaactccctaagccttttatctctctcttactgagagctttcatcacctccatcctgtgttgtagatctagctatctactctttttctcccttcttgtttttcacattgcttgactcataatgtttgcttaatacatatggtaatcattgatattgtacagcaaatatttccagctctcagtcttctgagcagatgataagattgtactttccaccatctttggccaaatgactcactttgaccaaagaaatgtgatcagaagtgatgcaaattattttcaggtgaaatcatttaatagccactgctcaactcctacttttccttcctattcactgtgatggtatgtagagatgaagtctgagtccctgaatgactgcaatgtccagagtctcctgctgacctgcaaagtgcatgtagtttaaactagaaatatacttttgattctttgagccattgagattttggggtggtttgtatacagcataacctgacttattctgacaaatgcactggacctgtactttccaatatgatagccaccagctatatgtggctattgagcccctgaagtatggcatcttatttcattttctgttgctgtaacggaatactcaagaccgagtaatttatagagaaaagaaatttatttctcacatttctggaggctggaaagtccaagaggatggtaccagcatctgataagggccttcttgctatgttatcctatggtgggaggtaagcaggcaagtgagtgtgtgtaaaaagagagagcatgggggccaggctcacttaataaaaacctagtcttgcaataacaaacccactcccatgacaatagcattaatccattcatgagagtgcagtccccatgacctaatcacctcttaaaggtgccacctcttaatactgtcacaatggcaattaaatctcaatgagagttttggagtgaacattcaaaccatagcatgtggctagtccaaatggagatatactataagtgtaaaacccatgctgaattttgaagacttagtatgacaaaaagtatgtgaactatctcaataatttttgaatattagttacatgttgaaataatattttggatatattaggttaaataaaatatagtattacaatttattttacctggtgctttttacttttaaaaagttacacatggtttgcattatctttctgttagatagtgctgcactgaactacaagcttattgaagacaagagttgtatccgttttacctttttttcccccacaacatccaacagtgtctgggatatgagatatgcaacattaatgtaggtttaatgaacaaactgtgtctccatttatatgtagtttaacatttaacaaataatgccgttctcaacatgaagtttgtttgtatttttgtgtttaataattccttcttgtaattccgttagctaaagaataactcaaatctttttcaatcatcagataattgaatatcatattgtgatgttatgtttatgctataataagaaggctggggttatgcccattaaatacttctcctgatgaaattttttagcaaggtcactccttatggctaacattttcttatctttgtaaaaataacaaagaagtccctgtttgttcagtcatagttgtgacttttatttcttttccaatatctgccacttaggatatttattaaattaggcccctttgcatggggccttgtgctacaaaccaaaaggaaacagaaaaagagaaatggagctgccatgaagtccttctgcagcatcagctgtggggactgcacatgtgaggaagcagttctttggatttttagatgagtgagacagaaagtaaaataggtggtaaaaagagtcactgaaaggaacaacataccttaacaaataaagggtgggggaaacacaaagtaccaaataggctggaaaacatcttaagcacttaataaattatagctattgccatgaaagtgtacgaacccagaaggagttatggacggatgcatactaggctgttccattggctaaggagcggcaggggaggtgacacaggggaaggggaagatagatactctcatcaaaagaccatagaattagcaaaaacttgtccacaaaccaacttatatactattccatgtgcataaaatcacatattatgtgtatgtgcatagaaagatattacaacagtggttaccaaactgtagtgattctttctctgtatggtggctgaatctcaggtgacttttactttctttgttacacattttgaatttttctccagatgagcatgtatcatctgtatactcagcaaataatctgatctagcattttttcatttatgggtaacatcaggacaaagattaagaacccaaccaaaaattgtctatattatttgcattctgttgaatgctaatttttaaaataaaactgtcaaattattataaatataaaagtaatcagaagtatactgccagtacatgcattttggttatcacagaatatttaaaatgtacatgtttataggcctagtatcctcctccctgggttaggctccaattgattttctaaatgacacagggaagtagctgattcaggtcatggtggcatcttatctgaaagtgaacatttcttcagaaataaaaaatgcttttgtaagattatagaagatttgggaattatgccatgagggcacatgctgagtaatatgtttttgaggcaggctgccaagtttcgtcaaagaaaggcaagtacagggtttgttttgcaatgtctggaaaacttggaactctaatttcttggaaaatctttccaaaataaattcagtatgaaggcattctacctcaacaaattacatgtagcaagaggaaaggaaaaacaaagtgtaacaagatgtgagatgagaaaaggagattttttttccccaagagatgcgaccttgttgagttcaattacatgtctgacagcatcagagaaaacatcctcgtaatgttaattttactcaaactcctgagtgtgggtaaagtaaagaaattatccttcatcatcagttcacttttatccatctttaaaaatgtacaaaatataaggtgtcatatatccaaaaatattctgaattgctggagatcttcagcaagccgtttacattttctgggtccatttttctcctttgtctaatctggagggtttagatgtaaaaagtgctatggtctctcctaggtttaatttttttaagtaaaacaaattattatttttgacatattcacatactctttgatatatgtcagcaaaattttttccttatcaaggtctaatttttatatggtgtgaaaagcactgtggttacttcatagacatgatcgaaaactaggaccttccccattgtcccttccagttctccatacactttgaagcctttgcatggttgtcagaagggttgtagtgattgataaacaggaagaatccaactgacacaggttctgtatcaatgagatggctgtgcagagcaggagacagcaatattctccccctggcaaggataaactacccttgtcctcaagtcttcttggagctgccctgctgctggtgactctgcctaatgaggtgggagatctgctcaggttctttaagaaacacaatctgggtcttcatgaggcgagtccctactgttcccagaggctctcagccacagtagtgcatggaggtatgaactaagaagctgtagaaggatacaagtgcactttgcttggcgactgcttaccaccgtctttccttatgggcttgggagctggtggaaaccaattcagcagatttttgagtgacttttgaattgaaggtgaattctaggagatctgactgtcccaagtaggatgatactttaagcctttctgatgtgtttaccataattcaattgaagaacatttatgtatagtttattcatgaatcctacatttattgagtgcctgccctatgccattttggtggggagaagtataaaaataataaaaaagtataatttagtacagaatgactaggtactaattaaaattgagacagactcatagaggaggtaacatttcactcttagtgaaaagaagagcaagccatgaaaaggtttgatgtcaggatattccaggagagggattggcaagggaatggtggggaggagcttcacatgttcagggaaaaggaagaagtccagtgtggccggagtacatgagcaaaggggagcatgacaggagttgaggtcagggaggtgggcaggcgtgaggtcaagtgggccttgcaggccatggggaaaaatttggattttattgtaagagcagttaaccattagagggtttaaacaagagaatgataggccctgatttgtatactcttcttggttcctctggctgctaggtgaagaatggatagtggaggagtagagagaatagggaattagttatctagtcatccaactgagatgtgatggtgactcagacaaggttagtggcagtggagaaggagagaagtgtcatggctttgggatgtatttcagagtagagctcacaggacttgctgatggctgcctgtaagagaataagaaaaggcataaatcaaggaggattcctatgtgttggacttggaaaaactgggtgtatggtagggctatttatgaggagggagagacctggggaggaactggtttggagacttaccaagagttctgattttgccatattaagtttgggtggcctaatagatattgaaggaaagatatcagacaggcagcttgaattgctatggaaagtcctgggctggagatttcaatttgggaaccattggcatggatctgatgtgaattgtgaaaagataagtaaaagtttaaaccagtcctgtaattcatcttgagcatgtgctactttcagtcaggaaaaaaaagaagccctcctttatgaaatgatatggtaattattgcttactacttagagtctttgtagcagttgattttcaggcaattagaataaccacatcacttttatctgataattagagctaatttgcaagtactgatgataggctcattcactgaataaacaaaatgcagagcacaaagtttgtttctacagccatatatgtgaagttcctcttcaggtcttttgcaccacagggctgctgaattagtgcagagtttaattcagaattttcactcttgttcattgctaagctcatggctttattctgtaatggtattgtgtactttgggaagaatgccgttgggggaaattctgaccccttctcccaatctcagctgcgctgtcagaagctgtttgccctgacaggcctgggagcttggaagctagctatagtaagagtgatgcttggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggcgtgaacccgggaagcggagcttgcagtgagccgagattgcgccactgcagtccgcagtccggcctgggcgacagagcgagactccatctcaaaaaaaaaaaaaaaaaaaaaaaaaaagagtgatgcttcacattattgagtgtccacgaaatgcttatgacaatgccagttgttttgcatagattatctctaaattatattaaaacccctgcaaggtaggtatttttatttccattttaatgatgaggaaacagaagcttaaggtgacatggctagtaaattacaaaatcaggcctagggtctgcttgcttctgaaagcatctacaattttcattctgccaggctgttaaactgccaaaatttgccttagtttattcttccagtcctgctttctcctatcaactcttatgtctttccagccaaaaacccaattggctatcatctacatttctgtctttaaaaatcatccctaagggccaggcacccctgcaatcccagtactttgggaggcctaggtgggaagattgcttgaggccaggagttcgagaccagtctgtgcaacagagtgagacccccccatctctaaaaatacttaaaaattagctggatgtggtggcacatgcctatagttccagctactcaggaggctgaggcaggaggattgcttgagcccaggtcatcaaggctgcagtgagctatatttgtgccactgaactccagcctggcagcctgggtaacacagcgaggctcttttcacccccatccaacaacaacaacaacgacaacagaaaaaacagaaaaaagtcccctgaagtatacacacccctaccccgcctcttacgcctctggtttctgtctaaatatttcagccccatcctcaaattcatacctttcttctccccaaccataccttcctagtacactctaggattctattacttacacagacctctcattctttaacttttcccttaatatttccctacactcttgccaaaactcactcttggccttattctaaattacaagttcctgagccacattcttcactcgtcgtcatttctttcaattttctggctctcagagtgaggagcaggagccagagaatttcctgcttcccaccagcacatccagtctattgcttgttcattgcctctcaagaacttgtgttgtgaattccactctatcctgtgtaccacacttcttccatcttacattcaactcacaccttctgctcacttctcaacctagaagagtccacttttgctgactctctctttcttctatcatctcatggaaactgctaaacactttacctggtgttccaatccctggcctcagagatctttggcctgaggacattacggaactttcctttcctttccctttcccttctcttccctttttctttctcagagtctcactctgtcacccaggagggcgtgcagtggcatgaactcggctcactgcaacctctgcctcctggattccagtgattctcctgcctcagcctcctgagtagctgggattacaggtgtgcaccaccatgcctggctaatttttgtatttttagtggagatggggttccaccatgttggctgggctagtctcgaactcctgacctcgtgatccacccaccttggcctcccaaagtgctgggattacaggcatgagccactgtgcccggccaaagaactttatttctaattcactcttgctccttataggcacaaccacacttcagacctgcttgacatttgaaactgccccttatctgaaatgatcttctcggatgatacccagttatagttctgcctctttgcaatcttctcttgggctgaatcttggctttattctcagtgtaacagcttcttgcctcatccattgccttgacatgccacactggcctcacctgcctctctactcatgtggaccgtttggtctgccatttgagctcagtttttgatagttccatggacttcaggctctgatcctattttacttgctctgcaaatctccaattctaggtatcaccatctgatttctctccgcctcctcttgtattactgagtacaaaaaaaggacatgaatcttgatttttgttaacaataaggaaaatctgctataacgttttagcatgtaactcacagtcagtcccatgattggttaatttagcgatccaataacatcatcaaagaccttggatcttcccatttccccccgccccctcacctaaccccctgttgtcctattaggacagcttcagtctctagctagccaccagctgctgcatttccaggggccgtgcagagaccagactcagcagaaaaattggtttgattggttttaccacaaatatcaacccacaattagaacctcttctggcttcattgcagtctcattacaaatttgctcctacttgtgtttctcactggaactattctgagctttttccaattccaatcttatcaagccccacctacttgtttctttttttgtttcaaaagtgtcttccatatctgttcctattgcccctaccctaacttgcacccaacaattgtttaccttgcccccatccattcattcccctgtccctttcctgccaggttactgttcctgaagctggcgctgagtgtggcacttttttgttcactctgcctctagtgggtccctgaagttcagatggcttattgtagcatttgggatccattaagacctggccctggactacattctcagttttaatttccattatttctatttatgtaccccataagccaatcaaaatggaaatccctggctattcttttactgctccccagattttcccacctctgtctttgttctctttctctgaagaggactacccctcaactctgcaagtgaaattactgcacactttaaggtctaactccggtggcacttcttttaaaagctttcctggcctctctcatcctcagcaagaaattatagtcttttccgaattttgtagtagattatcttaggttacttgttaactctgtatgatattttttattgtagagtaaatccgcactttgttcatatgttcttggaaactgtgaagttaagtgaaaccaattttaccataggctgattgatataaaaagttaagttcaggccgggtgtggtggctcacgcctgtaatcccagaactttgggaggccgaggcgggcagatcatgaggtcaggagatagagaccatcctggctaacacggtgaaaccccgtctctactaaaaatacaaaaagattggccgggcgtggtggtgggcgcctgtagtcccagctactcgggaggctgaggcaggagaatggcgtgaacccgggaggcagagcttgcaagtgagccgagatggcggcactgcactccagcctggtcgacagagggagactccgtctcaaaaaaacaaaaacaaagcaaacaaacaaaaaaagagttaagttcctaaggcatatttctggccacaaaaacatcaccaaaactcgaaataagacaaaacacttctaacattaaacattaaaataaatgtaagctatacatacatttaagaaagatgaataaaaacaagtaagataattatttagacacttcttccaaatcagagttgtgagtgatcagagcctattctggcagctcagcgtagctcagggcacaaggtgggaaccaaccctggccaggagccattccctcccagggtgcactcagacacacacccacactcactcagactggcaccatgcagacacgccagttcaccgaagatgcacgtttttgggatgtgggaggaaactggaataaggggagaaaacccatgcagatatggggagaacctgcaactccacacagacaatggcctcgtctgggaatcggtttttgttctcatcaacataataacagagtgacgctattcaaggacctgctgtacatccactgtggattgctctgtaggcccagttttcttagtttccactaatatcatttgaacaatttttcagttgcttggtgtttgattgttttagttgtttagacttttttccattttcctgacctatgatctcacgaaagctaatagtatctgttatggacttagaggacatccggcttctgaggccctttgggactgtacatgattttgcttggaaaaagcccaaatactgtaactaaaattgttcccgtggttattttgtccaattgatatgaggttgtttttgtctttttggttttgatgcagtgttttggtagaaaaacatagcaaacaagattttactaatatcactaagttaactttgaggtacccagttgttgctaacgtagttctctacatcaccaaatattactgatcccaccattacaagacctctgaaatctatccctttctctcccttcacactgtaggggccggatttctgaccctcaccacctctctgccaccagcttcatcctactgctatctgtctgcagaagaatcatctctggtggggccacttctctgcttacgcacattttctgatttcctattgcttccagaattaagtccaagtccatttgtgggacctctgagtccctttagattcaaatcccagttgccttccccaggttcatctcttgtcacttgcttagctgtgtctcctgtccccagccacattgagattttcactactcccagaaagacccatgttcttctggggcttgaaagatccctctaatttcttcccctgacccattcccattcattatttaataaaaactcaagtattacctcatctgtggtgcctttccctacttcctcagagagcagccccctttctgtgttcctataccattcattcactcattcacatattgaaatccaggtagttaaaaagtgctgggaattaagtgacctagaaaccttagtccctggactgtaaggggctgtatagggatgtaaaaaagaaaatgacaacattgagggcagggaggggaccaaattagagagactccatgcattagaacaaactcgaggagttagtgcctgactctgtgtgtgggaatgcagaaagcggaagagaagagaacaatccccatattcctgccttgaatgacacaggtatgtggctgtccatggacacaggaaatgaaaggaaggagcaggcgaggtgggaagtgggaccagtttaactttgaggtgactttaggacatctgagtgatatgtccagtgtgcaatgggatttatggatcaagagctcaggagaggaagcggagattaagttaagtttctgggaggttccaacaagcaaatagcagttgatgttaggaaaatttctgaatttaccaggtgctccatgcccttcttttgttccgtatcatattgtatatctggtgacatagcctgctttcccataaggacactcacttattaattcacctcgtatcctcagtgtctactacactgctttgcacataaaaatttcatttcaagtgagagaatgaatatgagttcactcagccatgtcttactcatgggtgagagaatattgaaattgatccatttaataaataatgtattgagcaccttctatgtactgggaagtctcctggccactggaaatacagcagtgaaaatgatagtgggggaacagtaacacagtaaataagcaagataatatcagatcataaaaatgatcatagctaatactatggagttcttattatgtgtcagggcctgtcctgagcatttaacatgaattttaaaatttaatattcacaatatcttataaggtagggaaattaatcgagtaatatggtggcaaatggtcagagaaggctgtttgcagttataatggagctgaattgtgaaggagccagcctcaatgagatctgggggaaggatgtttcatgcacagttcaagtaaatttaggttttattaggttcgtttttgccattaaaagtaatggctaaactgcagttacttttgtaccaatctaataaaaccttcttcttttaatgtgaaaagaatacagacttttcttaatcactgcaagttgcattcactagccttcaaatactctacaccttagttcacctacaaccaatcaaactagcagtagttaattgtagaatctaaggttagggcaaaagacctttccacgtacattaagacacacatgtagcttgtagtgagtggagattggggaattttacctcatttgtactcactaatgtattatgataaagatcaacaggaaaatgatatgaaaacacatgtagaaaaatgatttagattctaaggtagattaagttaggaaagagcaaaatcataaagatatacctactttatctgctcactcaatcagactaaattcttaatggaaaagtttcttaggaacaagcaaatataaacaattactttttaattcatttttcctgatctgtataggttatttgcatgtaaatcatattgacacacaaactttactttgtcaatcatttagggcaactatgaaaagattaatacagtagttggacttttgattttccatcttgttcttacgtagaatttttgatgagactgtgatggctaaagggagggaggaagttcatcaagggcccgaaatgtctgtctgttattagaaaggagccttcattttccagaacgaatttatccatagcaatctgtaaaataaatctgtgtagaaagacgtctcaaactaggcatgataaaagttagggccatactgcaggaaagaagcttagaaggatcttctcatccagtgccctcagtttataacccaggagaggccagctgtcttatctaaagtcacaacctagaagggatgagattctgggtagcatttcttgataaacttgcatatttacttagaattatgcattttaagcttatctatgtattttaattattttaagttagaaaactgtaatatagttttaatttttaaatataattatattttattgccttaagtttaatagtttaatagtttaatttatgtgggcattttgtatttaatcatgggaaagtaaaaactgttataattcaatttgatttactgaattagtgaataaatttatttttgtctgagtttttattaaaagagacgaattttaatcaatagaatttatgtatatatatatgtatatatatatatgaaagtctaaaattggaacaaaataaaaaggtgatgcaactaggagcccctttgtatctctactgtcttttgggcttcctatttttgcattatttccacttttattgataaccaaacactttccaaatgttaagtgtataatctcagagggctagttaggaatttgctgaagagtggtagagaaagccatacttttaactatctttaagcctcctcatgctttctaagaaattaatcttctttttctgtttcccgatctcttcccttctgtctgtttcacttggtactagatcagctcttatcattcctcctgcagttgaatccacattctgtttccaggattttacgaatctcaaaaatttgaaagctactgaccattctggaaaataatcagttatgggtgcacttacatatgtaaactttaatatatcacttcacattttaagtggaccttaccattgtttttgcctccttttgtgatataaatgtggggtaacctgatctgctgagggagtagctgtgatccaaacatgtgagttgagtgcccacaaggcagggctgaagccttggaggacctcgcatccatctttagctacaagtcaactggcttctcaaaaacagaacagcctcaacaatttgttgattcaaaacttttaaatatcaatatttttcagattaatacttttatttgtctaacatttaaatttatatatttttcttagctaaatgtttgtttgcttaattttaaattggtaataataaaaattggcttataagtgaacaattttgatagattttagttcattatttagttcattatttgtaaaatgcatattttccttcccctttatccctgtgttcaaatgaggagttattatttgcttcaggaagcttctcttggggattaaataagcattttcttttcttttcctttctttctttcttttttctttttctttttcttttcttttctttttttttttttttttttttttttttttttttttttttgagacagggtcttgctctgttgctgaggctgccaggctggagtgcagtggcacaatcacaactcactgcagcctcaacctcctgggctcaagtggtcttctcatctcagcctcctgagtagctgggaccacaggcgtgtaccaccacgcttggctaatttttaaaaaactttttgtagagacggagtctccctgggttgcccaggttggtctcaaactcttgagctcaagtaatcctctcgccttggcctcccaaagtgttgggattacaagcatgagctgctgcatcagggctaaataagcattttctataaaaggtttattagcataatatctggcctataggaaggatggaatttatgttagttgttgttgttgctactattattgccagaccctgtgctaggcaccgaagatagaaaggagataaaagtgtactatctcaaaaggatcaaagcctggtgatgaggcctgtagggatcgagttagaattacgattgttttctaaagatggaactttgtggctattttgtagtttgggtctggagccttctgccattttacacaccaggtctatgcatctgttctttaatgcaatacatagacctgcaaaaatacacaaaggattacagaaggtgaataaagagtagtatttccataacatagcatggaacccagcagcctctagttaaaaagttttactgtgcttcccaagttcttgatttaactttattagttgaatcttccatatgccttcaagggaagcataactgaaatacaactagcagttgtatttatattaagcttcatctagtttgttatcaaagtataatttttgctttgttgaaaattttttagatttgttttgattagtctgtgtagtgattaggcagatctgtggaaaacgggtactttccaatttcttgaaattctaaacatgttttaatggtttgtttcaacatgttttactttcaatgttttagtagctaaaggcgcattactgattagaagacaaataagctcttttgagttactttacaaattttcatttatctctcatggtaatttacaattactagagaacttcggttaccttaaaaacatttgagagtaatttttcttagcaccatagatggtaatgttgatatgtggaacaaaatcttcaatagtgactggctctgatttccaaggaagttgaaggtacattgaaaacattttcagtattaagaaaatacattaaaaataacccatttaaatatgctctactagatcctcaatagtaatagtatcatgttcacagtttattctgttaaatatttggatttttcaataatgggtttctttccttttaacagttttctcctgagtggtccataataccaacttgttaaatttgcaaaagagatttgtatttcaaatttaagtgcaagaaaaagctaatgtttctactgatgttgtttataacaagagagtgagaaggcccagtgaaactgtgagaagaatgatttatcttacttactgcattagaaatcggcctgttattacttcgttggcttctacaaaagagcttgtaaataaaatgttatagccctaattgaaaataaaaggatagtgaatggaatttagccctattcatccttttggatttaagcatgattcatttcagctaaaaattttaaaaatcctcactttcattatggtttttttttttttgtttgttgagacagagtctcactctgttgcccaggctggaatgcagtggtgcgatcattatgtacattttttaatgcaagtttaatgagtatccatatctcagattagcacagcaattttttgaggcatttagaaattcccagatgtactaccatgggcagctgaatgctttggtgcaagcgcaaggtaggatcagagcaacctagggtgaaatcctactagctgtgtaactgttgcccactagctgtataactctgagccagttggttaagcgtgtgaagtctcagtttctttacttgtcaaatggggaacaaaacaaccacctcacagggtagcttagagaagaaagagaaattcattatgtagagcatattgcagtgttttgttaattatacttggaatcctttttaaaaggatggcagtaggctgaattacattcctgcatggcagtaggctgaattcttacccagtttagtatcatctgatattgaatacagctcacttcatataggatgaagtgaataaatagtctaagccagaggagttggcaaactatagggccttctgcctgtgtttgtaagtaaagttttattgctaattaccctgatttgagaaacatgacactgtaccccataaatatgtacaattattttatatcaatgatacataaaaaagttgttttattgcagttcagccttgcttattcatttaagtgttgtctgtgtttgctttcatgctatcatggcagattagttgtggcacagaccttgtgacccataaagcctacaatatttactgtctggccttttacaggaaaagtttagctactcctggtctaagctgttgtcaggggattgcttaattgatattatgaagtgttgtggtttgcacaaatgagaggatccattttaagtgaattactgtaggaatagactacagcattacttagctatttttgggctcaccagagaagtccaaggattatctgtgattagtggtgagatcctctggaatagatgggaataaaaacctagtacctacagaagggcatttggacaggaccaaaaccttctgtggttcagtttcagagtggggagaagccagggagtgatattagattcctatatgacatcctttatcagcctacagctatggaaattgttccaagcattcattacaaagtggatttagttattcttaaaaggtctttgtgaatcatcctaaatcttaaattaaaagattgtaacccgatattactatgtagagaccctggaattaatgcattttacctggttattagagtagctgcttcaggtgccagagtaggcaaaactagacaaggctctgtgtgctgcaaatgactgaaggtctgaagccatattccacttaatttaatcatttttaaaaattattattttagagcagggtctcaccctgttgcccaggctggagtgcagtagtgtgatcatagctcactgcagtctcagactcctgtactcaagtggtccttccacctcagcctttgagtagctaggactatagtcatgcaccacaatgcctggttaattttttaaattttgtagagatggagtcttactatgtcgccaggctggtcttgaactcctggcctcaagcaatcctcccgcctcagcctacccaaatgttaagattataggtgtgagccacagagtctggcttcaatttaataattttgatagatttaacatcagatcaattgctggcctctactggaagttctgagaagtctttcatttttcataataagtaatattctaccatcccaaagtctgcttttctccttaattgatctttggggagttagacaatacaatcatcattcctgagagctatttggtgctttagagtttacaaagtgcttccatttacacaattttattcaaataacataatcaccttacaagctagaagggttggaatcatccgtatttcatactgataacaacttcaggttctacgaagttaagccacttgcctaaggccatacaactctaaagggtgaaggagggacttgatttgtcttctgacttcatatcccatgttttctctgccaagttattttgtctgatgttaactctccgccaagtttactgaaaaatagctaaaatataaagtctcattagtttttaaagtaagcatccagaggagagaacatagagaccttttcaccagaaacacgtatcatctagatcagagctggcaaactgttggaccataagtctcatctggcctgcagatgtgtttgacttagcctctataatatcggcctgtacatggctttattaaacaattacatggatttagctgttaagtaatatcacaaataagtccagatttccaacttctttagaaaagtcagatctggccacactgtgcccacattcatgcatggcagtaggctgaatttaaacagttgtctcctttggagggggcatttgctttctagtttctacaagtcactataatgccctgttgccctcccattcaaacctcacttcaatcatttagggtacctacctgactcctggaagcatttgagtttgtgatccctgatctagactaggatactcattttgtgaatgaagaagtgacattcgaagtagtaagtcaattaggcagcaccaagattacaacttgttttcctgagacagagcccttttttggatcctggcttcatggccagattatcattactgaagaataacagaacagcaagggaatagtaattagaaatgccaaaatgatgcacacttttaaataaatggatatggttttagtgagggtctgctatatattttatatttatgccatattagccagacttaaaatatttcaaacatcagactatgtattgtatgtttcagttttgaaaacatgggtcactgtaaactgaatgaatgaatttcattttcttatgttggagaagttgattggagggtgcatttttgaatgaatttcagcactgagactgagtttcagttttagaagcagaaggtgcctcatgttagataatagcacatgttaaagagaaactgagggaaagagcagtgatcggtattgcgggtatatactgagaaactgggatgagtggatgcaggagtggactagcactgtcagccacaagtaggagcatgtagaagctgagtgagaataggcagtttaaaggaattgacggtgggacctacccagtgataagaaggggtgtcagatatataaatgagctgagtgagtatagtgttgatcacttattttatttcaatggcttttgaggtacagtggtttttggttacatggatgaattgtatagtggtgaagtctgagattttagtgtacctatcacccgagcagtgtacattgtacccaatatgtagtattatttattcctcaccctccttccttctcattctgtgtccattatatcactctgcatgcctttgcctacccatagcttagctcccacctataagtgagaacatacagtatttgattttccattcctgagttacttcacttggaataatggcctctggctccatccaagttgctgcaaaagatgttatttcattcttttttaatggctgagtagtattccatggtgtatatatatcacattttctttaaccactcattgattgatgggaacttagcttggttccatatctttgcaattgtgaattgtgctgcaataaacatttgtgtgcagctgtctttttgatataataacttcttttcctttaggtagatagccagtagtgagattgctggatcggatggtagatcaatttttagttctttaagaaatctctgtactgttttccatacagggtgtactaatttatgttcccaccagcagtgtataagtgttcccctttcaccatattgacaccaacatttattgtcttttgacttttcaataatagtaattcttgcaggagtaaggtgatatctcattgaatcacttattttttgtgaagtgtaatttctaggatggattatatagttcaaacccaaggggataaattatatcctattgagtgaaagaactaactaggggacttgcaaaaaataactataataaacaatgaagagtagaaattcttgttttttgaatgaacctacaaaatgcgtaaaacaaaatatttgatgaaaacattttcagattatgatggctgttcttattactattcattcattcattcattcagtaattatttatagaagtttgctaggtgtagggcaccatactgagcattggggaaacgtctctgcctttgagttgcttttgacctagttggggagataaaaaaggaagacatggagtattctacataaggcaagcccatgttaagttaatgttttggtggcttagagaaagagacaccacttctcctagcttgactttctgagggatgaggaccaggaatttgaactagatctgaggggatgagtaggatttgaaataccagaggaatggtagaagtttgtttagggagggccttgacttccaggctagataatttgcatttcaaagagatggtttccaaaactgaccaagtgagcttggtgctaagatcataatatacatttaaaagtgttttggttactctggaggctgaggcatgagaatcatctgaacacaggaggcggagtttgctgtgagctgagatcgcaccattgcactccagcctgggcaacagagtgagactctgtctcaaaacaaaacaaaacaaaacaaaaaacaaaaaaaaaagtgttttgggatggattactttcagtggagtttgtaaaatgcctttgtgaatagctgcgatttagaaaacagcttgctcaggagagaatcaaaaccttcctaagcagaaataacccctcagacttgcacctggagtccacttggagattctcccaggtattacttaggatacacagagactaatatacaaatgaaggaaaatgtacagatagtgcctactggtaatagattacagttggagaatcccattttgctaaagatagtattgagtctggaatgttatttaattttcagttcctgtataggcctatggaagtcaccttatattggagtctttatagagtctctcatgttacagggcgctgctcaattaccttattttgagcagcagaccacttgaggaagacacattagacctaaacgagctcatcagagctatttttatttgctcatagagatgtagctgacatgatgggtaaaaaaaaggaggcaaataaatggaatacagtttctgttattattcctagagatatgagtttgcaattgcaggtgctggatataattttaaacatgccttttaaagcaatgcagcagatattttgtggatattacaaacatacacctcaggacaaaaggaaagctaacctaatatgactggaattcaaggtgtatggtaagatttccagtgagggtatgtattagtccattttcatactgctatgaagaaatacctaagtgtggttccacatggctggggaggcctcacaatcatggcagtaggtgaaggaggagcaaaggcacatcttacatggcggcaggcaagagagagtgttcaggggaactgcgctttataaaactgtcagctctcatgagacttattcactatcatgagaaaacccacccccatgattcaataaccttccacagagtccctcccatgacacataaggattatggcagctacaattcaagatgagatttgagtggggacacagccaaaccatatcagggtagattcagaaaatgtttctctaacagtttagactgatgcaaaggtgtactttttggaaaactctttgatgacttaaagtttaagtggaaatgtagagtctggataaaactcatggaatttatagcattccaagattaatatataattttataggatgtgttatagaatatggataattaaattaattatataaccattaggtttgaacaagtattaatcctggagggagtgaaggttaattttacggtcaatttgagtgggccatcgggtgcccagattaaacattgtttctgagtgtgtctgtaagggtgtttctggatgagattagcatttgaattggtggactcagaagacttccctcctggtgaagtcgggcatcatccaatccattgagggcctgaatagaacaaaaacaaaggaaagagaaactcaccctttcgcttcgtgccttcttgcttgagttgggacctctcatctcatcttctcctgtccttggactgggatttataatttggctcccctggttctcaggccttcacacttagactgggaataccactggctttcctgggattccagcttgcagatggcagatgatgggatttctcaaactctatagtggcatgagccaattactcataatctctctctccacttccctctctcattctctcctttcctctctgtgcatatataacctcctttggttctgtttgtttggacaactctgacaaatacagatggtcattataaagcaactttatttttgtcacccacttttgttcttttaaatttattctgtgctcctacttattattgttctggtttgaaatttagacacagcctcatggttcttccagtcacttctacttccactggaagtacagtctgcttagtatatttattccaaacttcagaatttattgaagttaaagcttcccctttctcccagtgcaggactgctgcagacgagccctcattagtgggagatgtgctgagaagcccttctctttcccactcagtgcttctacttcctctcatcctctcctagcttactccccttgaagcatggtggggtatgtcatcagagtgaggagaggttggagctgaaagcacccactgtcttctgtggggcctggaaatctctccctcaccggagatcgctcatctgtgcttgtcttccatgggtgaaaacatttctcctggttcgtctctcctgatgctttgctcagctctgcacacaacttcagtttccttttgatgaggccccttgcttgcttctcagcattcattttttttttttatgattagcaagatttttttaattatactttaagttttagggtacatgtgcacaatgtgcaagttagttacatatgtatacatgtgccatgttggtgtgctgcacccaccaacttgtcatttaacattaggtatatctcccaatcagcattcatttttaaaactgtggcaaaatatatatattacaaattcatcattttaactattaaattaaattaatttatttttgagacagggtctcactctgtcacccaggctggagtgcagtggagtaatcatggctcactgcagccttgacctcatgcgctcaggtgattctcccacttcagcctcctgggtgtctgggaccacagacacacaccaccatgcccaactaatttttgtgttttttgtagagacagggttttgccatgttgcccaggctggtctcaaactcctgggctcaaccaacccccctcctcagcctcccaaagtgtcgaaattacatgcatgagccaccatgcctggcaatttcaagtattttaaagttataattgtgtgattttaagtgtatctatagtgtagtgcaaccatcacaccacacatcttcagaactttttcatttccccatactgaacgctgaaactgtactcattaaacactaaccctccatttgctcctccctccagctcctggcaaccaccattctcctttctgtttctatgaatctgactactctgtaacctcacataaaataaatcatatgatatttgtctttatgtgactggctgttttcattcatgttgtagcatgtgttcaaaattttcttgtttttggaggctggataatatccgcattttgtttattggttcatcttttgaagggtacttgggttacttccatcttttagctgttactaataatgcttctgtgaacataggtatgcaaatatctgtttgagtccctgttttcacttttttggggtatatacccagaagtgtaattgctggattgtatgacaattccatgtttaattttttgaagaactgtcacactgtcttccatagtggcggtaccattttacattcccatgggttccaatttctgcataccctagccaacacttgtacttttctgtttttatttgtttgttttataatagcaatcctaatgggtgtgaagttgtatctcattgcggttttgatttgcatttccctagtgactggtgatgttgagcattttttcatgtgctttttggccatttgtatatcttctttggagaaatgtctattcaagtcctttgcctgctttctaattagattgtttgtttttgttgttgagcatcagcattcttgggtaggatttctggtgaccctgtgctggtccctgtgtgctccatcatcagggtcagggaagcatacagatggcacactccagtggaggaactgaggagagcttggtgaagagattattctcagaagtgtgggcagtgttgagatactaacaagggatgttgaagtgccttgtgtaacagtgtagagtcattatcacccctgggcctgaggggacaaggagaaggcatgaggacagagagcctagagagagctacatctgcaggagaggactgcccagcagaagctgtcaacttctctagaacctgtgctaacccagcagggagaaaactggggggataaataccccattctctctccccttccttgttcttgtcttctgcaggtgcctcctgttggacaaatgtagctggaagtctgtgataatttccatcaaggtcagtctcttgggcatagagcaggatagtaacaggtggaggctgggtctacagtggtagacaagatatatccagcacatgagtggaattcctctttggtccacaggatcttctacccattgttgggagtgcagttacttctcaaaccacaggcttttctctgctgccctaggctgcttcagtgagtcacttaccctttagggttctcaagagtgtgagttagtcgccattccaccacaaccaggaagcatgtgagctctaaaaattccactgaagctccttactctaggcttgaggtgagggacaaattcttccccaaattcttcttgcggggaagatgagactcatagcacaccagtaactttctccaaatagtcttctgtaatctccaactacctagacttttatgccctcagtagagatgaggagaagggtaaaatctaggaaactgcaatctttacgcagtcctttcacacctcactgtgaaatatgctggctatgggctaggaactttagcagaaactggggctgaattggttgtattttaacatcctgtaacaaacatcatatgcagtccatatccctaaaagtttgtatattttggtaaatataaacacatttttaagaaagtcatctgagtcagaaatgggaaagattgctttatatttgggattacttcatatttggggatataagatatgctttctttgacattttcccaatgtagaaacacaggccaaataggataactcatgaattccatgaaatttatccaagtatctcttagctttaagtagctaaaacctaaattaggtaaatgaaaatatttcaacatttggtaaggtgtgcctaaattaaagttcacactagaaacattcttgtttaatttcaggtgagttcagtagagtagtttccttggcataaataatttcacatctaactgtttatacttttaaatgtattttaattgtgaaggcctaatttctgaatttagtttagaataaacctctagccattttctttcttatgtatgtgatccccaaagcagacgtgtcctaggcatcagttttcttatctaatcagagaaccagtgaagaaaggaggaacctgtcatctccatgcagaagcaagggattaagtgattaagctgtcatttctcaaagcctttctccaatgcttgccccataagttttgggttttaaatgagtttagtggaattctgcagtcttaacatatggcacatatccatgacttcagtaaattacaggtactaacttttgttctttctggtgcagatgtgttatcattttgctctgttttgttttataatgtcagccttctctgtgttattaatgtagtgtcatgtgctaccattttaggtaaaaagctttttctgttatttcctatgaatctcctaggaatggacccatttggagaaccagactgttcattctttcctttccctccttttctcttcttccactccttcaaagtattggttgagttgctatattatgtgtcacaggcattgttccaggtgttggagaatctgaaatgaaacacaaagtccccctgctccaggagcttgctatcgccatccaatggaaaggaaagcaacaagtaaataaaaactgccacatgatatacatgtcagacaggagacacatggtataatgagaataccacaaaggggcctaatggggtgacccaaggtgggtcctgagggtttatgaggcaatagttccataatcaaggagaagaaaggcaaccctgggcggagagcacagcatgggaaggccaagaccagggaatccctggcatttgagcagtcaacaatctcagcgtcagccatgttcatggtgtggtacagtggtacttttgtggaggcatacattttaaattcatgccctgggtggccagtgtacaggaggaaatcacttaatgggggggcgtgtgcccagctggctgctggtatctgcttctttgtttggctctgtcttttgcttgctatcctagatgcaataactcctatgaaatgaaagcaagaactttctgtcttagtgacaaatggtcatcttatgagagttgaaaggttaaattgtcacatgagtttatgcacaggaaatgtgatttgggggagaaacaagtgcctctgcaaacatttttgtatttgggaagtggggatgattgcaaggtttatgcctgcagcgacagggagggggctgcatacatcatgttgtgtgaagagacggggcattggaggaagagcaggtttgttcaaggtgacgggcaagagggaaagggaaaggagggagaagaaagatggaaggagatgatgaattctgttgagtttgaagagagatccaggccagaaatgctggttaggaaggcattggtgctgcatggtagtggaagtcacaggggtggactaggtcatttgaagaatgcacagagagatgagagggctaaggaaaaatctgaggaacagcacagggcatttttagggtagtgaaactattctgtatgatactgaggatatggtagataaatgacattatatagttgtcaaaagtcatagaactacataacacaaagaaaactctattgtaaactttggaatttagttaataataatgtatcaatattggtttatcagttgtaacaaatgtaccaccagaatgcaagaggttaataataggagaaattgtgcagtgtggggagaggtgaatattgtaggagcactgtattttctgtaaacctaaaactgctctaaaaataaagtctattaattaaaaaaaaaagccagtgaagatcagttatgtgcatagcagctatacttctgcagaatctccttggtgagcgtgcttttttcaggcttacataatacagttaaaagaaagaaaaataacactcccctcacagagaaataatcagctgaacaaatcactagttatcagaatgcaggctgtagtacatcctgtttttctaactcctctaaatttactagtaaagcaacccaaattgcatggaggaggggaggtcattgcttgctgtcaaggctgcactaatgacattagggtggcattagcgtaccagggctctcctagtcctcactacaccacattttgaatgagttttgcttggacaagtgttgagggtgaggtggcgggagagggaaggagagagatagcttgtgctttgtcctattacctgaaccagactcaattgtcaaacatttttagtgtcgttttcctgtgctcacggaatcctgagagtgtagcactactgtggggagggcaggagccaacaggtatagctggcttatcccagcatttcttccttcccatctgtgcacagcgtaagtggcacagtccacagagtccgctcccattttctctcttcccccttaatggggcgggggcgtgagcccagctggctgctggtatctgcttctttgtttggctctgtcttttgcttgctatcctaaatgcaataactcctatgaaatgaaagcaagaactcaaagctcaagtggtcaaagctcaagtggcagccaagtggtttcttgtgatctgctgaggtcggcttctgataattagaagtgacaggtgatgactatgttatcataacctgcagccacaccaccttcttctggttctgagacaatgtgtagtagaaatggttatttgttcatcgagctggtccccacaattcacacccaaagaggccttttcatggccctgcacgcactgatggctgtttcaggtagacaagcccagcagtgtgggaacccagatatctcccattctgtgtgaaggagctacctagtttctggaatttaactagattagaacctcaagtgatgcattataggtctgaagaagcatgccaatcatgacctttatcttccattttatgaacccttggagtggagcctttagaaagaggaaacagcagagagagggccttaccttgtggcccatgtggtgacattttaggagctgcaaaaagggtccctttgcctcccaaaaagttccctgaggctgattcattcaattctatatttaatgtttcatttagtaacactttagattgaggattattgttttatgttaaaatataaataccttctgggtattaactcttttcagttatagcctttatggtaaaggagttgccaagggctcagaatttgataaggcaaatggaggagaaagcatgagggcttagtgggtgggagtggtggagagtgatatggagcgagacagaaactgaaaactgaggccagaggagaagaaactgtgcctatttattcagtttttcctgggagtttccttgagaagaatggagctatgtgtgtgtgtgtgtgtgtgtgtgtgtgtgtgtgtgtgtgtgatatgagattgcttgtgcgcctgtgtgcatgtgtgtatgtgtatgtgttgaacgatactgtggaaagtttgggataagaaatgataactgggaagagccagacatcgaatgcaatattctcaactaacattcttcttagaatgatgcttggttccctggagactttatgatcatgagtgctaaatgtgtgaggggtgtgtgtagggaggcagaaacagtgatggtttcatagatgtccaagttgctgctacctttgtaaaatcattatttgtcccttcatctctagcctgttaggtaccaatgtatttattgcccactcgaactacttcctctcatcatgggggcctcctgtttttgaggcaacataggaaattaggactgatgacgctgcatcagaaaagcttttgttttcacttggtttaagtctgatagagaagttggctacatagaacctccacaggcagttgctccaatgacttaaaatgaatttgtccttctgcctcaactctccacagttagcatgtgctcattcacccactcctttttatggcccttggattcacccaatccaaggtgaactacttccttacttctatgtcttcactgtcttacgatcttgatcaaacagacaacacactcaacgaaggtgtgggtgggaacggaacccacccacatgattgtgaatcacctagagactggcagcagaagaaaatcactgccaccctaagccttgagtggccagaggagagagacacattcattttcagaactagtgagagctacagctctggtaaggaacctcccaacaggagttgtggccatgggtaggacagctcaagaccataagctggcaaggaaagatcacagaggaaccagtatcctgatctttctctattcagctatttcttcccattggtggaagcccaagagaaacacaagaccagggtccctaaaggtcagcttctcaaggcacagagcagggcacagaaaggtggtgtgtcatactggaggggcaaaaaagctggcaccatctcactttctgcatgtataaaatgaagacgtaaactgccaggattgaatgtgatctacatacaatcatttagcacagcacctggacaataaaaaggaccctataaatgtagtttagtagtagcagtgatagtaatattagaacatttttactacattttagctatatcataagtaagtggctctccctgtagcctaataattaacatcccttatcatatcctaaaatttgtaagaaataggcttaagtgagacttgcttgtttagtgatattcatacctgtagatgtgaatgtatagctacatgcttctttaatttggacagagagaaatgtagagagttgtgatttcatgatttcaattctacagaattctatagattagatgtatagggcgttgctgccctaatggataccataacaaagaaataccccatcttttcctctctccatgactgagcatctgccttagtgcagattctggaaaggaggggatggaccatgaaatttaaattgcatatatagatgtggctatggaaatcatatagaaccaacattcctccctttcttccctctcctacatattgtatatgtaatacgtatgtgtgtgtgtgtgcttatccacagaatgtgtgagtttgaggaaaaaaacaagataaaacacattccgtaggtagtgcagtcacacatagctgaaaaacctgtatcagttatcaattatctatttgtttggagcaaattcctgcaaatcattaaatatacaaatttccactttcattgttaaattacccaaagtataatctcaaataacctctgacctcctggagttgatgacagttttatactgaaaatagaatttttttttgtacatctatagtgtatcttaaattacctaaaagaaagatgatgccagggtagttaaggagggaggtttcagttttggccaagtttcgtacatcttaattgcgatactttgcaccccatggatacctgtgagtgcaaaaatgtctgctttgtttggacttatatttatttttattgtcttcccacttttattttagattcaagggatacatgtacaggtttgttatctggctatattgtgtgatgccgaggtttggggtacaaatgatcttgccacccaggtactggtcatagttgtttgtagttttagaagaaaaaatgaatgagactcaatttaacactggtaatatcccttctttcccagggaaatttagtgagttgaaagttgcaagagtaatgctgttagtgttagtcacttttcaaaagtgttttgccatttaatattcatttttggggtcttctgtgtggtcatgtgggcctactatattatactttgaagagatcagtgaagtcatatggtttaaagtttcacttgatgaatgagcaaactggtgttcacaggggcaaagtgacttattcgaggtgataacactggtgagctggagaacaacctgctatcactttatttcccttttttttttttatcttggagacttttattgaaaggaactattcaaacttttcaaacttttaaggtccatatttctgagttctgagtgttctaatttgattattcataaaaaatatgcacagttcctattctcatggagcggatagttgatttatgaatatatgtgtatgtatcctgttaacgagtcatcatgactaaattaacttagttaagctacttaacttttcagagccttaagtttcttataggcccagcaagttttattggaaaaaaatgggcttcgaaggcagagagatgtggtgttttctgtttactagctgtataagtaactcatagaggaataatagcctcctcatggggttgtttagagggtaaaatgaggtaacctacatagaatacctggtttatgcattcctattgtatctgtaagttggagatgacactgtgcaacctatttaccacatggcattgtgattaccatggagacaatggttggaaaagggcactgtgaacagtgaagtgctgctgtcacatcacttattgagggattttttttgtttgcttagttatttcaacgtaagctttctattgagggacaacatgcacacagaaaactacacacaagagtgtacaactctatgaattttcacaaagtgaacatacttgtgtaaccagaacctagataataaaagagaacctcctagaaagccccaaggtacccttttcccatcactacctcatctcaaagataattatcctaacttctaactccatagattaatttctcccattttggaactcttaaccaatggaattatacagaatgttctcttccctttctggcttctttgactcctattatgtttgagaggttgatccattttttttctgtgtagttgtggttcattcattctcatggctctagagcaggggttcccaaaccccggtacggtctgtggcttgttaggaatcaggccccacagcaggaggtgagtggtgggcaagcgagctaagcttcatctgtatttacagtcactccccatcactcacattaccacctgagctctgcctcctgtcagatcagtggcggcattagattctcataggagcgcgaaaccctattgtgaactgtgcgtgtgagggatctaggttacgtgttccttataagaatctaatgactgatgatctgtcactgtctcctatcacccccagatgggactgtgtagttgcaggaaaacagctcagagtttccactgattcttcattatggtgagttgtataattatttcattatatattacaatgtaataataataaaaataaagggcacaataaatgtaatgtgcttaaatcatcccaaaaccatctccaccccctggtccatggaaaaattgtcttccacaaaaccagtccctggtgccacaaatgttggcaactgctactctagagtgtcctattgtaccccacaatttatgtatctattcttcagttgatgggcttgtgggttgtttctaatttttggcttttatgaatagtgctgccatgaacattcttacatgtgtcctttgagaacatatgtatgcatttttgttgtatatatatcttgaaatcaaatttctgggtggtaggatgggtatacaaaggtttgattttaataaatagtgacaaataattttccaaagtgtttgtaccaatttacatgactacaaatataatattttttaacatctgtaaaattgttacattcatagtgggatatacaaaaatacagcttgaatcattgaaaactgggtttatgtttttctcttttgttgacattctattttagttatgttcttagattgcatggaatacagcctcatttccagtaacttagcttgtggggaagaagggtgttattgtaaagattcttatgcatataaactcagaaaaagctaaacagtgaagctttaaaaaggccagaaaaatgtacaggtgccaggctgtgggatcttgagtgttctgctctttaggattgattctggtatcctgagggtctgtccatccttgtgggacctgtattctgcaggcaggtaccataaggtactgctgtaggccagcatcattctgagtgagcatctgttttgtttggttgctcttctaccatgcactttgttaaacatttggtcatcatcctgcttaagggaagcccatatttgcaatcatttgtcaggatttccagccctctatgtgaactatgttaccatttctaagcaattaacttctggaagctacctgctctcattggtccctaaggagtagatggatgtactgtccgcccttctagatttagaggttgttagatactctgtatttatactagatgctaaatgaactacacagaatcataagaaattcataagaaaactttagcaatcacaattttttaactaataatgtgagtttttaaataatagacataattcttaatgtaaacttctactaagactactttacaattttttttaatatcttaaaaaacaaggggcacttcttgccattttgtgctaacttagtctttattggttgaactagtgctaggcaaggaaggaattagctatagggagcagggaagacagatctaaacagttctgcacttatgagcatattagtgaataatagagatgctccttatggaacccaggcatgaaaaccatccttggacctgtcacatcttggaattatgtgctggactcttgtattggttcgttgactttagttgtagtttaggaagtgatagccagaaacttgaactcttgcttctagcttttagaccttctacttaagacagaagaactatgtatttcacctcgtctaacttctagtatttcagataatttcttctcagatacttttttttggctcaacctatgcttaatatttttagctaatgctcactctgtcatcattaaagtggtttgcagaagaatatatggcctacgcagaagaatatatggtctatgcaaataacttctcactgtacattctctatacagacctatacaaatattttcataaaacttctgagctggaggtggaactattacaaagtgttgtggttgaaaaaggttgatggattgaggttattcctcaagacctctttccaccacaaaactgaatatcctaattagagaatccattagaaggaacttgaccaagtctgtggcttaatttatgcctcaaagtgaagtgattaatattattcaatgcatgcataggaccagaaattcttatttgaataagttattcaacttatagggtaattaaaaactgaaagtaaactgtcatttcactgctatattcctatatattaaattaaactttaaacattatttaaggattcaatgtaatatatttagcttttttttttaaaagcaagtctggaagctgggccaatttctacaaatgttctgctcagtagctagccttttgtggaaactcaatagatcttaaacacttggttcatttaaattactcttctttttgctttcaggaaagattgagaagagttacagggaagtttagtggattagtcattcagttccttgatggatcacttgcatgtgccaatgccagggaacatttaactgattaaaacattctgaatgaatttgtcatttgggggtactctttgaatgaatatctttattgcattgactgtgtcctactgatatgacttaggcttacttccaacattaattctaaagaggctctggctaacttatctgtagaatgtgtgtccaagtcaagttcgtgatgtatttggttaaaaaaaactttgtggctcttgaaagaaatacaaagatttagtagtcagtattgtttataaagtctagggtggtcatatttaaataataaatctaagaattagatgagtactgttacacatttttgttaataaatcttaaatactggaaagaatagacttaagaaaaatattccaacattgaaaacctaagtatctaaacatatttcagtctcatatgccaaaaaatatgaaattatagcatttttggtcaggataaacgcctcctgcatctttttgtataagaagtattttgaatgaaaatagacttgccatgtcagactatttgaaatttaagttctgttttcaattttaggttcttaaaaaggtccaacttagccaatgaacataaaagtgcttactgctaatttagctgctgctgcagaacatgaaaggaaatcatgaggccattaacacatctagaaatagtcattttctagctttcggttcctaagatagcttagtgaaaataaaatattcagacaaggcagggtagggaggtgagtttttaaaggattttctttttaaactttccttccttccaccctcgctccctcacttccaccctcctttatttctccttctttatgtgtgttaacttagaacttcacttcaagattttccgagtgctaagtgataggggcagtgagatatacgctttatctccctgcataggcaatgagtaaaaaagatgtgaaattatggcaaattcaccagcagatttcaaaggtgaaaatgcccttcttgtaccagggttaatatgatctccagccatccattcacagatcatgctcactctgttgatggcaaaggaaagttctctttgaggccttgaaatggaaactgcacatcgtgcctggaaagtccctccaggctagtgttcaagaagtctttctttcacacttcagtttcttcattgcattatatttactgactgcctaccctatgttagaccctgtgttaggtcctgcagtcctgttcacaaggatattatagtcttgaggggaaggcagacattcattaaagactcacctcagtgttgacgggcagactgcaataaaaaagtatgcggcactgtgaatgtgtaacaggtgtgggcggtggtcagggaaggctgagactggttaactgggcagaggcaaagggttgcaggcaactcgcctgaggtggagaggcaaggctggtgacaggggcagggaggccgtggacagccgatatcacaaaaggcggtgctgaaagatgcaaggggactgaggacttctttttagctgagcaaacagtgcacatttcttccactcagacttttccttttctaattaaaaaaatggggacatccacatcttgataacacagttaatgtgtgaatataataactgcttaataaatccttgttgaaataggaatgctgattaaggcacttaggccagcagctgaaggaggcttaatatattcagagatgattcctaggtatctagaaaaggatattttaagctaagagaaaagagggacagttcaccagtttcttcccttctagggaaacaacataaaaggactggagttgttaaaagacagggtgagaagtctgttgacataaaacatgagaaaatgaagtttgtgatgttttgatgcagaagtaagttatcattattgttgagtgataatggcattaattttctgaagatgggcagctcctttcatcccatttaatgtgtatgtgtgtgggcatgtgtgcttgcatacctaaggctaaattaatttttggtacaatagggtagggttgctagatttggtaaatggaaatacaaggcatcaagataaatttgaatttcaggtaaaggaagtataacttttggagtatatatatatgtcccaaatgccctaccagagtggaattttcctcttaagaactctggaggcgtgttgcctcatttcccccatgtttttagtcattgcatgtataatgtttatatttatgtttattcgcagtttatttttgccacatatatttttagaatctaaattttcccaatagtctggaacctttggtgggtgtacataatgtgatgaaggattctcttcctggagaggctgctgatatatagccaagattctgtctttgtgctctgggcttctgtctctgtagtgttaatatttcaagaatgagactagagcatttttcttactttagtgccctttggagcaacagaaagctgcctttgctgcaaaggaccctgtggaatgattgttgatctgccttctagaaactgagctgtgcccaaaaccttttaccagtttctaaaggcacctgctttcattttcctaggaaggttctttaggtgagcgatagtcacccctatatctctgcaataccaagtgagcagcttgttgtgtgtagataccatgaaatagaaacagattcatgaagataagattagaaggtaatctttagattacagaaacagattcatgaaaataaggattagaagttgtgaatgaaaacaactgttgctttggatggctggatttaaaaatgttcctcaatattgatgatgtggtattttaattaaaaaataggatcagatcatgacacatagaagaagctataatatgcacaatgatctgcttttccaggaaatgagtatctttggggatcagcattgagctcactacacatgataaaaaataaaactcattggaaatctagaaattggcaactaaaaattgagtcaaaatgtgttttaaccaccccacccccctcttgtttgtttttattcacttctgataacctactggctgtttagttatattttatggttgttttggctatcacaaactcatacagaatagctggaattatcagtctcaacagggaccatgaagacatatgtgtgtaattcagtacatatattaaaaaatagctaatttacaatattacaggcacaagggagcccactgatgtgaagtttcagtgaaacagtgtaaagaaatgatgttagttaaatatcactatttctcaaagtaaaggatgtcattgtattagtagaatgttaaccctctcttttatgggtcagttacatcaacttcatcataaaccctcttcaaaaaacatgcattttaggacttggatatagtcaggtctgtgtttcattaagcatttgttcagattccagctctcttgctccacaaccattgatatttctcaatttatctataatttacaccctgactgtctccataaaagatataatgtttataaggaaagatatatgcaattagataataatttgaatgcttttacagggagagggaaataaatatgccacccaaacctaggctaatacattcattgaaagcgagtactaataattatttctaagcctcccagcagccaaggcaaaaagggactccagtaacataacatgatcattatttcattgtttacttttactactccctattccacgttgagattgttagagatatgttagtgatcacctcaagtcttattacctccagaaatgtaaagtttgacttaaaatcacaatgaactcttccaatttttttcatactatattgcatgtgcttaagtaattctttgggcttggttttagatttttaaaaattatggtaaaaagcacataacattaaatttaccatctcaaccatttttaagtgtagggttcagtagtgttaaatatactcacattgttgtgcagcagattgctacaactttttcgtcttgttacactgaaactctctactcatgaaacaactccccatttctccttctcctcagaccctggaaattaccattctactttctgtttctatgaatttgaccactttagatacttcatatgaatggaatcatacagtgtttgtcattttgtgactatttcacttaacgtaatgtcctcgagtttcattcttattgtagcatgtgacaagattttcttttttttttttaaggctgcataatatcccattgtatatatttacattttccttacttattcatctgttgatggacatttggactgcttctatctcttggctattgagaataatgccacaaggaatgggtgtccaagtatctcttcaagatccttttctgaattcttttggatatatacccacaaatgggattgttggatcatatagtaattctattttgaatttttggaggaacctccatgctattttctgtaatggctgcatcattttacattcccaccaataatacacaagggttccatcttctctacatcttcaccaatgcttggtattttacgctcttttgatggtgaccatcctgatgagtatgaggtgatatttcattgtggtttttatttgcactcttctaatgattagtaatgttatcatcttttcaagtgcttatgggccatttgtatatcttctttggagaaatgtcagtttaagttctttgcctattttagaatcaatttttttgttgttgttaaagtttcttatatattttggatattaaccccttttcagatatattatttgcaattattttctcccattttataggttgcaatttcactctgttgattgtttcctttgacatgaaaaagtttttgtgtcattccatttgtttatttttgatttcgttgtctgtgcttttggtgtcatatttaagaaatcattgctaaattcaaagtcctgaggctttacccctatgtttctttctaggagtttaacagttttaagtctaatttttaggtctttaattcattttgagttaatttttatgtatggtacaaggcaagggcccaaattcactctttttgcatttgaatatcctatttttccaacactacttgttgaagaggctgtcttttctctgttgtgtggtcttggcactcttgctgaaaatcatttggtcatatatgcagtggtttatttctgggctctctattttactccgttggtttatgtatcttactttaggccataccacactgtcttaattactgtttctttgcagtaggttttgaaatcaagaagtgtgatgcctctgactttgttctttttcaagattgttttggctcttttgggccccttaagatcctgtagaattttataattatttttctgtttatgcaaaaagtgtcattggaatttttatagagtttgcattgtatctgtaggttgctttgggtattatggacaactttacaatattaagtctttcaacccatgagcatgggatgtctttccatttacttgtatcttctttgatttctttttgcaatgttttgtagttctcagtgtataagtcttttatctcctgggttaagttttttcctaagtatttaatccttcttgaggctattgttaacagaattattttcttaattttctttccagattggtcttgttaatgtatagaaaatgcaactgatttttgatcatcgattttgaatcctgcaaacttttctaaattcatttattagttctaacatttttgtgtgtgtgacttaaaagaccatgtcatttgtgagcagagacaatttaggttcttcttttccaaattttaggctttttatttctttttcttgtctaattgctctggtaagaacttgtagcaatgtatcgaatagtcgtggcaagagtgggcatctttgccttgttcctgatcttagagtaaaagcttttagtcttttctcatcgaatatgatgttagctgtgggcatttcatatatggcttttattatgttgaggtagtttccttctattcctagtttgttgagtgtatttatcatgaaagcatgttgaattttatcaaatgtcttttctgcattgattgagatgatcatttggtttttgtccattttcttaatttggttattacattggttaatttttatattttgaactattctttcatttcatttataaatccctcttgatcatggtgtgatcaacgtgtgcttgaatttggtttgctattattttgtttagggtttttgcatcagtattcatcagacatattggtctacagttttttttgtgtgtctttttctggttttggtattaggataatgctagcctcatagaatgagtttggaattgttctctcttaatttttttggcagaatttgaggaggattggtaatcattattcattaagtatttgatacaattattcagagaagccacatggtcctgggattttctcttttggaaggttattttttttttttattactgcttcaatctcctcactagttatagatctgtttccgtcttgataggttgtatgtttctaggaatttgtctttttttagattatccaatttgttggcatataattgctcatagtagtatattttttattgctgtgacatcagtggtaatatctcttttttcttttctaattttagccatagagtcttctctcttttttctttgttagtctagctaaggatttgtcaattttgttgtttttttgggaaaaccatcccttggagtcactgattgtttctattctttatttgatttatctctactctaatttttatggtttcctttgctctgctaactttgaatttagtttgtttttctttttctagttactgaaggtataaatttaggttgttgattttagatcttttttcttttttaatgtagatgtttactgctatgcacttcccttttactactgctttcactgcattccataagttttgtatgttgtgtttttcttttcacttgtctccagatattttctaaattatcttgtgatttcttcttagactcattagttgtttatgagtgcattgtttaatttccacatattactggattttcctattttctttctgctattgatttttagttttattttattttgattggagaaggtattttatatgatttcaatcttcttaaatttgttaagatttattttgtggcctaacatgtggtctattttgggaatgttccatgtgcgcttgagaataatgtgtgttctgctgttgttggatgttgtatatatatatctgtagacccagttggtctgttgtgttgttcaggtcctcttgtttccttattgatcttctctctgattctgttgataactgagagtggggtattgaagtcttctactattatcatattggtgtctatttctctctccaggtctgtcaattttgcttcatttatttaggtgctgtaatgttaagtacatatctgtttttttactgttatatcttcctggtgaattgacccttttatcattatacagtattcttcgttgtctcttgtgacaatttttgtcctaatgtctactttgtttgatacaactctggtcacttctcctctctgtaggttcctgtttacatagaatatctttttttaacccttttactgtagcctatgtgtgtctgtaaggcaggttcactgattaccaatcagtaattctaatttctatcaattgtatgagacagaacactcaaacaagttaagtgaagcaactttataggcacagttaggcagcaagggacaacaaaagcctaggattcatagttccccaaagctcagagtgaatggaatctttctgtgtgttacctactttgcagtgcaggtgaagaactttgaaagcagtctactctggattgtatacccaggggcaatggggattgctgggctaaagtgctgcagggcatcctattcttggagggacaggaacagagcccaagctgtttcagatactttctccttatctcaagatgctgcactcctaatatatcctacagttatttttgagaactacaattgagaaagtggggaagagtgcagtcagtcaaggccatcttggaattcgttctgcactgtctctagtgctaaattgagtctcttatagacacaacatatggttggatcttatttttttaagtccttcggccaatatgtgtcttttaattggtgcatttaagctatttacatttaaggtaattactgatagggaaggacttactattgctattttattgttttcttattgtttttgtccctcatttcttctcttgttgtcttcgtgtttcatttttttttgtagtgacatgttttgattctcctctcattttcctttgtgtgtagctgtgtgtatatgtgtatatataaaaatttatatatattacatatatataaaccttaacgagtttgagtaagaagcagttcatgaattgggaaacaccaaactgaaagaggtttagtgttctgatgacaaagcataccttacatatattctatagatagtttatttgtggttatcattgcaatgagataaaacatcttaaaattatgacactgtattttaaactgataacaacttaactacaatcatgtagaaaaccttttacatctctgccccctcccagtttatgttattgatgacacaattatctgccgtcatatttcatatccatgaacatagatttatcattactttttatgctttattaaatagattttaaaaatctataccagatttataagtgttaatttttctagcaggctttgatatggttggctttgcacttgcctggggtgcaggatccttttaactggtttctagatttctctcaggggcattggtccattggtcatttttaagttcatatttttgtggttgaaggggagtccagggcttcctattttgccattttaatgttatcactcctggttctaggttttatatatggtgatattgaagatcagtttgtgattgtaagtgctgagactaaatgagactgttatcatcatcctttgattgtgaccactttattaggactatcgcttttcccttaagcctttttgtttcccagatgaatcccattaattgacttttggggtttaccttttgggtaaatcttcttactccaagactctgtgtctatgtaccatgctgattaatattatactagaaagtggtttgctgttttatttgactacagcttaactaaaaatcttttgactttccctaggaaaatctgagaaagcgtatcataggtggtctgaatttaaggcaaatatgggtggcgattagaccaattatagacaaacatataagaaagctgtgagaatgtgtgtgagatgaataattatgaaacaccaatgaaccagtgcagctggggatttaaacatctaagtgggcttaatgtatcattttatatagctgaagtaaattaaaacaatattttgtgtgaacattaaacttttcttcctttggtatgaatactctggggatttggaataagcatgattattataattcacacctcttttaaaatcttaatgttgtttgtggctagttgagcatgtgagactataaagtagtgaactctgcgctctttatggccacagcttttgttcctaattcttcttggcctgtttcaacctgtgtgtcatgactcccaagctgaactaggtaaaagaatgtgaatggatcatcatttctagaaaagcatctcagaacatagtccatttagataattggtttaaaaagtagccttttatttcatagaaagcagcacagtctaatacaaggaactggtgtgctacacatgaggacatgctctgccttaataattctctggctgtcttaggtagaaaagtttggggttgaaagaaaagtgatgtctgtttcaaaggaatgaaaattcttagggtgtaacaatagcttattagtgaagagcctaactttggctcaagcatcagactgcttgagttcaaatacaaattcctccatttaccatcaatgtgagcttggtcaagttattcctccaatagtcagtttcctcatctgtaaagtgagcacaatggtaggaccacaatttaattgattctgattggaattaaatgtactactctgtgtataaagaagtaattagtccagtgcctggcacatgataagctctcaataggtattagaccttttttttcttgttaattttgttgtttatgttatctttattataaccatgtgggaagttttatgctgaaaaatatataatactgaatttttttaaatagataatatgcaacagcatctgtaatgactgcataaacaattcttgcattttcctgaagtgttcattttaaatgattgattcatggctcggttcaagtatacacacagattagcctttgcaaataattcacttaatactagctacaccctgtggcagttgttttaaggtttttgatctctagggggtgtacagaagtgttctacttgtgcaaattgttttcctttttatgtcatcaattctgaaaacgtaggcttattacaggaatttttccccccatatatttttgagcctcatgcaattttgtatagcagtagccagtgaagttatccatattgcttcctctgatatagtctctgagtcaatttgttttaatgtttaaaaacttattgcctacttttccttgacacttacatgttcggcgtttcagtggaagataaaatgaagaaacttgatttccactccactagaaacaggctattttccttctatttcatcaaatctcaaagcttatagagattataactgcatgttggttattttactgttcttgcctatctatctatctatctacaaatctatctttctatcttgttcattttagggataatgaagaagcatttagtgggaccccacaagcataataaaaagtgtcactgtaagatatatttacaagcataaatataaaaagcaatatagtacttagcaaaaaatataacacattctctcataaggcacattttttccacacttttattttgtttttacgatttaaagtagtcacttaaaaatcagaaagcaaaagttttttgacctagatttagttggtttataataagtcttgttggttatggtgagtaatcagttaatacctgttaagctaataatgaggtaagaaatatattgactttatttcttggtgtggaaatgacttattcattcaacagatacttattaagtgggccaggtactacttgttaatacaaatggtgaataaagtggcttacactctaatgagagagacagacagctccgagttaacaaatggataaaaatatacttacatatgtgatatgcatagtgtaagataacgagggtggtcacggtggtggtaacctactccaaatactgtactcagagcatatgtgtgataaatgaagttgttgcagtatgtttaaaacactggagccaaaattttgagtgctcatttgaaaacactttatagtaaaacagtggtgcttagaatgatgcattaaaaaatatatatgactatcttgctgaaggtaaactttttttacaacttacctgacatgatctttctaaattacaatagattgtatatgttggaaaacatttttgtaaaatgtacaataagtctgacatgtgagtgaaaaaaaccttttttcttaactttcaaaagtgctaaaatgccctgtgtagtatcatgtaaaatagtgacactaatgcctcactcagtggggaggtagatgtggctgaggagggacagatgaatggatctagtcagtagtaacacatttgaagttctggctgatccacagagtcttttacttctagggtcaaggtggtaacagccaattaataggagagcaggttggaagaagagtaaaagatctacatgctcatgttacttgtcgtgctcacagaaaacaaaccagttttgtgtgagaaaattgtttcccgtcaacttgaaaacattgaatttgctcaccctggagctttctttgatgctcctctcttcaagtcccatgtggctgtcttccttctaagaaagctatttataaactgcagtgctctacgcaactgtaagcacagtggctgcagtctagtggaaatattttggggtcacaggtagttctgtattcaaatctcagctctggctctttctagctgggagacttgagcaaattatttaacttcctgatctatagcttcctcgactctaaaatgggggtaataaaactttgtttacaggattgtgtgaggattgagactgacacaggtaaggcgtcttctaccatggctggcacttagtctgttttgcttattacttagggctcaactttgaacgaacttgaggttacaaagctcagtatcaggttatcctcgggttgtttcctctgtaatcctcatttccctcagagcatggtgagagtcttgaagacatgaaacattttatgcttttctaccttccttgtgccttgcagagtcctcagtatccagtcagcacttaatgcttatactgccacttctggactgcctttcaacaaatttctcaaagttagagaccatgaagggcatggagactggtgcttttcatgccgtgcttctgcagattttggtggggaggcggtaataggggaatgaaggtggagccatatgaaataaactcttaaaggcatgatagtgaccaggaaaataatatgtaccatattgtgtgacaatccctatgcattgccaaaattgcccagtgtatttttattatgattaaaaccacaatgacacatatgatgcccatttaacatgctccaaaaacacaacaggaattcaccttcacaaagaacaatagacatggggccaagaccttggattctgaccagttttaaacacctgcttcctcctacacagtcgagaattatcttacacgattcagccttagaactgggggcatggtttaaattgtaatgtctgaggagactcaggttggctgaataagaaggatgacagtgcctttgtccagttaaatctgcagaggttgtcttccatcctatgcagctgcctaccataaaagaggaatctaggaaagattttccatatagcaggcactcagtacttatgtaaagaatgaaaggacaaaaaaattgttctctttgtatgtcttaatgtaaccctaagagttccaagccaattgttgacattattctaacatagcataaagatttggacagacctgggtagcacattgtaatgatatttggcttgttgatttctcagctctaagagaatctctgcttttgccaataggcacacataagaatgttcttaatgctttagtaataacatagttatccaaaatgttaaactttattccgcaaaattttaactcaaaaaatatttttcagcaagtttacatgtattccctgggcaacactggtcaggcattcattcaacagtagacatttaagtatatattatatactgttcttgattgtgtgggaatttcaaagataaatgagattctatctttgccacttaagacttacaattattggctcccaggcaagatggctgaataggaacagctctggtctgcagctcccagtgagaccaacacagaaggcgggtgatttttgcatttccaactgaagcacccggttcatctcactgggattggttagacagtgggtgcagcccatggagggcgagcagaagcagggtggggcattgcctcacccgggaagtgcaaggggttggggaactcccttcctatccaagggaagccaagagggaccctgccatgagggacagtgctatcaggaccagatactacgcttttcccacagtcttcgcaacctacagaccaggagattccctcaggtgcctacaccacaaaggccctgggtttcaagcacaaaactgggcggctgtttgggcagacatcgaactagctgcaggagttttatttcatacctcagtggcacctggaacaccagcgagacagaaccgttcactcccctggaataggggctgaagccagggagccaagtggtcttgctcaatggatcccaccccatggaacccatcaagctgagatccactggcttgaaattcttgctgccagcacagcagtctgaaattgacctgggacactctagcttggaagggggagggacgtctaccattactgaggcttgagtaggcagttttcccctcacagtgtaaacaaagccgcctggaagttcggactgtgtggagtccactgcagtgccacaaagccactgtagccagactgcctctctagattcctcctctctgggcagggcatctctgaaagaaaggcagcagccccagtcaggggattatggataaaactcccatctccctgggacagagcacctgcaggaaggggcggctgtaggcgcagcttcagcagactttaacgttcctgcctaacggctctaaagagagcaacggatctcccagcacagtgctcgagctctgctaagggacagacggcctcctcaaatgggtccctgacccttgtgccttctgacggggaaatatctcccagcaggggtcgagagacacctcatacaggggagttccggctggcatctggcaggtgcccctctgggacgaagcttccagaggaaggaatacacagcaatctttgctgttctgcagcctctgctggtgatacccaggcaaacagggtctggagtggacccccagcaaactccagcagacctgcagcaaaggggcctgactgttagaaggaaaactaataaacaaaaagcagtagcatcaacatcaacaaaaaggacgaccatgcaaaaacttcatcctaaggtcaccaacagcaaagaccaaaggtagataaatccatgaagatgaggaaaatccagcataaaaagggtgaaaattccaaaaatcagaatacctcttatcttccaaaggattacaactccttgccaggaatgggaacaaaactggatggagaatgagtttgatgaattgacagaagtaggcttcagaaggtgggtaataacaaaatcctccaagctaaacaagcatgctctaacccaatgcaaggaagctaataaccttgataaaaggttagaggaattgctaactagaataactagtttagagaagaacataaacgacctgatgaagctgaaaaacacagcccaagaatttcatgaagcatacacaagtatcaatagctgaattgatcaagtgaaagaaaggatatcagagattgaagatcaacttaatgaaataaagcatgaagacaagattagagaaagaaagaatgaaaaggaaggaacaaagcctccaagaaatatgggactatgtgaaaagaccaaacctacatttgattggtgtatctgaaagtgacaaggagaatagaaccaagttggaaaatactcttcaggatattatccaggagaacttccccaactgagcaagacaggccaacattccaattcaggaaatacagaaaacaccacaaagatactccttgagaagagcaaccccaagacacataatcgtcagatttaccaaggttgaaatgaagggaaaaatgttaagggcagccagagagaaaaatcgagttacccacaaagggaagcccatcaaactaacagcatatctctctgcagaaaccctgcaagccagaagagagtggggaccaatattcaacattcttaaagaaaagaattttcaacccagaatttcatatccagccaaactaagctttataagtgaaggagaaataaagtcctttgcagataatcaaatgctgagggattttgtcaccaccaggcctgacttacaagagctcctgaaggaagcactaaatatgggaaggaaaaaccagtacaagtcactgcaaaagcaaaccaaaatataaagaccattgacagtatgaagaaactacatcaactaatcggaaaataaccagctagcattataatgacaggatcaagttcacacataacaatattaaccttaaatgtaaatgggctaaatgccccaattaaaagacacagactggcaaattggataaagactcaagacctattggtgtgctgtattcaggagacccatctcatgtgcaaagacacacatggctcaaaataaagggatggaggaatatttaccaagcaaatggaaagaaaaaaaaaagaaaaaaaaagcagggattgcaatcctagactctggtaaaacagactttataccaacaaagatcaaaaaagaaaaagaagggcattacataatggtaaagggatcaatgcaacaagaggagctaactagcctaaatatatatgcacccaatacaggagcacccagattcataaagcaagttcttagaggcctacaaagagacttagcctcccacacagtactagtgggagactttaacatccacctgccaatattcaactgatcaacgaggcagaaaattagcaagaatattcaggactggaactcagctctagaccaagcagacctaatagacatctacagaactcaccaccccaaatcaacagaatatacattcttctcagcaccacatagcacttattttaaaatggaccacataattggaagtaaaacacttctcagaaaatgcaaaagaatggaaatcataacaaacagtctctcagaccacagtgcaatcaaattagaattcaggattcagaaactcactcaaaaccaaactactacatggaaactgaacaacctgttcctgaatgactactgggtaaataacgaaattaaggcagaaataaataagttctttgaaaccaatgagaacaaagacacaatgtaccagagtctctgggacacagctaaagcagtgtttagagggaaatttacagcacaagtgcccacaggagaaagcaggaaagatctaaaatcagcaccctaacatcacaattcaaagaactagagaagtaagagcaaacaaattcaaaagctagcagaagacaagaaataactaagatcagagcagaactgaaggagatagagacacaaaaaacgcttcaaaaaaatcaatgaatccaggagctgtttttgttttgaaaagattaacaaaatggatagccagagtaataaagaagaaaagagaaaagaatcaaatagacacaataaaaaatgataaaggggagatcaccactggtcccacagaaatacaaactaccatcggagaatactataaacacctctatgcaaataaactagaaattctagaagaaatggataaattcctggacacacacaccctcccaagactaaaccaggaagaagtcaaatccctgaatagaccaataacaagttctaaaattgaggcagtaattaatagcctaccaaccaaaaaaaagaccaggaccagacagattcacagccgaattctatcagaggtacaaagacaagctggtgtcattccttctgaaactattcaaaacaatagaaaaagacggactccttcctaactcattttatgaggccagcatcgtcctgatatgaaaacctgacaaaaaaagaaaacttcaggccaatgttcctgatgatcatcaatgtgaaaatcctcaataaaatactggcaaactgaatccagcagcacatcaaaaagcttatccaccatgatcaagttggcttcatccctgggatgcaaggctgggtcaacatacacaaatcaattaacgtaatccatcacataaacagagccaatgacaaaaaccacatgattatctcaatagatgcagaaacgcccttcaataaaattcaacaccccttcatgctaaaaacactcaataaactaggtatttgtggaacatatctcaatataataagagctatttatgacaaacccactgatatcatactgaatgggcaatatcatactgaatgggcaaatgctggatgcattccctttgaaaaccgacacaagacaaggatgccctctctcaccactcctattcaacatagtattggaagttctggccagggcaattaagcaagagaaagaaataaggggtgttcaaataggaagagaggaagtcaaattatctgtttgcagatgacatgattgtatatttagaaaactccatcgtctcagtccaaaactccttaagctgataagtgacttcagcaaagtctcaggatacaaaatcaatatgcaaaaatcacaagcattcctacacaccaataacagacaaacagagggacaaatcatgagcaaactcccattcacaattgctacaaagagaataaaatacctaggaatacaacttacaagggatgcgaaggacctcttcaaggagaactacaaaccactgctcaaggaaataagagagaacacaaacaaatagaaaaactttccatgttcatggataggaagaatcgatatagtgaaaatgatcatactgcccaaagtaatttatagattcaatgctatttctgtcaagcttccattgaatgtctttacataattagaaaaaactactttaaatttcatatggaaccaaaaaggagccggtatagccaagacaattctaagcaaaaagaacaaagctggaggcatcatgctacctgacttcaaactatactgcaaggctacagtaatcaaaatagcatggtgctggtaccaaaacagaaatatagaccaatggaacagaacagagacctcagaaataacaccacacatctacaaccatctgatctttgacaaacctgacaaaaacaagcaatggggaaaggattccctagttaatgagtggtgttgggaaaactggctagccatatgcagaaaactgaaactggacctcttccttacaccttatacaaaaattaactcaagagggattaaagatttaaatgtaaaacctagaaccataaaaaccctagaagaaaacctaggcaataccattcaggacataagcatgggcaaagacttcaagactaaaacaccaaaagcaattgcaacaaaagccaaaattgacaaatgagatctaattaaactaaagagcttctgcacagcaaaagaaactgtcatcagagtgaacaggcaacctacagaatgggagaaaatttttgcaatctatccatctgtcaaagggctaatatccggaatctacaaggaacttaaacaaatttacaagagaaaaaacaaccccatcaaaaagtgggcgaaggatatggacagacgcttttcaaaataagacatttattcggccaatgaacatattttaaaaagctcatcatcactggtcgttagagaaatgcaaattaaaaccataatgagataccatctcatgccagttagaatggcaatcattaaaaagtcaggaaacaatagatgcaggagaggctgtggagaaataggaacacttttaccctgttggtgggagtgtaaattagttcaagcattgtggaagacagtggggtgatttctcaaggatctagaattagaaataccatttgacccagcaatcccatttctgggtatatacccaaaggattataaatcattctactataaagacacatgcacacatatgtttatggcagtactgctcacaatagcaaagacttggaactaacccaaatgcccatcaatgttagattggataaagaaaatgtggcacatatacaccatggaatactatgcagccataaaaaaagaatgagttcatgtcctttgcagggacatggatgaaactggaaatcatcattctcagcaaactaacagaggaacagaaaacaaacaccacatgttctcactcataagtgggagttgaacaatgagaacatatgggcacatggaggggaacgtcacacaccagggcctatcaggggttggcaggcaaggggagggatagcattaggagaaatacctaatgtggatgacgggttgatgggtgcagctagccaccatggcacatatatacctatgtaacaaacctgcacgttctgcacattgtatctcagaacctaaagtataataatttaaaaaaaggaaaaaaaagcataattatttttatattaacactagcatttcatatcttaaagcaactgatgtttaggaattactacacgtggtggctcatgcctgtaatcccagcactttgggaggccgaggctggtggatcacatgaggtcgggagttcgagaccagcctgaccaacatggagaaaccccagctgtactaaaaatacaaaattagcaaggtgtggtgacacatgcctgtgatccctgctactccagaggctaaggcaagagaatcgcatgaacccaggaggcagaggttgcactgagccaagatcgtgctattgcagtccagctttggcaacaagagcgaaatctatctcaaaaaaaaaaaaacaattactacgagtggtacctttttttgcattagtgtcttttatgtggcatcatgaaaatttctgatgaattaatttccctaattaacgtaattccattattcctagtgactttaacataattcctaatgatacttccataaacaacaggaccattgaatttttgagatttctctgtggttctttttttcctcaggatattttccattgaaatgtatggttgaaatttgatctttgaaaatctacttgatgtataattaggcttatttctatcagtttgttttttaagagttgttttgattttttcctttttatttaaccttggtttttaataatctaaaacttgtacatgattccaaaatcaaaactatgaaacaaggtacatttggagtattcattcctgtctgttctctatacccttttaacaaatgaattttaaaaattagtttttagtgtatgttttagtttacttatttctttttaaaagcataagcaaacccacacacatgcatatataagataataatatgaatatttatacatatatcaattcataaatcttttcccctttctacacaaatgtagtatactagatgcactctactggaccttgttttctcatgtaacaatacattctgaagatcattttatttcttttgatagctgcacagtaccatattatgtggctacataatattttattcattaggttgcacactgatagacataggggttgtcatatcatgctttaaataaatatttcccaagtggctgatcaggtaatctgaatgtctgtccattggtggttatatgtctcttggagactaatacctaacagaaatcaattttttgtgtgagttgaatgtaaaatgatatttatatcattttataaactaaaaaaatgtttagttttggcacaaccttgaggaaagcagtgtgacaagcctggtgccagatcccatggagaactaaccctggacagcctgggaaaactcctatgtaaacatggagaacccagatcaaagagtgtttggagagtgataacaatcacttaggacttaccttttctgaaaatcttaaaaattttaagattgtgaatttttaaaatagtgattcataaactatttaggtgacttgctgtggagccattggaccagagattttgttcaaaatgaaaacaacatgcagttaatcatatttgcaatggggccattgttgtctctttataggtttagttttaaggctggcattaaagagttttgcaaaattatttatttatttttctaattcctgggcactgcatctgccaccctgaaagaggccttcaggtaggtggtggtgtatgcattggtctcatgaactcatgcaatatttgccatagttttctcttgggaacaaagtgtgttattgggaacaaagagttccataatcaaataaatttgaaaagaactaagtttatttattgcaagatttcttagagcttttagtaactaatatgcatataacttctcaagatagggatgtaaaatgctggttttcacagacattttcctttatggagtctatttttcatggagcatgttttgggaaagttagatttaatggttaagtttcttataattgtgaatgacttagtgagttaattggagggagagagagaattaattgaacagagtagttgttatcatttctatgttacaggagaggaaactgaggcttcagtgttagtgacttgcctatcatggattgaagacagatttctagattgtaaattgttaacatcatcatatttaaagacttaaaggaagaaaaagtatggaaagggtttagtaattctcttaaaaatatccaatttatataaggaactcaattaactagaaagaaaacaaataacttgattaaaaattgggcaaaggacctgaatagacctttctcaaaagaatacatacaaatggctggcaggccattttaaacagggtatatgaaaaaacgctcaacattactaatcatcagggaaatgcaaattaaatttagaatgagatatcaccactcacctattagaatggctaatatagaaaataccaaagattacaaatattggcaagggtgtggagaaaagagaactcttgcacactgctggtgggaatgtaaattagtgaagtcattatagaaaatagtatggagagttctcaaaaaactaaaaaaagaactactatatgatccagcaatcccactattgggtgtatatccaaaggaaattagtatgttgaaaagatatagctgcactcccacgttcattacgcattgtcgacaattggcaagatatcaacctaattgttcatcagtggatgaatggatatagaaaatatggtatatatacacatggaatactatttagcctttaataaaaaggaaatcatgtcatttgcaacgacatggatgaacctggaggcaattatgcttagtgagatcaaccagactcagaaggacaagtaccacctgccctctctcatatgcagaatctgaaaaaagtctcatggaagcaaagactagaatggtggtggctaggagctgggggaatggaggaattggggagatgctgttcaaagggcacaaaatttagttaggaggaaaacgttcaagagacccattgtacaacatattgactatagttaataaaaacgtattgtatacttgaaaatctccaatagaatagattttaagtatgcttatgacaaaaaatgataaatatatgaggtaatgcaaatattagttggctcaattcagccatttcacaatatgtttgtattttgaaacatcatgttgtacaccataaatatatacaatttttgtcacttgaaaaaatcctagaaaggggaaaaaagaatattagtagaaaactgatataattcaaataatatctgtggtttacttaatagtgctatacttatgttaatatcctagtttttgataactttagtatggttatgtaaagtgtaaacattagggaaagctggggaaagggtaatttggaactttgaatctttttcttttcttttcttttttctttttggagagatggggatcttgttctgtcacccaggctggagtacagtggtgcaaatcatagctcactgcagcttcaaactcctgagctcaagtgattctcccagctcagcctcctgagtagctggaactacagttatgcactaccatgcttggttaattttttatttgttcatttattgtagagatggggtcttgccatgttgcccagtctggtcttgaatccctggccttaagcaatcctcccatctcagcctcccaaagtgttgggatttcaggcatgagctgccatgtgcggccaggaactttgaatcatttttacagcttttctgtaaatcaaagactttctcaaaataaaaagttaaaagtaaaaatttataccaacatatatgaaatgaattaaataaaaatgcacatattacatcaattgttattatgtaatgcaaaaaatttcctagtcttattaggatttttttttaagactaaaacattttctaggccattcagcaggagtgggattgggcttgccactggccttcccccttgctacggatgtgggcttatggatatatgtaaatactgtacatcagatggtgatgcctttgctcagagtccctgcaatcagaaccctgataggaggatttatcctgctttcaacttagcagagagaaagaattacttttactcttcagacagtttatcttttcagtcgttccttttctctgacatttttccccttgactagagtaaaagtagttatccttaatgtgacattggaagagagagatcacggtcatattttttgtacacaaaccgtctctacatcacatcacattgaccttctcctattcggggagaagggtatttattgcctgctttctcaccaagttctctagcttttgatgtttaaagttgttatttcatgacatttcatgaacttattttctatgaggtttctaacatgactttggcccattcgtacaaatgattccatcttggagctccccctgccagtgccaccacccccactttctgttttttacagaagatacatatgaagtctatttaaagagaagatattacaaacaaatatacagtactattcaaacattctgaaattagatatagttggattcagatgaatttattaaataaaaagacaaattcatgagtgacatttcttaacttggtatattcacagcatatcagtggagaagtaaggagatttacttcattattcacagcgtgatcatgatcttcagcaggtgttcaagaactctctgatgctgagactaaaagtaattcatcttcctaaagactttctatctttgggagggtgacatttcctgtctggcttttctgatgattcttacaacttaattacttttggcatgtccagttgcttgctttatttactacattgtataggtcaaacacttgaacctcaggtttatgtttgttttatcaaacttagagaatataattattcagagagtaattttcagattagcacaaacatacattttctactagagagtatctattcttaaagctcacttgtgagacattatatttttcctgttgtgaggatgagatggcattctctttgggatctaaattgcttctgaggcaggcacttttgtgtattgttatctctataccccgaagaacaactggagtgcaggaaaagcagggttttagacaaatgaaagtgggatatgccgtctgggctgatggctacgcttggcatcaccaaatgggagacttaagagccttctgcagtcacggctgcagtggctgattattcttccagccatgtctcttccttccttcttctcttctcttctctcctcttctctcctcttctctcttctctttttttttgagacagtctcaaaaaaagaggctggaatgcagtggcgcaatcttggctcactacgacttctgtctcctggattcaagtgattctcctgcttcagtttcctgagtagctgggattacaggcatgcatcaccatgcccagctaattttgtattttcagtagagacggggtttcaccatgttgcctaggctgatcttgaatgcctgacctcaaatgatccacctgcctcagcctcccaaagtgctggaattacagatgtgaactacagtgccaggcctttctttctttttttaaattttaagttcagtcaggggtatatgtgcaggtttgttacacaggtaaaaccaagtcatgggggtttgctgcacagctgtcatcacccaggtattaagcctactacacagtagttatttttcctgactttttccctcctcccacccttcaccctccaccctccagtaggtcacagtatatgttgttcccctatatgtgtccatgagttgtcatcatttagctcccacttataagtgagaacatatggtgtttgattttctgttcctgtgtttgtttgctaaagataatggcctccatctctgtctttcttgcttgcttttgttgagcagggggtgggtaacactgcccggtgattgtgtcacctcacactgtcaccccaaaatttcagattccagaataactaataaataaaagtttttccacagttggggaaaggaagataaaaaagtttaggaagcaaagaagatggtaatggggtttttacgagccttcccctctttgaaggccagcagggtagttgaatgtgtgtgtacagaagccacatgctagcaatagtatgatgataatcatagtagttatcattttctggcactcactatgtgcctgaagtggtgtaaatgctttacatgtcattaatgctgttagtttctttaacagctctgtgaggtgaatgtattgttattctgctttgctaatgagaaaactgcagcatagagagcttagtggagcaatctcaccaagtttacagttagcacactgcagaggcggaattctcactgacatgttttctactccattgtctctgatttgacccaggaggaatggtgatggtaggcacctgagctattgagtgttgtaatatagaaggcagactttctgtgttcgtaaggcacaagagtctgctaaggatttccttttttgcttcattttacattttattcaaaggttcaaaattgataagcttaattaaaatatcagttccttaataaagcgctctaaaacatatttaaacaaaatgccatacatcatgccttagttgctttactaatataatgttaaataaatatttcctggccaggcatagtgatttacacctgtaatcccagtgctttgtgaggtggagacaggaggatcacctgagcataggagctcaacaccagtctgggcaacatagtgagaccttgtctctacaaaaaaaaaaaaaaaaatagccaatagctgggtgcaaatacttgtagtcctagctacctgagaggcgtgaggattgcttgaacccaagagtttgaggctatagtgagctatgatcacaacactgcactctagcctgggcaacagagcaagaggccccgtgtctttatatatatataatatataatgttttctaacttttgtggttacataattatagaaatattagcaaaattaaaggaaggggtgagattttatatttatcaattgtatggattgaccgttcagtattggttgattgattgagacagggtctccttctgccacccatgctggaatgcagtggtgtgatcagagctcactgcagccttgacctcctgggctcaagcaattctctcatcttagcttccccagtgctgaggttacaggtatgagccaccgtgaatggccagtgcttttttttttttttttttttaatctctcttcttacacatcacttttgtttttatattattgttattcatatatatgtcttgtcacccccctattgagttggatgctctttgaatgttttttatttcatgggttctcaataaatatttgtgccacaaatgacttaatattacttgttactatgaaatttgtgcctctatatatgttgggtgacaattagaaaactaatgataattattgcatcaaaaataatttgagagcacaaatcttatagcattgtcatgtaagatgggtacatatagatttttgttattcttcatttgttgggcatgtagaataaatccacaataaattcaatagaagtaaagcttatttctgcatgtatatctagataaacataaaatattgattctctgttttggaaaaaaggaaaagataatgactaaaatttctttgtggtctctatgatggtttaatcacatgtctctcaaaaatctaattttctaagaatcaatctgtctgtgtgctagcagactgtgaaaacctactggtttctttaaacatcaaaagaagtcagcctttaaatatttggacgttttcctctgagatacggctgcactaggcaaacacactgacattaacatttctaaagcaggctcaaaataaatgagaataataaaaaaaaaactccttccaatacctaattgccattttaattaaagcttctgtttgtcatcagtgacaagagattgcctcagaaagataaaataagactgtgtgtctttggctttcatgaagacaaaaggtttgtgcaagaagtcaaatacccagataactttgctgttactttttaaattaaacaatttgctaagcatcaggtgaaccaaattattcataaattaacattttttttaggccagtacatctcaaatctagtttatggatggatttcctggtttgggtgcttaatctagtgtgtgctagaatcttatatcacaggctgttttatagagataaaggaatctggaaatggaaatcactttcttaaatggcttttgatttgaaattttatttattcaggttaccttaaggttataagatcaaataagaacatactacaaagagctttgtaaaagataaaatattacttgttatcttaattattattatctggaaaacaaagttaaatgcatgtgtttattccacccctccctctgacccaattaatgcatcaggaaattgggaatttgctttggtgcatctgtttaaatgctaagaactgggacttggatttgctgctcaagaatccctagcccagcttcctaaactttataaagtcaaataaaaatagggtcaccaggtaacatggaaagagcaggcttatctttcctctcagcttctgaatgaagttgaaaatgtgttttattgtagaacaggtaaaatgtgattcttataaatgggaacaaaagaataattttaatgatgaatttgaacctggaatctgaacaacagataaaatgcaatcagagaagcactgagactatgcagtgcatttgacacagaaaataccaagagcagcattagcacttttctgaggccttatcttaattaaacttggccagatgaagtttctttggtaaatgcaggttcttctcacaaagcctttcatcccttattgcagggagagccacattttccaaagaattgccccctcactggagggaacccagacagcaaaccccagaacttactggcatcaagagtgctccatgtgagggtaccatgaagacggagattgggagatattgggtgttctcaaatgcgacagattttaccagtaccgttttctcttgggatcagtataatgtaaacctcttgagaacggtatctgagtctctgtatttcctcacatgcctactatccaagaattcaaaacacatatgtggttgaatgagtacccttaagcccaaactgctgactgtaaccctttatccaacctcatcttgtttacctttgtgtaacattggaaatcacccatccccttttctgttggaaactttctttaactttcctgattctccgtttacgtgatttattgctgctgcctctttctttctctgggttccagtctctaccccctcaagctggctatttcctaagattctgtttccagccctcttctttatattctttggctgactgtgcattagaattgcctgggaggtaaccgcagcctgccctgtcctgcctcgtgtttctgtgtgtgtgtgtctgtatgtggtgcacacgtttctgtttttatttttttattttaaaaaatttgatttttattagctttttcttttcttattattatactttaagttctagggtacgtgtgcacaacgtgcaggtttgttacatatgtatacatgtaccatgttggtgtcctgcacccattaactcgtcatttacgttaggtatatctcctaaagctatccctccccctcccctcaccccacaacaggccccggtgtgtgatgtcccccttcctgtgtccaagtgttctcattgttcagttcccacctatgagtgagaacatgcgatgtttggttttttgtctttgcgatagtttgctgagaatgatggtttccaacttcatctatgtccctacaaaggacatgaactcagggatctagaactagaaataccatttgacccagccatcccattactgggtatatacccaaaggattataaatcatgctgctataaagacacttgcacacgtatgtttactgcggcactattcacaataacaaagacctggaaccaacccaaatgtccaacaatgatagactggatgaaggaaatgtggcacatatacaccatgaaatactatgcagccataaaaaaagtttttgtttttaatgtttgcaagtaagttacagacttcctgtccccttatacctcagtgtgcattttgaaaaacaaggacattctcttgtattattaccacaatacaattatcaaaacctaaaaattaacattaatagacttcattcagattctgctgattgtctcatcaatgtcatctctaacaaagggcaaaaaccaatttttgtggtctaggaaatcaatccaggatcacatgttgtgttgtgctgtcatttttaaagtctcttttaacttagatcagttcttcggtatttcgttgtttttcatgaccttgacatttttgaagtgtacaggccagttattttgggttaatctgatgttgtttaatgattagattcagattatatgtttttggcaagaacaccactgaaagaatgttgtgtcctttttcatgtctcgtcatggtatctatttctgcccttacttgtgttcacttaattaatgtggtatctgccatatttctgcactgtaaaattactctttgtcccctgtaattaataactatcttgtgggagacacaccaagactatgaaaataaatatatctattagtgttaatgacggtcagttttctcattgttgaagaagaaaggaattatagatatgaaaaggtagaatgctagagtgaacccatgtgctgttggattaagattagcaataactgtatgaattcgtggtttttatagctatgtagatcaatctaattgcctagctgtatcctctgacaggataaagaagcaatgataattcagtagcaattagcataagtagtaccattatcttggtttctaaatactattcaccaacaaaaatcaaccaagtcttcttccttgctggggcaggaaaagaacaagataagcctggaacaggtgttgttttttgtttttgtttgtttgtttgtttttggtttttttccatttgaaagtaagagagtgagcaaagaatgatggggacatgtcaaaaggacacacgagccagctccaaggggctcctactagccaaatacaggacaatgtgaccataaaaataaatggtagtaacagatggaataagaatccatgagtccatactgataagaacaaatagatgagcaactatgtaaaatggaaagttagttattcattacaatagaattccaacaaataaatgtgtgtggtatggctggatgcggtggctcacgcctgtaatcccagcactttgggaggccaaggcgggcagatcacctgaggtcaggagtttgagaccagcctggccaacatggcgaaaccccatctctactaaaaatacaaaaaaattagccgggcatggggtgtgcacctgtagtcccagctactcaggaggcagaggcaaggagaatcccttgaacccagtaggtagaggttgcagtgagccaagattgtgccactgtactccagcctgggcaacagagccagactctgtctcaaaaataaaaaatgtatgtagtatgattgattgaaaatcatcatttgttaactaccatagtaatggttgtttgaggcaagaatcatcaatgaattctcttttttaataacatagatttgttctttctgactcctccctatccattcagtgcacagcttttagcacacaattgccttggtcaaatctgttcttaagctgggcttccccttcccattgtaccatgtgtgtgaatatctaagaccacaaaatatgctgcttttccactactgaagtaatatcttacctcatctctgtttagattcttcacacattccaaggaaacacttagctaattttctattagtttgaattaagttgagatgctagagaagtttgctagaatcatttttcattgccagctaacataagtgcattttcaaacatgctattgataaaatctggataagttagagggaactatctgcttgggaagcagataaatgagagtctattgggggcaaatgagacttttggggttccttctatatcatagaatggatggacatataatttcatcttctgccttgaagacaggtgttgagaattgacctaagctgatttggtcattcatagcccttagtggttttttcctccatggttcatacatcaaaagaggtttgagctgagtcagtgttaggcactacacaaaactttgctactagtccataatgaaagcaagccagacaaaattctgctacacacagagaccattgattacataaatacttaacagcaagcaaagtaaaaaacatttttttacagctcgttatacaacttgttaggaagtcccagttctgctaccttgcataaaggttcttccaaggcagacagggcaacatcccagaggctggatcctgttacccttatcaatccagtgggcaatgccaaatcttcttaaatcaacaggtggacactgggccatttaggaaaaaacctcaggtttgtctctgggggagaggctctctggatccttatcctccattacactagagtggagaatatctctaaaatatttttgctactccacatactcttgattgtctttaattttactcgagagagtccatttctaaattcttcatattaataagccactagttttaccaattaaaatccattgctagcatacattatactgattattaaagtcttaggtgttaataaaaatcaggataatagaagtacttatagtgattgcttctggagtattgcctttctgataaaatactggataaatgtacagtcttgatgaaatacactgggagaacattacatactatagtgccatcttggaaattaaaaatgcatgttagctatttagaggttaatgtcctgcaataaaggaaagctgcttagttttgttcgaccttgcatttcccaaacttagttgaccccaagtccttttttccatcgcactcttgaaattagttattcctgggaaaggctttagaaaacattgctttagagattataggagaagcttccttcaacatccacttaactgacactcagcattctctttataaaattcgaggataataggcacctatcttaaatactctctatcaagttgagttctgtgcttacaaagagtcaattgagattttttccaaaacggttttattctatttgtacttgtaattacagttacataacttaattaaatattacataatcccgtgacttttgagtgtaaatataaagagttattgtttctttgaaaaataaactgaaagttttggaaagactctagaaaagaattgctgaaagtgttattaaataaggtgagggtaagacaactatgaaagatttgggaaaaatataaaaaagaatttctaatacaacttactttgtaagtatcttttaagttattgatgcattttcaagaaactgaaatgtatcatttttcaagaaagagttcaagcagagaacttgaattagtggagccatactcaaaagccttacatttaaataaaacatgtgaggtatatgtatgccaatttttattattttctgcttttactgaattttttgattaagtgactaagcataaaccttgtaagagtcagaaaagggcttttgttctagagagagagagaattaaagagaagacttcacaaagcaaagtgtgtacacacacacacacataccccttgtggcatgttttaaaatattccacatagattttgcccatatttcctcaagccaggctcagttgtcttcagaaccctttggcattcttgacacactgcttttgtgttttttcaactttattgtaagtctgtgggattgcttaataccttgttaaagaaaattagagttaaaaatctaatttctccctgggagtggtccatatatatatacatagttcatggctgggaacaaagtttactactagtgtattttttcagtgttattttgtagtaaaagttcttaaaatattgtgtaataaataatatttgatttctatctatgttctcttaggcttggtcccatggcagcctataattcaaggttaaggttatgttgttatttaagaatttttagcatctgtacttgtatgtgctgcataaacaaaacagttattctattgcagaccagtttttccttttgaaatgtagaatacaacaatcacttctcaggtttaattaagactgtgtttgtacagaggtctgtagtttataaaagcagttaagcaaagaaatgcttttgttatatacaaacagaacaaaaagggaaaatactgtcttgatcctttcattaaaggtcaaaaaaaaaaaaaaaagaaaaaaagagttcactcaattttttatctcgtgttttttcacaaataccagaaacagagctgtaagatagtaatttgttaaactacacattaagctggtatttgaatatgaaaaggtatttccaccccgtgcaatattgcttttttgaaatactaaaagcccttacattagggtggtaattgaatgactgcttaaaaacaaaccctgtctgcttcattttgacaggttctttatacatttttgtggagggtaaacatgtcaggatgtagcagactaaggaaggagctggtattgaacagggttcatagtcaaagtgacatagtttctcattctcaagaagagtagttggcatggttgttttgggacctgcaatatagtttttctagattcaacatggaaaacattattctaaactctagtgatctatctgcccatagcttatgccaagcagcatggattatacatttttgatacctgtagacgttttaggagccttcttgatgttatgttgaaatcttattcctgtagttatccacataattttctaccaaatcaccctgtagaactgatgcataattacttcttaggatttgtttgttactgtaataatgaaatattttcctgtctcttggtatacccatgtgtatactgtgttttttattttgtaagtcccatgaaggagaaaggacttctatttttgttttattggagttgaacacttcttgagcctccttcttggagattctcaggtttctgatcattcttgttatagttaactgattatttttgtttccttagatcaatttagagggtcacaatatagcactttcagaaaatttgtcagagcttttattacattaggaagagtagccatttaagtgtgcaaacacatcactcattgactggctcactgaacatctatgagtcaggtagctgctgagaactagagatgttaagctagatgagatagttctctgcaagattggtcaatattcctttttcagctgctatgttctagaaaatgtatggtaccatatgaaaagataattgaaatggagaacatgttatttgctagaatggggcaaacatatgtcttaacctacatgaaaaatatgggagtgacattgagattggagttagggagagggaatagatcagatttggacattttgtccgaagtagggcaataaattatgtcttaaatacgacttgataccaaatccaaaagtagaatggttgcaacaatatttcttctagttatacttctttttctgaatcttactttgttatggaaatcatagagcatgctgatattctcagcatagacgaggagttgaggagggtaagggaaaatataggcaaacaggacaagattttcatcccgtggacattagtgcatttgaaaaactggctcttgggcttcatgttttggacagtcaggacagaggtctcacaggggttatttgcaggttttgctttttttgaggttgcagccatcctaggactatcatgactgtcatgtggtgttgagagaaaggaagatagaaaaaagatgctttttgaaaagcttttccccaagacctatcattgggtcttctttctcctggtggagataggggaggagaggcagagaggaacccagctgtcagcaatggtgcagtgggtccaaactgcttctccttggtgggtggaatttccgttctagaggaggatctgaggaggcttatgagcttccctgggaattgctttcttcttccagcttctgaaaggttctcttcatttggccccaggaggaatgaggaacacactacaaagctttccattctacaggctctgtgagctgagtggtgaagttgcacattttctaattggagaaaacatggtcccatacattttaggttggctaagaagaaatgcctgagattcatggattgaagtgtgccttcaattggtcttctgctagagtttcatgtagaaactgatagatgaaacaatacatttacccaaatatgtgaaccaaaggactatgtgaatagagagggactgattgtgtctactcagtaaataggccaaagaaagggcaacaagcgaatcacaaggactgtttaaagccctggccaatggggggttgggggaattgtgtcttttgcataagttgctcccagtttgaaatcttcttagtacactcccaaagctgctctgtggctgccagcagtgttagcctgagatctcttaatcctcatatagatcagcatctctctaaaataaatcacttgactgttttctgcctaacattgcaggaatggcttgggagactaacccttcggtttgaaatgtctgaaaactgcttctctgttttacaatcttgaattttacttagctctgctgctctttttagctttctcagaagtggattatattttgctacctttgccactgaagtacaaatataatcgttgttattttcttgtctcacagagtatattttgaccgaaataagtagacaatgttctgttttctaagttccaaccacagtgttttttttgtttgtttgttttacactcagtaatccacatattgttatttctaggtaattatagaatttttcagtcagtaatttactaagcacatgtcatgttttcagcactgtgtaaggaactgaggcatacaaatgaaatctgaggcatggttcaagtcttcatgtaggttacagtgtttgtggagaaataaaaccaaatcagaggaaacaaagaacaattaaatgttcaactgtgtagtactcatgataggaatctcctggaagtaaatactgaatatggataaattaatgaatgaagtgttcattcaaggaagaaatcattgtggactagaatgtgtcattgaataggtcggatacgaacatagccatgaaacataaataggactggtaagtggaggagagaatattctaggtgaagagagcaaaggtaacaaggttgatgatggagttgagcatggcatgtgttttggacaataagaggagaccaggtgacaaaaatcggtatgcaagagaaacaaaaaaataaagttgggtatccccccttccttgataagtgaacctcaattttgtgcctatctgcaagtgatgaatcatgattggtctaacccattcatgatgattctatcctccgcctttccagtctcctttggagctagggcagctctgtgatcgtgttctggcttcaagctgaagtctgctgatggcatttctggaaatgtttttgttctttgataaaatgttggcacctccttttcctctcctccttgccttgaatgaagatgcaaggtctgtaaatatacagcaaccttgctgttatgaggaaaaggcaaagagttattgtttctgatactgctgaactgctaaacccacaccaacagctgtctacctctggacttcctgttatgtgagagaaaccaacctctgtttatgtaaaacagtataaattatggttttagttgtttgcaatgttttaacattattttagaaaggttaatctgcaatagcacaccagctgaaccggaaggtgatgagaattgaggtggtggttttagcaatatgggtcttaagtgaagaagttctgggcaagacttgtggccaggggaataggaaggaaggcagacatctcagagaagaagcaaaagtattcagtgcagattcagtgaaggatagaagaagccagataacctcaaagtttctaatcaggaagataagtgggcctgcattacagctttggggataggcagataatggtaaagacgagttctgtcttaaggtatgttgagtttgagattatgatgatggaacatccaagtggaaatattacgtgcatagtcagaaatacaacatttgatttgaggcgaatctatacaatgcctatgaccttgggcatggagaaacagaaaagcaataaatgatgccaccagttatttgagaggaagaaaagaggtcatttgcataaacagacagagaaaggagataatacggggttggtacagggatgaatatgtcatcatcagtatccaatgatctagagagatcaagaaaggtgaggaatgaggagagaatttggtaaatctgacaaaaagtgaatctggtaaaaataggacaccaatgatttccaagagaggatatattggctgcccagatctgagcagttaagtgggaagggaagggagtccaagatgaaagtggtagtgacagatcattcattgaaggagctgggaattgagaaaggctgattcttgcaagggtggtagacctagtaaaagatggttttaaaaacagtgaaaactgggaggaaagaatttcatggaaaggcccaacatttaaatggaaagaaaggtataaacacacagagaaagttaaagaaatgtgtaatgttggagaaagactttagtttcaggacagttcagatattcctctgaaattggaggcagggatgacaaggaggctctggaatctaatgagtggaagcaaatatacttgtaaacagctgtctctactgggtaggtgaagtcctgtgttaggagctggtctagtggtagggagaagtgaaaggggagctagccacttcatgcagttacaaaatcatgcagccttgccatcaacgtggcaaggattgtcaagggcaaggctgcgtaattttgtgtctttctcaggcaggaccatagcggagaaccagaagctgaagaggagacccagaatcaggtggaggttcatagggagttgtgaaggtgagagaatctagaacaatgctcctggagagggaggagaaatctagtgttctcaggaagaggttaaagtccaagtgcagattgtccagagaacaggtttggttgggggaggtggcagagaaggggatggtggcttgagcagagtaagtccaaatctcagacagagcttgaaatggtgagatccaaaaattgcttctgagtacctggacacagcagcttgttacaagtagagatttaattcttgttcttttttttttttttttttaaatgagaggctaatttgtcacacatttcttttactttctctgtgtatttgtacctttctttccacttaagtgttggtcctttccacaaagttctttcctcccagttttcactctttttaaaactatcttttactaagtctaccacccttgcaaaattacacaacatattttcagtatattctagtgcattatttacttataaataaaattgaggccaagtataaataaggtacaaatgtactgagttttatctcactttggtgagacttcttaaatacgaaataaaaagccatccatgttccaattctggcaatatattccccttccacacattcaactaccctcttgctgaactcaaccttgggtttctacagtgttactgaaacctgccatccattcacagtggcttctcctagtgatttccatggagcacaattttttaaatgtccttaaaaaagcatgctactttaattatatggcagatggtgtgttgcatggtttcctaactggtgttacttccacactgtacttgaactatataaagaactttgctctcaactcaggaggaatcctgcgaagctcaagtttgtattaacttagagaggaacaatttctgtaggttgggacaaattttaatgtatatgttatagtactaattttattatgtaaaaactacacataaaccaaaaccataggggtttcaaataatcattgcaaattatgattaatttagtaagactttaaactgttgttttcttctgatttttaaaagtgagtcattatcatgtagaaattttgaaaaatggagaaaaatagaaagaaaataaaaattgctcttaatctcaacttcctggagatagtcactcttcacctatttttgggtgaggggaggggcactttattttttaaactgaatcatattaaacaacctttgtttcctacctcaataggtcaattgacttttaattctggtttcattttctgaaaactctgtaaggtcagcaagcaaaggtgttagaagtaggtagcatataacataggaattagcagatagcttatttctgtgggaaatagaaaggctgactaatctgtgacatccagtaactttttactgagaaaaatgtggttgcaatgagtaaagtctcccatgtcactattctgtagaagataaacaatgttttagctttattatgatttataccgtattcttttcaggattaactctaagcgtagaacattttagttttataccttgattagaatcatttatttatatcccaaaacatagaaattaatttggggtgataagtccttttgttgtcaagttatttttctcttaacatttgtatatagttttttgtattatgtttcctaatggaactcacatgtccattagagtcaactgattattcaagacagatttgctttaatctcccagtgtttattcagtttcatttaatattgtacttttatgagggttatgaatcataggaatgtagataatatgaaacatattgcattattttagatggaaagttagactttgtaatttagataggttgtcctcattttattacatagggcattttcactattatcttaactgtggaaatatttgatgagtcagttcatcttgttttatagaatttccaaattgacatgaaaagaaataattgttttgcattaatttatatttaatataagcacttgagaggtaaccaggaatgggaggaaaggaggaagacattcatggatatgcattctagagtaatgaatttcaactgccggaaatcaatggctctgccagattcatatgttaatttttaatgagtagacatttacttagaaattgatttatttggactcagatgaaaagcaaaaatggctgaaaattgtcaataatagcatacaattgcctctttaggtttagctgtgattatttttgaaataaaatcctcagggatgttggaagtgagccctaacagggtacacatgtaccattttatttgacagagatcttcattgcatatatcctaccacttttcatttcaatgtaacgagcaatcaaaaactgcttgttgagtttgaataaaaagggtgactggtggggggtggtagtatttgtcccttttgatgttttcatagtttaagtttgaggttggcaaactatagcctgcaggcctagtccagtttgccatctgtttttgtaaataaagttttactggaacacagacataatcatttgtttatgtattgtttatagctgctttcatgctacagtggcaaaattaagtaattgcaagaggagctatctagactgcgaagcctaaaatattagtatctagctctttactgaaaaaaaatttcaactaagtttagttaaacttttcccttatagtactgtatttcttaaacctgatggtatactattgtttaacatgtcaatatggaatcaaattaccaagatgctaaaggagaaagaaacctggccgaataggaacagctccagtctacagctcccagcgtgagcgacgcagaagacgggtgatttctgctttgaaaaatttttcagataagacataaataagtaaaacagagaaagatatatcactttataatcgagggctaaattgtatgatagtatcaaaaaacccttttcaggctcagtggctcatacctgtaatcccagcagtttgggaggcccaggcaggtggatcacttgagctcaggagctcgagaccagcctgggcaacgtggtaaaatcctgtctctacaaaaagtacaaaaaattagcccggtatggtggtgtgtgcctgtagccccagctacttgggaggctgaggtgagagaatcatctgagcttggaaagtcaaggcagcagtgagctgtgattgagcccctgcactccagcctgggcaacagagtgagaccttttctttaaaaaacaaaatcaaaacaaaaaaccaaaaccttcatatattctgtatcataaatatatgtgaattgaaagtcactttaatgtggtcagagtcagagttctaaagttctcaaaattgcaatgttagcatactaatgtagtaggatatgttttgatgttttcgtctagaaatgggaacatcaacttagtgccatatagttatatggttgtatctaggttagccagggttctaaaggaatctagagcttttctagaaattgtggggtcagaaaggatgatgtactaggcttgcttgagtatgaaccaggagagatgcatgtgtgtgtatgtgtgtgtgtgtgtgtgtgtgtgtgtgttttgttttgagagggagtctcacactgtcgccaggctggagttcagtggcacgatctcggctcactgcaacctctgccacctaggttcaagtgaatctcccgcctcagcctcccaagtagctgggactacaggtgcacgccaccaggcccagctagcttttatatttttattagagatggggtttcatcacgttggctgggatgatctcaatctcttgatcttgtgacccgcccaccttggcctttcaaagtgctaggaatataggcatgagccaccacgcccagccaaaagatgcagtaatttcaggtagttctatgatcagtatatagggatgccaccacaactgtttctgaagaacacaattttaataggacctaggtagggaggcttaggattaaaacatgttgaaaatctgtcttcagggactaaatgaagctggaataaataacatggcacacagttgaacatatattggggaaaagggtgatcttggaaggggcactagaagcaattataaattggtgtgaacttatatgtgaacataaataacacaagatgatacattggtaacttgtatcatttacatttggttttgtatcttgagtgtcttgcataataataaagcagatcccagctttaaagagtggagtgtttctgctctatattgaaataactatcagagggcagggaggttaaaatcagaagtaggtacgctccttgcataactcttccatgcgagtggtggcagattaagaaccttctgtagtagaaccattttgttacacattgccaaccacaaaatttcatagagtcaaaaaataaaaataaaaaaagaggtcaatgtggtggcctggactaactgggaaaagctttatggagaatattggattttctctcagtttctgttctgagtaaagtatgaagctgcctttataaagaagcaagttggtgactctgggatttgaatgagtttcccagtcctgttggggtactataataaaatacgttaggctgggtaaattatagtcaacacagaaatttattgctttacagttctagatgatgggaagttcaagatcaaggcaccagcaggtttggtgtctggtaagggcctgtttctcatcaatgataccttttatgtgttctcacatggcccaaaggggcaaacaagctctcttagacccttttataagggcactgtattagtccattttatgttgctgtaaaaaatgcctgagactgggtaatttataaggaaaagaggattgacctggctcacagttctgcaggctgtacaaagaagcatggcaccagcatctgcttctggtgaggcctctggaaacttccagtcatgcagaaggtgaagggagagcaggtgcatcacgtggtgagataaggaacaacagagagggagaaggagagagagtggggaggtcccagactcttttcaacaatcagatctcatgtgaactcattaccatggggaggacaccaggccattcatgagggatctgtccccatgacccagacacctcccactaggccccatctccaacattggagatcatatttcaacatgagatatggaaggaacaaataaccaggcactaaccatattcacctcctagcggccccacctcccattaccactgcactggggactaagtttcaacatatgaattttggggagcataagctttcagaccatattcagcaatgagcatggtttgtgtagaagaagaacttgggcaaagtgaatggcttatgcctcaagttgagcagattagttgcgtagtaagaaaggtgaggggagataagggtgggagagtgatggaacataagggaactaaggtaccacttgggtcagcctagtttctgtgattccgttacattatgggattgagtgtttaatgctcagtgacatctcatagaatgaatcatagggagaccaagtggtgtgcacaggtctacctggtttgggaatcactgagattgttttgctctgctccaagttgcaactgaagacaaatcacattcctggagggaaaggaacatcaagtgactaaaatgcaacagcataaatcctctctcataatagacagcacctgtagccttttgaccctttgttctaaatcttttatagaagagtgtaggatgtagataggaaataaataaaattgcctcctgattttatgtcactatggagctggttgggagtctctttccttttcagagaagccacagagagaaagaagaaaaagcaaaggcaagaccccttctcttacatatcccaatggactttgagtgttagtgttgctttttaatgaaggtggatggcagagagagattttcaatatagcttaaccataaattttcttaagggggttaggtggtgctgtccaatactccagggtgtggtggtggagctggcagaggctacaaaaagcagcaggtgcctataggtctagaaatccccagctcattagaagtgctgtaaatcatagcatccttcatgtctcttgagtgaaacttggcacctccagcttacaactgtgtggtggtcacactgtccctgacttcaataatgttaacagatgacaacttccattgaacgatgaaactgggtgagccagtgccagtaatgatggattgggtggctgaaagtttctgcagagaggacagcaagaggatgccaaggaagctggtctgtgtgtaactaaaagactagtaaatatgagaattgatgggcacatctatcacccatggggccactgtgtcctgaaagaccttgtatgaaagctttgagaaaggctttggcaaggataaatgccccagcgcttagacaagtatgggtctctgcaggccggactggttgaagagggcaacgaggtgaggtttcgtgagttggaagttggcctcctgtagtgtgcagtctgacacagaaaaggttctagctcacagttgcctggttggagcatggaaacagctccagcttaatattcaggacatctgtctgccgaggcctgttttttttctgtacgttttcatggctgtttgtagacagtggtaggtgagattggaagaaataagagacttgaggaaaacagagttaaacaagaaagtaaaagtaactcttcaatacccagtacatggttaatatgtagatacttgaggatcctttatccctcttatgtctcaggagatggggtgctggggttgtggggagggcaggggaggagtaagggaaaaagggaaaagacaaagaagatatcatctatttgagtaaataaaatggagatgtagtaaagatatcattttgggaaccttgagattgataaaaaaaaatacacaacttactagaactttttcagttcaaagctgaatgctaaaaggttgttttgtgtgctgtatgacagacaaatattttaaaatatgtctcacaacattcctttggcttaggtggtgatatttaagttaagacttacatatatcagttggccagtttgacagataggaaattatttggaattaaaaattccccttctagtttttcccctaaaaagtccctgcttaattcatgattgttctctcctttgcctcttctttcctaattctttatcttctcccatatccaaaagaacatctggcaactatctctttagaggcatctatgatcctggattgaatttgttatccagtcagcaccttcgtgagctgtgtttgattttctgaaattgggtttccgcaaatggtcatatttcaaagtgctatgccatataattatttgaagggaaaacattttaacgtggtacaacgacaacgtaaagaatgaaaattgtgctaagtgagttctgtctctttcaagttcaaattggtaggttttcctggcttgaacacaaaatgaagtcaaattgaagggtcagagatacaagaaaattataaggagaacaaactcattagaaagggaactgaaaaatggataacaagaggaacaaatacagggattttccatatctagggaaaaacaatccataggttctatggggactttaaaaatatagaggattgagaaaaaaactttgtattttgcaacaattttaggttaatagaacattcgtaaagatagcaaaaatagttcctatatactctatatccagcttcccctaatgctaacatattacagttttagatttttaatggttatgataaacatgagtctatgatttatagatgtcactacttttttatagtattagaagaaaattagacatataattttctacttgaaaatttatattcttgtttacactttaagaatatgtaatatcttccaaccacattcatatcaagaagaacaaaaacaagcaaacaaaacccctgatcatatcttaaaaaaacagcccttctctgagttatttacatttttagcaggatgcaaaactttatgcccaaattttccaaatttaggtatgttaccatggcattttatcctggaaaattgctttgactggaagtttctttggcaaatctcacttttatttatttattttattttatttagacggcgtcttgctctgtcgccaggctggagtgcagtggcgcgatctcggctcactgcaacctgtctcctgggttcaagcgattctcctgcctcagcctcccgagtagctgggactacaggcatgtgccaccacggccagctaattatcattattattattattattttttgagaccgagtttcactcttgttgtccaggctggagtgcaatggcgtgatcttggctcaccacaacctccgcctcctgggttcaagtgattctcctgcctcagcctcctgagtagctgagattacaggcatgcgccaccatgcccggctaatttttttgtatttttagtagagacagggtttctccatgttggccaggctggtctcgaactccctacctcaggtgatccacccgccttggcctcccaaagtgctgggattacaggcgtgagccaccgcgcccagcccctaatttttgtatttttagtagagacagggtttcaccatgttggccaggatggtctcaatctcttgacctcatcgtgatcctcctgcctcggcctcccaaagtgctgggattataggcatgagccatggcgcccagcccaaatctcactattttttagattaaaatggaactgttgtggggtataatgtaaaatttatgcatttttaaaaagcaagagatagcttaaaatgggactctttggtggtctctggcagtgtgcagactttggtggtatgagttcactctgttttgtctttatagctatagaggttgaaaaaaaaaaaaaccattaccttacactaattgacataaattttggaagcattatttcagcaccaaccaatacaggtttcccatagtccttattggatatcatagaatttttgataaatatttgtgaaatgaagcaatgagtaaaaataaggaatgtcattttgaaatgtggggccttttctgtgtctcctcaaatcccacctgggaagtgctcactcattccaggtaagacaggctttgctgattctgggccttggactggcagggaagaagggactgactaggttaagtatctcctcaaggtgctggaggcctctaaataaaatgaggtacctcccccttcattcctagcctggaagaagactggagcctcgagattacagttatagtctctgcttattatataaaagtaatcatatgctatatatagcccatgatggtataaatgttgtagctgaagggcaactgacaagagaaggcagtggagacttgggaaaaagtgggattttaggtctgagagaccttcaagttctagcctgggctgcaggatagaaccctaggtttggtactttgaccctcggtttggtacttatcctcttgaggccatatttcattatataaaatgggaagtcagtaatctatagtgagagctacatgtaagagtgaatttatcttatgaactaatcattggccttttttgctgtcagatctattccttttctcccacttcattatctgcatggctgaaggttcaacccctgcaggctgatttcctagctctttcccagctgggtttagccaatgagaggcactggcaggagatgggcaggcaagcacagctgctgtgtttgctttgtggctccagcttgtgtaagacaggcccactgtggttccagctttttccatgactctggccctttggtgctggtaataccatcctctccttctgtccctccagccaaggagtggtagtagctacctgcagttgttagcctccgggttgcctctttattctcttttggcttcttagctcttttagcagtgatgtatctaagtcactgtattacattccctctttttagaatgttggagtggttcctatttccctcattggacccttattgatccagtccatttcggtaatctagctgtgagctgcagtacttcaactaggctggttgtgatagaaatagaaaggaaggagagacctgccaaaggagaaagagagcagtaacctattagatggggaaaagatcaggagaaataaagcaattcagataattgtgactgccattgttgaagacaggcctttggaaggggaactggtttgggtgtagaaccaatgggttttgtgtagagcatgtcaaagaagataaacttcatgatttcactgcctttcccacttcagtgtattgcagctgcaggagtatttatggagttgcctttctctcttgggaaagggtaaaaatgttcagaggaaagagatcaggggtagctacacttatgtcagataaaaatagactttacgtcaaaaactacaaaaagaggcaaagaaggtcattacataaggatacagaggttaattcctcaagaagacataacaattgcaaatatgtatgcacccaacatcagaacacctaaatacataggtataataatgtgattcaagtccaatattcacacatttacacataggtgtaaaagtataattcaagtccaatatttattgattttttgtttagatgatctgaacagaaaatcaataagtgttggacttaaattacattttcaaccaaatggacctaacagacatatgcagaatactccatccaacagcagcagaatacaccttcttctcaagtacacatgaaacagtctctaggattgatcacatcttaggcgacaagacaagtcttaacaaaattcagagaggacagcagtgtgtggcccagaagggaatgccccctggtggcttgctaagcctggaacacatctaacaccattgactccagccccatctctgtaacttttttgggagtagaataggaacccattctttgccagttgggcagcagctctttaccaagggaccaagatgagcaggctgttccttttgtcagtgcaacatttgcaagaggagtgctgtgggaggagataaaaattgacttccaaatggccagcaaaatttcagagacatttttgggactggcttttaggttcagacttaataagtaaaacagcagatacttaagattttgatttccctgtgggttaagatagttcatagtggggatggccaacattgctacagcaagctggaatccacttcctcaatgtactggggcattatggaaaataatgatctctgagggagagaaatgattccacatctttgggaacaatatctagatatattaagaaatgacctcagatgaaaaacaaatataaaaacattttggcaaatcagaaggtgcacattatatggcattcatgatgttttatatagtatatgtgtgttgggaaagaaaagaagagtctaataaatgaagacaaacaggaaacccttcctaaactctcttcccaaatacttcttagtcacgttgtacaggtcgaaggttctgggaagaaacagctagtgctctgacctgcattctgcaaatataacgtttcctgttttgtaggaacttggggctgaaaaatgcataaaccaattgatttaaactcttaaacccataatattcacaaacctcaaggactgctggtcaaagcctctctctctctctctctctctctctctctctctctgtgtgtgtgtgtgtctgtgtatgagagagagagaaagagagagagagagagagagagaaagatctattgcagatgttcttggagtattacattacatctaatttccagatagtctccagataactgaataattgattcatgtgaatcttaaatacatcaatattctgtagtttctcaaaccttttattttgttttttttttttcaactctgagtgaattaggtttagttggagaaaaccgtttatgttatgtacttctaaaatatgatgaggtgaagcatgaagcatggttctccttggaatgatgtttacattaataaggctttttatctcacaacgacatagataatataaaattaaaatcaactgctgatctcagggagcaaacagatttttatgataaggattgtatagccacctttacatctttttctttccttttaaataaatgatgaaagctccagtgctgtcataaaatcacatttatttgtagtgatagggatgaaataatcactgtttcatcaccgtgatcagcggtcacatacacacaatggaacctgacatgctggcagcctcagctcattacagctttccaaccaacctccaagcttatggctggaagtcaaatggggtgggcaggttccaagtaggaaagaaaaataattggctttggagataaagggattatttaaatttccatatgaaatttccacaatttcttggcttcaaattgagagggagttacactaagatgcctgtgtttcaattttaaaattaaaagcattcaaagaagtggagaaaattattatagacaacaaccatttcaataacatttctctgtcttcatgttgtttatcacactattaattacctgctaattaaaaacaaaacaactggaaaattctagcaacagaatttttcatcaggaaggcttttggtttaataatttttttcttatccttacaatatcaagttgttcccctcccccccataaggattgattagtttaaaagattggtgtttgatcggaatgcaaacatcagtgggacaaagtgggacttttctggtactatgtagtttttggagaccaaggcctctgagtcagacagacctaggattacatttaagctatctctcctttgagccagatttgaatctcaatttatctttccacttcgtgatcttgggcaggttacttaatctttcaaagcctcagtttcctcatctgcaaaatggtgataatgaaaccaccacgaagacctgttgtgaggggaaaataggatcgtgtgtgtaaagagcttacataacagagagcctagcatatagattcatagtagctgttttttaacaaaattatttttgcactattttcttttgtgactattagcatttggcagtgtgcttaccgcattactaaattttgtcttgatagagcagtccctgagcgatggttgagacctcacagtgtagatagacctgttgaagtgttgggtgttgctgactttgatttgcacccctggacaccacattcagcacctggatagctttagcagcaatggcaaaagatgaattccatttcaatcaacgctatccacaaccttgatttggggtttttgaataaaaatagggttttatgcttgaggatatagcacattttgagctgctgagtgagacttgcacttggcatgtgtgggtgccctggtgaaaactcagggagctttgcatttcattatatttttaataatgcttggcaagtagcagaattaaacttgtgaatcatttgaacaaccacttttcttaatggagatgagcctctttatcttttaggagtcaatactctgtggttctaaattagagtcctcgatgtgattgtattcctctcaaacagtattaagaacttattttataatggagaggttcataatgaaagcagtctggggaacgaggcatcctaggctcttgatggtgctgggttgaaggacaggaggagctggtgaggatgtggccaggacctgttccctggtgtgggggtagtagggaggatactaacctttttttactgtgtactagatgctttgtacacattgtttcatttagtcttctcggtacacctttaaggcaggtattgtcatgcccatttcaaaggtgcagagagatgatttatccaagattacatagtgaatagaaaagcagtaataaaaggaggaaatatcagttttggttacccagtatattttgtgaaaatccatcaagatgtatatttataatttgtgtacttttctgtatatatgctcacttcaataaaaagttacttataaaaacaaacagatctgcctgacaaagtctatgctcttttctatcatactaccaccaaaaaagtatgatgcatggaactccaagtgctttacaaggaatttcctctgtcagtcacagctaggcgtggcgagaaatagtgctactcttattaactagacctgattttgaaagacttgaatatttccaagggaagatacacttagagaagtatagtttcctaaaactgcagatgtctatgtgttagacttagaagattattccaaaatcgtgttctgaaaatgcatttagcttgttgcagagttgttcatagtaatgtaaaattggaaaaaaatagaaatatccatcaaagagggattcaacaaataaatactatgtgacttaaaacttacctattttgaatgatgcctctgatatagtgtggagtgaaaactggttttcgaactgcagatatagtatgatggtatttttgtagttgttttttctttatgtaacatattcatataaataaatggctggaaagatatttgccaaaatattaatagtgatacctctgcatttttgtgatactggttgaattttactttccattttatgtccttctgtatggttggttttatatagacattgctttcctacaattctataaataaaattttaatttttaataaaacagtacctttaatcaaaggctgcatcccaaattaaatatatcccttctcaaggtgtctactgtaaaggaggaagaattcattttagtgtatgagtttcgatacatcaaaataatattaaattatagtcaaatcatagaaaagaattttcaggaataaaaagtgccatttaataagatcaaatacatgcaattaccagactgcttggcttctgtaaacatttttaaaaaatcattttgagggatatagtttataaaagtaacaattataataaacaattttaattatattaataaatataattaagaactactttaattatattctatataagcaagttgctctatctacctgtaccagatatcatagcaatctaaaagatagctgttttacttatccaaatatgtgtcttatatagataggtcagtttcaaaaattctccgttctttttagattttagtataaagacatatgattgctttattttattttattctatttcattccattttagcgattccttcaatcaggctgaagacagaattaaaattatgcacattaaatactcatgcaaaaacagattatagagcaggatatgactttcatttttgtctttttcttaaagatttccaaggaactaacctaagagaatcctgagtacatcttactgtgggtgtcattgatatatactgtttcattgcctataacccccaacaggaatcatgagctctagctgagttcatataattactaccccctgaacacttagcagtcctgccatttgctccttctggataagcaggttccctattctggctactctcctgtattcttgtgtgactttatccatcagagaccaactcaagcttttggggcatagccaacgctcccctccaaatgtgtatacctatgaaaagggacaacatgacctgacaaaattctctttctgatttgtgagttgatacatatgaaaagtcttagagcatataaaaagaaatcaaatatttaaatttgatgtatctcattattaaaaaatatatgaagaatcaggatgttattatctggaaacatctgtttggtttctgtatagtaccagtaaagttgatttttatattgtatgttttacatactttgaggtagaaaattatctttaggttaactatgcctgacagacatcatctcttttacttaggcaaggcatttcatttgtggaggaagaagtactttgcttgacagagaagaagagaccgcgaggagcctggtgtagttggaagaaagtagttttggcactgagggacgagaaagctgagagaggatgggagagtgggttcagccaagctagccccctgcctcctctacccaggacacacacactcagaattttaagtacaatcatggagtttaattatgtgtggatttctcaggaaattgggaaaggttctgaattctctgttttgcaagcagggaaacctttgagaatagaggtagcccaggcaaacagagtaggaaagagatggcattttttgttgcaggaattccgtcgatgcacggggacagaggggctttgcgctgtcttgggctgtggaattggagacaggccatgtttaaactgatctctaaaggtgtcaggttggcagggcagcgcaaggttatctggctgcatgaggttatctgactgcacatactgttatgggcctgggatgtcccctccctgtgtacaaatgcaggagccacaggtgctgctgacagctcacaagcttctgataccctactgaattcgagtcctttgaaaaagaccactagttggctcttctcacttctttttcattaaaaatgaagaaatcagaaacgaccattcacttaaaatgtggagaaacaaaacctttgatagtctgtccattcatttcctgccatcttcaccgctgaaaagtgtactaactttaagtgactacggtaatgggcagtggaacccaattcaaaattcagcagaaaatttatgatctaattttgatagagatatgtgaattatcagtgagttgaagttgtctctgtgttaagtcattacagatgttaaatttagcaaagacatataaactcctgggtgtggagagtgctgaatgttgtagtgttaaacacaaatgtactgcttgttgaattggtctcagatgaattttcctgctgagctgacacagtacctctggccgagttggaacatttcagtcctacagttcaccatcgtgctgtcaatttgtccatgaagatagtttatgggaatgcattgacacacatgtacatgctgttggaatcttgatggatttctttctttccttcctttccactgccccaaacttttctatagaactttttgattagcatagttcaaatttatgttttgaaaataattaggttcaattaatcagagctttctacctttatatcactgtttgtttaaagaaataatgttgattttttttgttataaaatagtggtagatgtcatcccttgaggtgacttgaaaaatgccaccttcctttaaagtaccattaagtaaaatgaacataaggaatgttaatcggattgtctcaggatcaatgcactgatattgatgtgttaaatattgtggttattagctgaaagtatttattaaccctaataagccagcaactctatggaactttctatttaacttttctcataagctactttgggggtaaacaaatcccaattggaagtaaggactgcaaatcaacccagccaagtgtaatgattagcaatggaaatatcccattgtggaattctagttccatatgctcgtgaaaaaaagattacagataattataattaggaactcagtgtgtgggagtgaaagtaatgattactgaaagccactgatcatggtgggagtaggggtgtgttataaagatgtgaacattttatctaaaacgtgcactctgttaattagtaactttcaatacatttatatcttaccgatacaatttctattgtttcttgaacactaggaaatgcttgaggtgtgaatattgttttccagtgtgatttgtactacctacacattataaagggatgttaaccgttcgaatcctctttaacggcccccagcagtgaaggagggtgggcagggagaggaacagctgttgcctaagaggggaaggaagggagggaaggggaactagagaagctggcttcattggtatatgatctgggataatgggaagcactgatttaggaattatcaaatcattcctccattgcaaatgtatcgtcattattattattattattttgagacaagtctcgctctgtcgcccaggctggagtgcaatggcaccatctcggtttactgcaacttccacctcccgggttcaagcaattcttctgcctcagcctcctgagtagctgggattacaggcatgtgccaccacacctggctaattttttgtatgtttagtagagatggggtttcaccgtgtcagccaggatggtctcgaactcctgacctcatgatctgcctgcctcagcctcccaaagtgctgggattacaggtgtgagccactgagcctggctgcaaatgtattataagggtcaataggtacgttgattcttactttttcctccatacacattacacaatactgagaagaaatgtattccatcctgtctagcacggcagtggttggactttaataaatgacggctcccttcctcttcatctgagtacattgaactgctacaattcattagtcagaaatttgaattgtttaggacatggtaagattctggagcctaattccaggaaataaagtgaaattcaaaggaagccccagactgctccaaatctgcccttcaaattatttgtctcatttacacgttatttttttgaaatggcaaagattatcctttctgataaattttgtgcattaaaagacaagttttatctattctaggggagctccaaatttatacaagacaattgtgataaattttttcttaaaggaagaaatcctttattatgcaaataaagcttctttattaacttctgtatatttgaatggaggttggacttttctcagttacctacaatttatacgtaactcaattatatatacttctctagaactgcttatgtaaaataatatttcttaacacatttaaagtggtgactccctattatattgcaatacccttcctctttttttctgaactaacaatggaattaaaattcaagtgctgaaaaaacacggtttcagtatccttatattcttaacatggagccatcatataattaaatgcaatgtctagtttttttcataagtgtatgaagttgaatattctgatttggtgcagtgttttcaaattttcctgaccataagaatcacttgggggtgagcctagggtatcatttgttaaaaaaaataaattcctggcctcccccctttaacctactgaatcagatgtgtagaacctgggaatatactaagtcaatgagctatctcaggtgattcttataatcaggtaagtttgggaccaatgatgtaatgcagtaaaacttaagggtgtatcagaatcacccttgtcttattaaaacccaaaatttctgaaccccacccccagatccagtgggtgtagagtctgaaagtctgcaatttttaacaaggtccttggtgatgctgttgctggcagtccaaagatcacactgtggggaccactgatgtagtggaaagaatgtagtcttgagatgagacacatctgggttccagtctcatttaatagctggaaattttttagtatagttacttaatactatactaagtacttaatactatactttactgagttttttcctctttattttcaattttttaaaatatccttaaataaatttatacactcatacatatatattatgcttgggtttaaatgctaccttgaataaatatggagcacagatggaaaccgagaagaaggaggcagaaatgagagcaaggaggaggctgataagtaggttcaagggagagtgagtggtctgcacagtaataactgtgtcctagaataaccagaacccagcaaaacaacataatcagaagcaaactcaaagtgaatgtattaaaagtcaagctaactgtttactttgcaaggagaagagaaaggtcacttggctgtacaagtatgatagcattgattaatttgaatgctttgtctgaatcattactgttgagattctgaaagttcagatactgaaaagaggaaaataatgttgacatggagaaaccaatcatgtgagagctgtttttcatgtcagtgaggataaaatgattgctacctgctctttttacacacatgactaatgacatatttgtaaacttagttttctaagaaagaaacatagccatcatatttagggttcataccattatttaaatttgtatactgtgttccatcagcttttcatgggaagtatttttatcctctctgatgatttgaaatagaaaagccaatttgggtgtaaaatccaatgttcaggcagaagccttatgtggagatagtgttcccacagaattgaactcctggagtactggttaagagcaagtactccaggagtcagatatctgggttccaatcttgctttcacctcttagggcccgttctgttgccataggaatgttcaataagctagtaatcattatagtacatagctatgggatttctacaaacttttattcaacaagtatttattgactgcttgagaggtgccaggcatggtggcaggtactggggatatccactctcagggagctctgggagacaggcaagaaacctgtgaataagaaagttcatataataatagtaggtgttaaggatggagcaattaacaaaactaaaacataagtccctagtcctccaagttccattatagtgccttatatcctagtttgtttaccttccataagctcatcaaaagtcaaatgtgacttagatttactgactaggttactattttattcatcagattgagctccttaattcgggaatttaacagaggttagtttgcaacttaaaaaaatcttcatttctatcctgtcttaggcattaatagattttgtccatattaccagtgcaaataacagtgaactttatgtttttattctctatttgatatgcttgtaatttaaggcttagccacaattaaaatgttcactttataatctattagaaattctatataatttaataattttcattttgttgaggtcaaatttaactacaaaatctaggaagctattgattcccactaaccgcaccattgttatagtcttagtatgtttgaaaatttaagtaaaatttgtttccagggccaaaaggagagtactattttagttttgtggaactttgccaaaattgtattaattattaactgtgattcatttatgactgtacttcttctataggattttaactaatttaaagcaaagactgaatgaaagtctttatgttttgcagacaagagagcacccatttatcctcagcaaatgaattgttggagcaaataatttcagtggaccgtttggtatagggaagcttatggagacagaagcttgtggagacagaaaattcaagggattaggatttttgaaatacagaataagactgaggggcagctaagatttatgtagtcttcaagaacatagactatgcaaatacacaaacctacattctgtagactgcattgtagggaataatggacacactcaacatcctctaagattaggatagagagaaaagctccactctatttgaaggaagggaaatttttagcaaatcagaataatattaatctaagtttttcattttctttggtggtagtcctttctggattggtttagttgccaccttgccagaatactttaggaaacttctttaaaaaaacttctttagtccaaggggtactctcaatccaggatgagtaaggctttcaactttccagaccaaataaataagtcagaaagcttttcaagtctaaataacttaattcttcttacagaattctctccaccaattgcttgataaatgtcaattcaatgaaatgacatgcacattcagaatcatggtaaatttttgttttccatatccttcagaatcattttttaaactttcccaaatctttggcttatcaatgatgcattattctgtcaccctattaatgtatgtttcctttgtcattcataaaacggttgtattgtttggccttatggaaggatgttgattaagtgcctgtgaatgtttgctttattggcattgagaaagaagagaaaatgatttgttttgccaacaatgaattattgcatctgtttgtggctgttaaataatttaatagaacttaaagggcctattttcccttgattaaactacaggaaaatatcagtctctgcctcaccttggatacaaagttagatgtaaaacatgtttttaatttgccttttgccagtttaggtgttgataagacactgagggatttttatattatgccatttttacatttaagttgaatatctctttaagcttgagacaaggaaaaagtgttatgaacaattttatttctaaatagcttgttcacttttattatataatattagtaatcgtgtcaaattcctaattataccaaatatcaagggttacaaattattattactgaaaatttcaaggaatataatttatttagtggaaatcctgagattaccaataccactattttccctctcctttgttagcttttctcctaaccaagctcaaaatgttctgcactttcaaaggtcactgctaagtactcttctctttttattctgccttctttccttaagttatctcattcagccccatgattttgaaaaccactaataacctgacagttcctaaatcccaaatttttaccttgaactcagggtttatcttaggatctagttccttatttacaattgtattcttaatactctagagccacttacaaatctgttccttctatagacttctctgtttctacaagcagctcctccagcctctcagttgcccaaaccagagatctggggatccctctctccctctccccattgctcccaacccagttcatcagtagctcctcaaataaatccacttttctcttgttctcaccttagttcagtatactgggaactctcttgcaatcaccaagtggttactccattaatttgtatctccaaatccattctctagcagctagatatattttttcttttgaaaatgtaagaactttcacttctttgccttaaaacctccatagaataaattccagatttataaaaaatggcttttacagccccctgccacagcttcatttcatttcctccctcctctcctatgcatttgctgtaggggcctgtgttagtggagtctcctcaggatcttcccgtgctgtttcttctgcatggaatatttttcccacactatttgcctggcaatttgcctagcttgtgttagttcctcaggggatgcgtagtaccccactccagtctaaattagttcccctctacctaaaatactccatattttctttcagagcagttcttatcattttaaattacatgtttgtgtgattatcctttaatatatctttctcctacaggtgccattacagtatatgcactatatatccagctcagtgcttgacactaaattgggactccataaatatatgttgaagaacttcaaatattccaaaatatgaagaattttccataccatgtcctcttttttgtggccctctttttttttttttttttagagacggagttttgctcttgtcacccaggctggagagaaatggctcaatctcggctcactgcaacctcccctcccggattcaagtgattctcctgcctcagcctcctgagtagctgggattataagtgtgcaccaccacactcagctaatttttgtatttttagtagagacagggtctcaccatgttggccaggctggtctcgaactcctaacctcaggtgatccacccgcctcggcctcccaaagtgttgggattacaggcatgagccaccgcacctggcctttgtggccctctttttgagcggcatttttgccaagtaatatagcactgttgggaagagataattagtgtaagtaacagttcttttttttcaacattcagtgagggaaaatatcaataatggtaaaacttgtattccttcccgtagtgaagggtgagaaaatacacttggaactagaaaagcatagtagtaaaatgtagaggtagtataaacttaaaggaaaaaaatttcaccaggactagaaatacctgggtttggcatctgactctgccactgatttatgtttttggcatgttgttcagtctcctgtgtcttgcattttctcatctcaaatcttcagagatgtcaacagaaaacaaatgtggaaaccctttgaaaaaattaaaacttcttagaaaggtgagatgctcttaccctccttattttgattttcatttttgaacacaaagtggttttacttggaggttcttaaagtaataatgaacacagtcattctcatagataagactagctgtcactttctctcaattcatgcaagtgttattaagaaaccacctagggatgataatatgaaattaagtgtagtgaattcattatggattgcctttctcattttttacaaggtttcctgatagcaaagctaataaagtataaatatgttgaggtgtcaagtattttttttaaagagattaattagagctcagtccctaagctatttgtaaattactatactttttcattgtaaagtgtttagtggaaatgctgttttaataaaatgattatagattataaatggtttcattaagtactttatttccctgtcactataccagttctacagaaataaatgactttaacgttctttttgctgataatttaaatgagatctaaaagatgaaacattattttgaaacaaatttaatttaattgaccctgcatggcttggaatctttgctgcccatgatccttttatgattaaatactaaagaagaaagtgtaatgtgaatatttttcttttatttctacatcatgggattcacacttcctgaggtgaaatatcttattcttttcagataatattagtagatgtattagaaatttatcctctcaggggttgtgctggtcagtttcatcaacaaatggaattcaagatcccttagtaaaacgaatgaacttatgtaacaaccacaccctacacacaattcaaatgtgtgttaaatatctttgtgttcagacaaattgatagcctagagatcagtatgtgctagcttatagtcctgcaaacaagtgtgatgtttattccatttaaaaattgccactgaggcgggcttacgcctataatcccagcactttgggaggccgaggtggacggatcatctgaggtcaggagttcaagaccagcctgaacaacatggagaaaccccatctctaataaaaatacaaaaaattagccaggcgtggtggcaggcgcagtggcaggcacctgtagtcccagctactcaggaggctgaggcaggagaatggcgtgaacccaggaggcggaggttgcagtgagctgaggttgcaccactgtactccagcctgggcgacagagtgagactctgtctcaaataaaataaaataaaataaaaataaaaaaataaaaaaaattgcctagataagcaaacataactactcaaatttcataagattttgtaaacttctctcagtgccaagaaagtaagccacctggcagtttttttttttttttaaagtgaaccaacacacaaggatatgcaccagagctgggcacggtggctcatgcctgtaatcccagcactttgggagactgaggcgggaggatcacttgagcccaggagtttgaaaacagcttggacaacatggcaagaacctgtctctacagagataaagaaacagcctggagtggtgatgcatgcctatactctcagccacttgggaggctgaggcgagaggattgcttgagcccaggatttcacggctgcagtaagccatgatcccaccattgcactccagcctgagtgacagagcaagaccctgaccaaaataaaaaatatgcactagaattgagtgttaatatttcacctgaatttggctcagatttacatgggctatgagagcattttttattttagttaccatttcttattacttataattatattctcattctgcagatattctcaggaggcaataagcctggtggtaattgagcagatttagttttttgaaaaaatatattgacaactatatttttcctgagagtgtaaaaatgattcagaaaatatctgctattttaagtaacattttgagtgtaatattgcattcattagttgaatgtcctgagatttcacatgttaaatgtagagttaagtacaattagtagaagagtattttaagtggcagagatgggcagaaattattttgtggagtgagattagttgagttcagataaggaccctctattaaagaagaaataaaggaatgtggattagaagacaatgaaagactttttggtgaactaatgtatactttctgaagatttgggagtgtgttgcggggcggaatgcaaaggcaaatttgtagttacatatctagacatgaaaatagagggataggccaagttcacctgatggagagcttttaaggctacattctatatttgatgattgtggttgaaattttataattattaatagtatgtatgctctgaaaggtaaaagaccttgtaacctatatgtaattcttactgagcccaatactttgggatatacttaaatcctaattcaatatagcagatttgaatcttattatcagtggagtgcatttaattgaaatcaaattgatttaaacatctagtaaggaattctcaagtttaaccttcttttccacctctgggtacattcatatgcttacatctactctcaaaccttagaggtagaaaaaatttgatttaagagaagatacacattttcattcaaattgattgtttaaatatttataagactaattttccagatacattataaaactgaattgtgctttggacattcttttcaccacagctaactaatattattagttctaaaatgtaagatactaaaataatttccaaatcagaggtctgacatgatatttaagggctatttttacatattgtattagaagtgcattgaccattctcaagaataataaatatttcaaatattgtatttaactaaaataacaccagtgtaattattttaataaaaataatttcaaaagagcccttgaactcctgggctctttgaaattttaaccgttctacttatgactcaaaaaagcttaaaaaagatggatgtcattaatctctacaaagtgtatctattgttctgataattcatgaggtaattataggactaatgctttctaattgtctttaatgtgcaaatatctttaatatgttttctcatagtatatgctaatatatgttaattttaaataatttgagcaatacagagaaagaaaattccataattttgctccctttttctagagataaccactatcaccaattggaatatattcttccagacttgtcataggtaaatggtaagctctcaagctctcatattatactataagtactcttctgttatctgctttttaagtatgcacacacacacacacacacacacacacacacacacacacaatgcattttaagatttataggtctgcatcacccattatatgggctgtataggatcctgttacatgtaatgtaccataatttattttgccagtccttggaatggatgtttagtttattagtttatacttactttttaaaatatcagcagcatggcagtgaaccacctcttacttatatctttgctcatttactcaagtatttccttcagatttctttaaattcctaaaaattaaattgctggatcaaagtagatgcatctttaatgttttaaaatatattattacattaccttccagaaaagttgtacaagtttatattcaatgtactgttgtacaaaaatttccatttccctacctttagtaatctgataggtaaaaatagtcattttatttgtctatacctttgtaaacatatatatatacataatgtataattatttgggcatctttttatatattctctaaacagttatataattttgtgaatttgtcttttccaaaatttgtttgtgaacaatttttataaattaagaaacacatagcaaatatttccagtttcaattttttaaaaaatatcaatacagttttaagtttctatatggtcaaatctatcaatcttttcctctatgctttctggtcttaatatatttgttaagaaaaggtcttcttcacccaaaactatacaaatatactcttatagtttttcctagcatttctgtgttttatttaatctttaatctatttaaaattattttttgtctgacatgaagcagaaatctagcttttttgttcaaatgaatactcaattcgttaacactaataattgaataatgtattgtttcctttgttatttaaaatgcctcttacaactgcatccattgaaactatcccattgggcttttcattacaatttgattgtatttgtctgctaattagtgaagaatttgaattttgccagtagtatgtttttggtaatttttaacatttttatttatttaatttttccttttaactttaagtgaaataaaattatataagttttgcacatatcttgttaagtttattcttgacttgtttataatcttaattactgatttgaatgggattcctctcacccccattcacccctgccattatgtttagaaacaggttggcatataaggcagctattaatttttctatatttatattatattttgccactatcacttttactggttttaataagtttttcatttgatcttttgggattttctcggtaaatagttatattttctgcaagtaataatgatctgtcactttctttacaatattttacgcttaatttcttatctttatcttattgctttggcttaactatccaaaattatattaaaatataaagtaaataaatagtgggcttttttgttttgtttgctttttgattttcatgagaatgcgtctaaatcttcagcagttggtaaaatgttttctctaggattctgaaatggttttgattatgttaaggaagttttcttctcttctcagtttactgagttttgttgtgaattgatactgtattttgtcagatgtctttggggtagtttcagttatgaacaattgtttttctcttttaaccaatttacttattgaattacattgatggactgtctcatgttgactcattcctacattcctggaataaatctgactttttgaagaatatatttctttaatacattgccatatcttacttattttcataaaaagatctataattcacttctctggaattttatcagattgtggtctatgttttacaaagtactttagcatgctttatttccttttttccttgacacagccctatgaatcaggctaggaattatatttttttgacaaataaaaattatagacatagaaatttgctttgcaaaaagtcatgcaagtaggtggtaatggtgagtaaaatttattaatctctaatccaatactttggtttggagagaaggaatttaattagttcagtaatttctatcagtacgatatttatggactttgagttttattatctcaaataaaaactatgcttatgtagttttcttttacatttttctaagttgagagaatgaatttgtttccattttgaccatggaggcttcactgggtatgaatgggggtgagggagagttcaccctaaaggagtccctgagctgagaatattcattctctgatatctgccatctgttccttgaacatgagcagatgctgatgttcagttaatcagaggtaatgcaataaggattaaagtgttagatagttctaacccattccggaagttatgggtaaaacttaaaacctttaatcagattcatcttgacgttgaaaccaagttggctatttgagccaaaggttctgtatctctatgatagctagtcccaaaggacatattctattattgtcattaagagaaaacatattaaggatgtgtttgcacacagcattgggtcaagataattgacattgtattttatatgtggttcagagatctgtcttatggaaaactcagagattgctttaaggggtttgttgcaaaagaaagattcaattaggcagtttaaaataatttaaatgtcagttttacaatacagacttaatacaaatgcaagaaggagtccatttgttgatatatacaccaatttattaaatggtagaatagacttctccaaatctagagaaagatcagtttagactattaatgtattatttcttaagtttgaatagaattaggttttttaaaaattgaaattgaaatttagtctccttgtcccaagtgacatacatttataaaatgtttttaaaaagtaaattcactgtttttaaatcttctacagaatattttttgtaatgaaaaacctacatgtatatattactgtacagtacaatagaactgatttcatttctaagaaataccactagtcgttatatattttatgtcattgagttgaatttgtaagtgatgcatataacctggagttttgtccttaccaaatattgcatagaaaaccataaattcctggaaattgactatttttcaaactatctcattaatgaaaatttatgctctgaagaaaggctaattatgtctcttatttccacttaagctggtataactgtaaatgattttcttatttttataaatcacatctgttctaaaacttagctccaataacactctatgataataaatggcaaaactcacataatattgaagcacattgggtatttccttttcagttttaaatatgcttaattcaaatttagatgattaaagaatatatttggactccaaagtgactaaaatcaatgaaaataatatattggtgtgtcatagttgggggtaaatattaccattaaaaactgaaaagtcgagaatggtgtgaacctgggaggcggagcttgcagtgagccgagatcgagccactgcactccagcctgagcgacagagcgagactccgtctcaaaaacaaacaacaaacaaacaaaaaaacccctgaaaagtcgcaaggaaggaaaaacgattctgtgaactcactacataggacacaaagagaggtgggaaattttgtcaggaatgttcgtgacatgaactctatttaataatgtcttattcccgttgatattttaatttttcagataaagtattttaagtaaatgtgcaacattaattagaataaaatataaaagtatgcgtctatttgaaggcctacctaattacatataattttctgatgaatgccctaattaagcatcaagttatatgtttatacctgtgaaataattggagcattacatttaatctttataacaatacattgaaagagaagtattagccatgtaggtattaaaggtatacatttagctagacttcatcattgactttccttttaaagggacatgacatcctgttttccatcaagagaacatcgaattaatcctcacaccagaaacaacagtcagtgctggcataagctccgccaggattcctgggccctgctgtgcaggggtctcctgaggaaggacagaatcgtatctcggtctccaagcccacttggttcttggcacttctgctaagagttgcgcaggctacctattaattttaaatgtattgtttttgaggatgaggcagacatctgtcttagagggacaggactgatagccgcaagtcgttcctcagaggctgctgaataaatcgtcagatgacctttattgttgtcaccctcattttgttcaaattgacgcagctaaagcacagtattaacaaaactacgcattgcatgcagcagtgggattagtgaaaaggaccatgttgttgactagagaaatggaagttcacgtatctcataactgcgtacgaagcagtggactgggaaggatacaagaggagaatgacaagattaaaataagagacaaggcctttacatgaaagcagctgacactacaaaggacgtagtacttctgtttaataggcctcatcagccttttatgctcccttgtgggcttggctcatgaacatctttaatgttatttaaagctgtttttattgtttatttagaaacattctttatacattttgctctaattattaaatttgatgatctttgttcttatttactgatttaattagctacaaacattcatacattaaaatttattccggacaacattagtgttgggattaatgattttttaaagaacaaatcacttgtacaatgcatagcccagagtaggggctcagtcaatctttgtgtaaatggaagttgtatttgaaataatccattggatgtgtataataagaatcattcttgcagaaaaaccctaactggatggaaactatacagaagaagagcttgagataatcacttttatttagattgtcccttcttaatgagttctaatgagcaaatgattgcagtgaggtacagcacagtggaagcttcttctgtttacaaaaacaaatcaatggtactaactacccactctgaaatggactcttttttttttctcagcactctatcactagctttgcctgtagaacatcaattatttttgcttccaagtgaagagagtcatttcagagaagatgtgtaaaatttagagggtcactggctgcccatattttaattagtatcccatccccaccacagcgtatatatcagtgtgggtttcctaaaggagatggctttagtgcgttttattaaatgaatcaccttttataaataaaatttaatggtaaattcagacatagaacttaatttggctagagaaacttgcatgcatacacttagcattgcctttaattaattctgttgacttagaagatggtgtagacaataaatgctttttttattgatcataaaataactgttcagatccttaccaataagggacccactagggaaggccagtggtttacttgggttatgcttcagctacttctcaatagtggccattaggacctccactcccactgcatcacagtgaccctgggtaagtcacatggtattaaccataaataagtgcatcacctgtttgtgtctctgcattaagtaactggagttgaccatgggaataaaacttgggaaaatttaacgtgaaattaatggtataattctatagttgcagacttcccttttctgaaacttgaaggcaacagatacagtgatgatcccatctctcccaccatcttgaattttgtgtgaactgttaggccttgtgtatgggtaagggttttctccagaacacttaactgccaaacatggatgtgattttgagcataggcccattggaaaggcaaaatgtatgcatcagaactgaattccattctgtgatcacaatccaggttagtggagccaacatttttgaggatagccctctcctggatttattactctctgcctctgcctgttattcggtctcatttggggccactttatctcacttagtatatggtagtagccatcctggctgtctttcccactgaaggacttttgttccttccctggaaccctttactctcagtcttgtcatggcagcagtttgggtctcatttcgttctctatcctaggcatcttaaaaggaacaccatcatggcacatgtatacatatgtaacaaacctgcacgttgtgcacatgtaccctaaaacttaaagtataataataaaaaataataataatttaaaaaaaaaggaacataagacattctcttgcccaagttagcagtaactgcttaactgctgaattcagtaagcttatcttcagatcttaatttccaacacgctttccttttagtcttggcttctgtggaagctcattctcctggttttcttacccctcagctcttcttttcttttaggtcttctctcctgcccagcctctaaatactggtgttcctctgggtttagctcatctctaactgcttttatttaataggtgactgtactatgctcaaggttctatttatccctttacgggtataacttccaacactgaaactgcagcccagacttctccctggaggtttgactcatatatccaactttccattgggcaacttcacctagatggcccatagtcatgtaaaatccaccatggcccaaagtaaacttagtttccacttcaacttcacttcccctgatatttcatacctcatttagtaatatttccactcacttctcactcaaaccaaaaacctagaagtcatcctttactcagtcaagaagttgttttacctcatgtttcttgatatttcccactcttcttcatcctttttattaggaacctacctaatcccttcatcctttttattaggaatcctttttattaggataccttcctaatctacctaataccttcatcctttttattaggaatctagctcaggccatcactatctctttattgtaatgctgaatgaaatagtcatctaatgtaccatcttcagttttgtccgtatcaaatccctttagcacatatgcagagtgatatatctaagataaaaatgaaaccttatcagtttcctccaaactctgtaatgtgctagactttgtcacagagtaggtacctattcttgtttgtcaaatgaataaatgaagaataagaccagaggcttctcagtatccaaggttggagttatctggattctagattgtatattgtctaccatcctttgagaatgtcatgtatcaaccaaatttttgtttctcagttttgcttggaacttcacaaaaccagaatgaatagcatatttttatagtgtataggttgtatatatgaacagatagggtctgtatggtgaaaatcaaacctatgtgcctatatgcttatcttttagtataatctattaaatttttattaataatttcttaagagaacttttcaaatataaatctttccctcccttacactatgtagctggagttcagtgttatgaaacaaagattccttctcatcacagtttgacaactggtgttttgatttctagtctttagagttgtgtaaatttgttctaacaaagaatcattttagaactgtttgcttaaaaaaaacttgccaaaacaccaaaaagtatatgtgatgatataattagatatttaaatatgctcatgaggtcaaaggcagggaagcttgggcttggtatttcctttactcacttttaaatttttgtacaatgcttcagtgtgcattttttccctgtgtgttaaaatatacataacataaaagttacaatttaaccatttttaagtgtgtaagtacacttaagtacataaccatttctaagtgtataagcattaggtagattcacattttttgtgcaatttcagtatactttttcctgaatttatattgaaataatttgatattttcatgattgagatccaaaacttgtattgaataagtagagttttctgggggcttatcaatgtgttttgaagaaaaatgattttttttttaattttgattaaggagcttgcattatatccaatcttattgggcttagggagagcaaatgtcaatgggaatttatggaaacatgtttattaatttggcttatctgaactttgtttccaattttagtttaataaaattattaaatattttaatacaattattaaaaatattaaatatttaggaagctgaaaatattttgctgttgtgacgagtctcatttaatcatgattggtatcctattcctaacagtagtagataagcaacagtgttgtagaaaataatttaaaaattaaaaagacatttggccattttccccttgtattttgaaatgatttctgagtttagaaatcagacattatagcataagattagatagaaattatctttatgatataaatgtaatagaaacagtgctcataggtaaatcaatcttgtgttgttttaacaaaaaagtatttgtctattgctttactagttcatgagactcttcttgattctgatgattgaatcctttataagatattgaataatttcaaaagacagtagatccaaaatgtgaaatattatttagagatgttcagagaccatataaacccaattttgttaattttttttaatttaacttatttaaatgtgattcctttcttgagaaatgataatttggagacttatgcatagaatattaggaagtagaaaggattgaattcaatgtctgactaattattggactcaactacaatatgaggttaagctttaatttaggggacagaggcatgacaatgcactatttatcttaataaatttaaagcgtttgttgtaagctgctcaaagagagactttggttgtggggcaggagttgggtggaaggggtattggtacttcagcctcttgccttcattctcatgtgaggagagttagctttgaaataagctgaaagaccttgtagtttataaaaatctcctggaaagatgttatggtcattggaatcagttcagtcatctaatgagctacacattggctggagcacacctgaactgataataaacttggtttcttttggaaagtgccaaaagtacccatcttcccaatacatacacaacataaaatttaccatttaaccatttttaagtgtatagttgaattgtgttaagagagaattgactctcattcaatcatcatcatcataattatgttttgtatttaccaagaaggaaaactgatactcaaccttcaactttttctagtctgtttaccttaatattcctactttctcaccatcaatctgccaagatcttcttgagggaatacagatgtaggggtgtaggactctggtggtggtgaagcttagaaggagatttggagtcgtccacccttcagtccgctgaggcaccatttccatctcccctcctcccaacctgtcagagccaatagcatggctactgaaagaacagcgtgattgctctctgaatccagacattgtcctttcctatgacagacctggagaaatatcagacaactgaaccttttccagcgtattttgaatgtacgtaatcttggctgtagtcatcagcagacaagataattattcgttcacacatgctctggccaagttttagctcatttggagacttgtaatgactttggattctgtcctttgtaaaatgacaacctaagaatcatgtctttttactggttccaagttttaggtgggattttgatataagttttataatcatgtaggaattgtgggtcaaagcaagaaataagcattatgggcaggtggattcttttgcaggctagatgtaaaacatgtatttcttgaaggcttggcattctaggagggaatgtcttgatttaaggagatatggcagagaagagccttgtaagagaaagctattctgacatgagtggttttgttcttacaaataaacagtgactcaagtcagtagcagggcgatagactgtggagaacgctagcataatatcatacttggggtataggaaccatatacattcatttagagtagcattaatttcccatttaatatttgttagaaactattagagattttatcactctgctgacaacaattctatttggaacatgagctgcttatataaaaatcatttttaatgtgaaagctctcattagcttaaaaggcaaatgaaatggttagctttaaaagctgagtcacagtctcatttaccatcagaattcacagttttcttctttattttaattagtagattaatcctgtctcagcaatgccattaggtgcctgccttgatggtgtggaaaaatacacacaaacatctgatatttctgagcatttgggttgtgacaaatttaaatgtgttctaatagatcatctgtgtataaatagcttaagatttatagatgttttttaacttaaggatgaggaaactgaccactataggataattaaaaacagcaactctttgtaaatgcaggagctaagttgtcaaatgccagggcaccaacaggcaatattctgtaatctaaattgggtaatttatatcattgtcacttgaagatctgatataaattggagtcactgaatcatcccaccaacatctcataactaaagcaaattttgtttccttttcatgggtagggttttagtcaattgaataataaattatcctgtcttttctgaatcataggataggcaagcttctgtaggcagaactgatgaaatgaggccccaaagaagatattttaccctgttttaaaatatttccaatgaaggatatggtccagactactttggttatacttttcaatatttgaaatagtaatcttatgtggttgtttgaaaaatattttcaatttatcaccgaagatttgtctgaaatgttcggaagtcaggaatgaattaacttctatataacacccaatatcctggtcagtacctactcatagtcctacagttactgggtgtaaaaggcaatgctcctcttcctttgaaaagcataacctttcaagcgcttacagtttataaagaacagtcacgcacattttctcttttcagtctcacaatgacactatgttatatgaaaagattattaattcctatcagaaattaagattgagagaggttaagtgactcactcaaggtgatatatttagggagtggaataattacaactcaagaacatggtggcacgttcctgtaatcccagctactcgggaggctgaggcaggagaatcgcttgaactcgggaggcggaggttgcattgcactgaaatcacgccactgcactccagcctgggcaacagagcgagattctgtcaaaaaaaaaaaagttatttttgctccaaggacaaggtactttgcactctacattttgctgactctttggcatgccctataaaattgggcatggtaaacatgcattacgactcttttggaaaatttgttcctggggcaatcacgtgaattgggatgtggttgggagcatcattaattgagtctgtggtcagaacagagactagtataaagaaatacccagtgtaagtggcatcagtcagatattcagtgtaaatgaattgggaatgatagacacagtgaacggtccaagactgaaatgaaatctatcatctcatgagtattcaggggactggaactatattttaggaaggacgataggtgagaaggcctagatacaatcaagaaggaaacagcctcaaaaaataataaacctgcttaagataccctcttctgaatggatggagtttgatgatctgttggccctgttggtcagggaagggtgaaatgggctgaggaaactggaattctgtaacactaagatccaaggacacttccagaaatggcatttacaaggtgcaagtgttccctgtaaatcttctggcaaagggctttgaaatttaacttatattggaagaaccttaaaaagttagtagagccattcatatttctgtttggtttaagctgtgcctgctaataacattgcactgaaatgcaggcgtgaattcctataatgttaaaatcaaattgtttacctcagtttgaaaatttgctcaaatgagagtgattggctattgttagctctcaatttgactttcaagacaccttgaaatagcttcaggaaaaaaacgtgatttctagttaagctgttcagttaagcactttgtgatacaaagtatgttaaggtaaaaccttttatttaaatcaactttaagaaaacctctttagaaagttgcagagtataaatgaggaaacctttaaaaaaatacagctttatttcttttacgtatctattgggaattgagctaggtagtcgaggcaccagcatgaggttcttaagaaatctgctttaatgaacaaatcagagtgatttgtacttaatacttgattttgtttcaaaggccacataggcatttgaaaaataagtttttgcctgaatcctgtaatttcagctttcttagcaatttctcttttctgaaacagtgaaaatgtaaactttagggtagcctctgttcaaataatcacaatatgtgaattgaagtttgaggagttcatagagtgttactgaatttgtctgttttctaaaggaaattgattcatttttttcaaattattttacaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcaggtaggagaaacactcacactctccttccctatccctgcttattcctacccgtataatgttttattaataatctgatttgcaaaaatttatcagaaagattgtttaagtctgggtgtggtgactcattcctgtaatcccagcactttgggaggctgaggcaggtggatcacttgaggccaggagttcgaggccagcttgggaaacatggtgaaaccctgtatttctaaaaaacatgaaagttagccagatgtggtggcgagcacgtgtagtcccagctacccaggaggctgacatgggaggattacttgagcctgggaggtcaatgatgcagtgtgctgtgattgtaccagtgcactccagtctgggcaacaacagaacaagaccctgtctcaaaataaaaagaaagaaagatgtgtaaacctgtgtaccattgaactaagttcagtattgtctgtgataaaacagatatattttatgtttctaactgtgaatgctatgttaagtttggactgaactaagatgtagcaaaatgctgtatattaaatatccttagtacaaaactgaatcaatatatggaaatgtgcatctgaaacaatgggaaccaagtagaatatacaatatatgtgtgtaatacataaaaaatttatacaaacatacacatactaattaccagtgtatatataacatatttgcatatatgatcatgaaagaatttgaagtgatataaaacaagcataatgtctattaggttactttttagttttaaattaggtataatgacaacaataataaattactccccacaagaacaagtaaaactaaacaaaaaaaattggcactcaaactggttgaaaaatatttaaccttgtcttagaaatgtggtttaattgaaagaacatgggttcttgatcaaatctatccctgtgcgatcttgaacaaattatttcaggtctctgatcatcaatattctccatataaggtaagaaaaatagttacacttatcgcaaaattattattagagtaaaattagggtatatggaaattgactagcctgaacatttagaaattcaatattaagttttctttccttcattaatgcttataatctgagacagtggtaaacttaaaaaaaattacttaatatacttattaggctagtgttattgagatgcaaacaataacagatattcaccgagtacctgcaatgtgcaaagtggatattattcaattcactttatttctttagctgatgtgtttataataatcctcaccaaaaatccctgttttcaagatagataataaatttgaaaatgttaatgcatttcctaagtattgcaagttaacagatagcaatgttagcctttaaatccaggactgccagtatttaatagaacaacagggtgactatagttaataataactgtacattttagagtaacttaaagagtctaattggattgtttgcaactcaatggataaatgcttgaggtgatgcataccccattcttcatgatgtgcttatttcatattgcatgcctgtatcaagacttttcatgtaccttataaatatatatacctactatgtacctgcaaaagttaaaaattaaagaaaataaatccaggattgcctaataccaaaatccatttccattatcattcatgtgcagaaccacaaacccacggcacagttaaatacttgtggtaggttgtcttagccaccatttaaaaaatagagtcccaatatcagcatattctatgtaactttttctgacataattctagtactattataaatccctatgttagattagttataaaccatttctgcacttaactttatagattagactttacatattttatataatcttgaaatatgtactttgcatattttatattatgtatttaaaatacatagaagtgttatagataaagtgtatccaggtagcgttgatagttcatattatcttaacataaagtctttggggttaaggattatttggagtctaatcagaagaaaaatgaaggtgatcattgtcatgaaattcatgagacacctaataagttaggtactgttcactgtgggtgaaatgtaaaatagtcataatttctatttcaaatgaattttttgaaaagactgtaacatggacaaatgtagctctacatgaaatgtgctttcagtgtgtgtgtctgtcaggtgcctttctgatgaagtgacaaaggaatgccattgattagtcagatggagggtggtgagcagtagcatcctgctaccttgaggaaaaaagcccaagtgaaatgcactccagtgtacaacccctgccattctgttttcctgatcaccatgatacaaatcaaacatgacattcatgatcagccagtacttagttgtgtgactatcccagtggtctgctttgaaaagcactgcatagccttgtgtcccactctgctttgctttcatgggttgtttgtggtgattgctaaaaattgagcaagatgaagtatagttatgaattagccctctattatcttttaaaaatgaatgtacttttctgtaaacctgggagtgctggcggtgatgtgtcaggtggtcagaagtgtgattccatgttttcttcctcacagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctggtaggaaattgcgactccatatttttttacgtgtgtgtgtgtgtgaaatcacaaatagcagggactcctctgtggaactccaatgaataacacagggtgactacctttgaaacatggattggaggtagcatgcagagccggcccattcagcttctgctaagtctcagtggaaaactctgagaaaatgacttgaacctggagctgcacaggttataagtggaaaactctgctttagcaaggaatgaattattaaaaaaccctcaaaaatatgtacactcatcatctaaatgactttagagtgcaatataaccatttaattatatacctatgggaagtaaacatgtctcagtgctgccttatgatggttgagacaaaatttatatagaatctatatttttcagctaattcctagaatgtaccccttatcctcatggtccaaaatgggtgctgagctccagccataatatctgcattccaaccatcaggagtgatgaaaagatgtaagacatagcttcttcctttaaggacgtttctctggaatagaatagatcatgtttgcttttatttcatcagcctggagttgacatatagccacacttagttgcaaaggagaatggaaaatatcatttcaaggggctatatgctaaatgttgtctcttctgttactaggaaataaggggagaatggatattaagggacaaccaatagtctgctacagaggtgaataggcaattcacttaccccccacccaataacaatgaaaaattaaaaacatttaactttaaaataagtttttaattagaaattaagaaaatatagtaagatattcccctcaccattaaattgacatgttttttctctttaaaaatagtacctctgatcaagaatttaagcaaatggatactctcattcatctacttctagtggaaaaataaattgatatagtatttcttggagaaacaattggcaatacaatttaaaatgcttacgagtttgatctatagagttccttttcttggatttattctaagccagtagagagaagcataaacatttatgttaataattcaacatagaaagattagctaagtgaaatataataatctatattatagattcctttgaagatattaaaatcatgtgttagaagaatatgtaatggtatggagaagtccttacaatgttttgtagaaaatttgattacaataaaatgggagataggatttaaattacatttctatgaatatgcccctaagttgctagcaggttattaatagtgaatgtttttatataagagtgaattttattttcttatttatgcttttctgtattttttctatattcaccaaactctttataatgaacccaactaattttataattgcataaaataaaccttaaggaagaaaagatgaagattttgtcattaaaaaacaagtagaagaaagatattggagataaacattctacgaatgaaaaagaaaaatttccacagggcatgttctgcttatgaatgaccatacctgttataaaatgtacttcatggttgctagggggaaagtttacctattacctgtatctcatttttcatgaaatcaactttttcatcataaaaatggggactgaaagctattcagtgaataggtataattgccatctaagaggtgaaattagggtactagttgccatagagacagacagtagaaatcacttattcctccacttctcttttaagctaagaaaaagaaatcattcatggccagggaggtccctgaagctggcctgtaataagcagaaggatacctggtctggggctgggcaattgccatttcacacccccgagtgtctgacagtgtcttattttttgttttatctgctgaagccaagactgaaatattagccttttctcatctgtattattacaatgcaaattgtaattgcaggcagagcatggttttcaaagattaaaataaaaggctacggtggaagcagaaatacttataatgaagtctttcatgtacagttctctatggaaaaccattttgggagggaattgagtgtaaatatccttataccacatggtaaacttggtagaattcaaaaatgattaaaaacaccattgacatctctgttgagtatttatttgggggatggggtgggtagggacagatacatgtaatgatgatattggccttgaaattaaaacaccatttttactttctaggatttgcattgtattggttggcatctttaatgctcttagtgtattactgtgtgttaattttaaataggtcttctaagatctcttcagatctggagtgaacatttaaaaacatagatcaaggggctggattacacttgcaatcccaggactttaggaggccgaggcgggtggatcacctgaagtcaggagtttgagaccagcctggccaacatagtgaaaccccgtctctactaaaaatacaaaaattagccgggcatggtggcacccgcctgtaatcccagctacttgggaggctgaggcaggagaatcgcttgaacctgggaggcggaggttgcagtgagccgagactgcgccatcgcactccagcctgggtgacagagcaagatgcaatctcaaataaaaaataaaataaaataaaataaaataaaataaaataaaataaaataaaataaaataaaataaaataaaataaaataaaaacatagatcaaatcaagtcactttcctgcttaaaatcctccaatgggttccattaaaataaaacggaaactcctgactgtggctttacaaggtcatttatgatttgcccctgcttgtctacctcacctgcctctccatccttgcccaatctcactacatctcccaacctcatccgcctctcacaacctcacccgtctctccagcctcactgcctctcccaacctcacctgcctctccagcctcccctgcctctttagttttacctgccgctcccaactgcacctgcatctccagcctcacctgcttctcccaacctcacctgcctctttagttttactgcctctcccaacctcacctgccagtccagcctcacttgcctctctcacctgcttccccagccccatttgcctctcccaacctcaccagcttgtcccagtctcacctgcatctccagtctcatctgccttttctagcctacctgcctctccagcttcacctgccttccccaacctcacctgcctctccagtctcatctgcttctccagcctcattctcacaccctctattttgctcactctcttccagccacactggctttctttgcacatatttatggggtatggtgtgatatttccgtacatttatacaatatgtaatgatcaaattagagtaattagcatatccatcacctcaaacatttatttcttagtggtgagaacatttaaaatcctctcttctggctattttgcaaggtacttaccactgtaccaccgacaccacctcttctagctatttggaaatatgcaatatattattgttaactatagtcactactgtgcaatggaacaccataatttattcctccttatctcttaattcttagctcaaatgtcattttctcagaaaagccttccctaactactctccccatacattcctttgtcacatagccatgttttatttccatcttcctgcttagaagtattgaaaaatactttgcttgaactttttaattgctgtcctcttttactcctcaatttgaatgtaaactccgtgaggttagatcctatctgtatatttattactgtcacctctggcacccaaaacaatgttggcacatagcacgttatcaggtaatgttcactgagtaaaaacaataaataaaagcatctattgttggtgaaaatcgtgtagtttccatcctataactgaacatgtttgatgataaattattaaatccccttgattttacctctctgacaccacccttgctgaattgttccctatcttatatttggctaaaaaacttacagagtaaggcaaaactatggagacagtaaaaagattattatttgccagggcctttgagtgggtcagggagggatgaactggtggagcacaaaggatttttaaggcagtggaactattctgtatgaaactgtaatggcagatacatgtcattatacactagtcaacaacctatagaatgtacaacacaaagagtcaaccctaatgtcaactatggactttagctaataagaatgtatcaatagtggcttgtcaattgtagtaaatataccacactaatgcaaaatgtaaacagtagggaaaactgggaggtgggggtagagttagagggtgaggactctgtactttccatttactttttatgcaaacttgaaacttctcgtaaaaatacagtctaaccacccccccaacctaccacagactattaataaaaactgatttggatgaataagggaaaaaagcaaatccaagatttattgcctagtggtgtggttggtgtggggagaaggtattccaaaatgaacagcttgggttcaatttagacttaagttgcttaaatttttggatttcttgaaaatggtaatgaactgtgtagatgccatccaagaggaaaaattgttaccactaaaaaatgcagaatatgtttagaataaaaacaacctgaaatctttcctgaacagatacaaatgttttcttttttcagtatggaaagaaagaaatcaggcaacttggtagcctacatttgttgaaagcaaacttgagtgcatcaaattatactattatcaagggaaaataaaataaaatattctagaaaacactgaccctgagttcatctgcacagattttttcccctaaatttagctttccatatttattacccactataaataaataaataaataaatcccactatttattagtcattaaatatttgaaaatatttcctcctgagggttttaaaattcagtcttaaaagtcattttttttctctctctctttttgttttggaaacggagtctcactctgtcgcccagactggagtacagtggcgcgatctcagctcactgcaagctccgcctcctgggttcatgccattctcctgcctccgcctccccagtagctgggacaacaaacacccaccaccatgcccagctaattttttgtatttttagtagagacagggtttcaccatgttagccaggatggtcttgatctcctgacctcgtgatctgcccgccttggcctcccaaagtgctgggattacaggtgtgagccaccgtgcccagccttaaaagtccttttaaattagtcttgcaattataattccattatagcaactgtgttggtatcaagaaatcaaaaatcaaatgtatttgtagcaaaatgggcctattgacgtggcagaatttcagaagaaagggaaggcacactctcccctgtcttagcacatcttacttaaagtatacgttttctgtctgcttcctgggacttgaaatttcaaaattacaaccagttccctagggttaagactttttatcttttttaaaatgcagcaacatccctgtgagtaataacacactgggttatcagtaattcattcttactttcgagtaaatttagcagatcctgttctacaagcaggttttaacctgggagaagcgagagatggtaatgacagagggttcaccaagtctgggtaaggtgaaggtggggttgctcaaagaattgcaatttgcttacgggcagccctgtttactgttaccattaatactctcaataggatgttgccatgtaaatgcctatctagtattttgtgcaactgaagcagagatgactttgctgatataaaacgtgtcacggctggaggtgggaagtgtacagcttctaaaacagcactagagggaactgggagcactatcaatcaataactctggcaagtagaaaaggctctaaaagtcgaaggtagaatggatgcctctttcgcaggctaaatacacaaagagaagagctgttggcattggattgttcaccacagtgccatttcagtggccctctgctcatcaggaaagttttccagaaactgtccctggagcttaatttgaaatcagaagaccatttctaagtgactcttccatttattttactgcgattcttcttcttttttggctcaggtctctgaaagagcaagcatcacttccccactctggatttttactttctctggaaaaatatcccactgaagtaggtagtatagtcacagagtcatcgtcttttaaggctgataatgtcatataattatattttgcaaataaaagtaatatgactttttttcatttaggattcatcttaaattgggtgttgttaagagtaaaaattggttacagaaagagttacttagtgttatagccagaaaatggagatgtttaatttgataaacattttctgaactccttttaatgtgcaagccactgcgttaaatgttgtggaaggttcagcagatcttgtgcttcagcagcttaccagcaggagatgtaacctggtgaggtactacccagccctaggagtctactattggggatgtgaatatgttactcatcatttaacatggagttgtaatagcaggggattacactggaaaacattttgtaattttagtagggcactatcaaaactagtttgtttgaattggtttgacttttttcattctgcaatcgtgtttttatgcatgtagacttagctccagccctaatgttttactctagtcacatttctacgttttattctgtgtaaccaaagatgaataagcagagacggaatcagcacagatagtcatgatagaacgaatgacagttctgtaactcaagagaaataggaaaatgtgtaggaacacatatatttgccacttgtaaaataacattttctcatttgatatgccattttgtatatgtctttaggcttttaattattcaactaaacaagaatattttggatgcctactatgtgcaaggcagtgtgcaaggtgctagagaaagaaatagtatgaagcaaaacttctgtccttgaggaatgggcaaccctgatgggaaaggaggacttacacctaaaaagggaagtagtcacacgcagtgttcagagagttgaccacatggtattttatgtccttagctggagtcttagatcatttagtcctatgatagacttttcacagtgacttataacacacttcttctaccacctctgccacctggtactcagcagaattttatttccaaatacatttgaaagaaaaatattatctgactttatatactttcttctttagatggccgagcttttccttttcagtgttctcacctttctaatttttcatgcagtcaagaagtattttcctaatatatttgatcatttccattattttaagttgttatgaaaaatatttgggtaatatcttaaatatatcattctgaagtggaatagctacaggaggttgcaactgtaagaaataagcccaaagcattctccaaggtgacttctgtgctaccttatttaacattaacataaaagttaaaactttactatggtaagaacaattttttttaaatttgttgttaaaaaaaggaaatcaaaacaatctagagaacataagtcaagggttatttaatcttttactaagtcagttgggggtgatttggagagcagttgatagtgctagagtgagcaggaatctagcaaaaaagagctaattgctgtctaatcacgcttgcaatggaatgaatacactagtaagtattacagttaagccaggcataatggttggcttaaatacattctgttatatcagtgttataaccagtatatattcagcctcaggatgggaaagagttgtagttatgtctatagttccccgatttagttttgcttattgaaatccatttaaattaaaattggattcagtcaaagatagtctcattccatcactgtctcttattgtgaagtttgtgtggaactctattagtttgcatttcaagaagtatctttgcttgtatagtaatagaacctaaaaaaagaactgtctgctggcatgtgcccaaacagagctcggtgtttaaaaacaagatgctgtattcttggggtatggaaacttccttcacatgtgggtacagcaatgtctttggacacattttctgtgtaaggggaaaattatcagcatcttgaggagtggcaaaatttctacttggtaccaggatctctaggaccatggatatcagagatacatatccataagcaagtatttcaggttggcttttttttgtggaattttgtccatgcatactcaaagctggctttgcattcttgaatcctcaggctttgtaacacttttggttaaaggtagtaaggtagtcaaattggcctgaaaattctggagaaggtttactaaggctactcgtctggatattttatgaaggagttaaatcgtaatgacagctggataaaaacaaatatttctaatgactactcaaggtatagctgacaactgtttggggaacaaaacaacaagagaaaaaaaatgatctgtttatgccaaaagggccccctgaagtagattttgtcaccattgtgaatgtggagacaaacgtcctctgacttgctgtgtgcaagttcacttgtcctgcgccattacaaatcaggcttgcaaatgtgatgcattagtcccaggacagagagctctgttgcatacaccaaaggcagtggacttccagtgaacttgcaaatattctgactttacacttgtttctgtatgaccgagagttgaccacactgacaggcttgattgcttaaaaacaacatgccaatctattagcaatgcttttatttgtttcattttaaatatttaaggaacttgagaatgaaaggaaataatcttcattctagttagcaaatatatatgtaagagcaatctgatttacaaatgtaccaagtttaataagagtcatcttgttttaaatgatctgaaaagatgagccactgcagaaccatagaatcgaaacctagtttttttgcttagaaggaaagtaagagctagaggaattattccagtgttctgaaaaggagaggacaaaaaaagtctagagtagattagctttttattgactcacattttctcaagcaatagcttctccaaagttcctaactccttcctgaaaaaacagaggactcaagtaaatacatttcttcctatgtttcatatgaaaaaatgtttatcatgattgatgcatgttgtgaattagacttggagggaaaagcagtcatggcaaaatttattttcatgatgcttaatttgatgaatgttactttattgtttattaccaacttgcacttgcaataggaattctacactttaatatggtctgctcctcaagaatgcctagattctagtctaaattgtttcactagctagttgtgtggctttaagcaagctaagttttagctcagggttttcaactataaaatgtggttgtccatgatagactgtctttaagataacttctaagtagaaagattgtggttctaggaatttaggtctaattcaggataaaatgggaatctatgcaagatttttgagtcctaatatgacgaaagtgcatcttttcagtattattaaataattacattgactttgcaatgattctgggcaattagttaaacttcttactggtaagagctggaaggatagtttcttcacaaaagctggacaatttaatccatctttgagtaacagtatcactgcccccttcagtaaagttttctttttaaagacataattttactcttaaagggtaactttacacacccctgctctggatacatctaatgcataaagtaatgtcaacctttatctgggcaagtcctctattcttttagagacaaagccctgacaaggaaataagatccattaggagatattcatgtgacagaaccagagaaaagctctttgtattactacaacaggcaaaggcaactagcagctcaggctgagacatcagatatgtaaatcaggccactgccagattctatcgactgaatcaacccagccgtcatggctgagtcgtgctgacttcccggctcagggattatctgaggacatcttctcaccttctctgcttggcttttgcgctttgtattttatttccatcagtatcatttagagatcttggaaggaggtgaaactcaaatcgaccattttttctccctgacaacttagataaattacttagttgagaggaaaatttgaaatttttgacttaaattgtggtttggattattggtacattttagctattcatctcatttgttttttctatagctactaataattgaaagctgactgcagaaaatagaataaatttataattctcaatacaatagaagctgttgacagagagaaaaatcaaatccccttatgaaacaatttcatatgagcaatgattttatgttctgagaatattaatgataagatatgtgaggacacaatttgagacttttattactaaaagatttctggttatttctgaggaatctcaaacagaagcttgttttgaggtaaaattatactcgattatctctttatgacgtttattagacaatgggaaaaacagaaacaacttataccatggggttaacaaatatttacttgggggcttttgagaagaacttgaactataaggttttggagtatgttttgatcctaaatttattttacctcaaataagcatgtaataaagttttaacatttgttttactttctgatgtttgagtattatatttctacaggggtaatcctattaaaagctttatgcttatttttcagtacttaatttgaaagagaattaagagcatacaaaattacagaaaaatgaggaagcctaggaaaaataagagtggagaaatctagagacaaaaagagagatgggagttcaaaaagataattacaagtttgagaagtggtcagtaataaataaaatgttttattgcacacacatatgtgggtagcagacagagagaagaaataagtatcacaaaagcaaaacggggaaaaaagtgattatgtaaatggatggatgcatctgggaatacaaagctgaataagattgagtccctgctctactggaattacaatttactggagaagtaacaagatggaaataatataggtaaagaataaatcataagatagaaaataaaaaaattccatgaacagatttaaaaaaatagaatgttttgggaatatggggagtgagaaggagacagaaggggaaatcaggaaactaatagaggagagggcactgaagtgagctttgaggcctggcaggattttgatcagggcagatggcttaagaaagtttccctaatagaaagaaatgtgtgggaggaggaacaagtagggtgtgtttagagaagcgtgattcatccatgtcaactgagacttaggggaactggaacaccatagttctaggttagaaaaattttacttcattcagtaagcaagggagaaaatgacaaagccaggaattagtactgtagttttggatgatgattctggaagtggtacttaggaaggagtgagatcagaaggaccagaacctactggtagctgagtgggacttcaagcccacctttgagtgctgcttgagagaattcggagaagataggagatacttcatttttttggtgggagtggggtgggggagagacagggaggataaaatggagcagataatatttttaaaggtgactttgctgcctctggaaggataaaaaaccctattctggttctcattgctattatgttccaataccacttgccttgatattgcagtaatctttgatgttaagggagtggaattaggtatttatgaatatgacctgggacataaggaatgtatatacatttatttgacagctacttatttggtgcccactgtgtgccaagcatgttacacaagagagtaatcataaggaaggtgacactagcctcagtgttaggatggatgggggttggaacagagcttatccttctccctcccatctgttgtggtgagactatggcttacttttactggaggtatcatgtgggtctctctgtatgtcgtcttcccaatgagccagttcaaggattctgacaaccacctttttgatgtttattttgtaacagatgattcaagagagccggtttctcatagaaatggcggacacagtccaggaaaagattgtacagtgtcagaaagcaggtaattgtttttaatttttttttctgttttttttttctattttgtttggaaactataataattcttggtagatttttttttcagaaactttctgcttctcttaaaatgcagttattttatagcaatgcttaactatactttaagttacactttagtctttgtttagtacagatgaaatccaagtgataataggtgggttgtatgtgagcgtacagggttggggtggtgtctgaagaagtctagagggatgagggtttctgaatctagttttgtggtttggaaccccatcaaaaccttctactgctggtattgaagctatggttccatacagtcccttaaaacccacttcaattttacaattggaaccaaaatcctattaatcttccaggcttttgccccattactagtcttcactttagatttagatttgttctttctttttaagtatgggatgagtcacatatctgtgagagtgtacttgtttatttctgttcaccttcatccacacccttgtgctttcatctcctggatccacaaccttctctatccacatacccgataatgattatgacgaggaagatgacaatagtagcaactgcttgatacattgcatatgctataccaagcacacacactatcttactcatgacaactctgcaaagtaatcatcattatatccgatttatagatgaggcatctgagattctgagagactgagtgacttaccctaggtgccatatcaacacgcggtggagctgccctttgaatccagaccaaacttttaaaatggtgcttttcactggctgaccagcaggcttagatatttctgttgacaggaagcacaaaaataataatacctgatacttacatgatgccaggcactgctctgagatctttatatgtactgattgacttaagctttacctctgtcccatgaggtaaacccacttgttaaccacatgtcacccgtgaggaaactgaagaccagagatgtcagggtctttccgagactcacatagctagtaagtggtagagctgggctccacactcatgttctttactatgtgctatgtttgtgatgttagcaccaggaaagttaacgtggtcttaggctgcattaataaaaatataaaaactagaacaaggagaatggtggtagatccctgacctcatgtaggcttctccaagcccattttgagtacagcgttcactcctggaggcaagttcccacagagctcagctccaggaaactgggcaatgcagtggccttgcctggatgccatctttaaagaagagtttcattggcaagctgaatatgtttgaatggttaactgagagaagacttgaagggattttacccaatatctttcttcaaatatctaaaagcttgcactgtagaaaagagtttagacctttttggtctgtgtccagctagcaccaaggagtagaagttccaaggaaggagatttttggcttgatgtcagtcatagctttctgaagatggaatgagctgttcataagagaatatgatttccatctttaaggtgctaagacaaaggctgaagaaatgtgatggtgatggttttcataatcttcaagctcgagcagatggttgagctaaaaatactttaaggtcattcccaaatctgaaatacttgggtgtttcccaaaatgctatttttaaaaaagcctttttatttttagccaacattactgattactcattgttatctatgtgggttccaggacctactattaagcgacagggatggttcataaagaaaaataagacatatgcattcctcacatatggttgccattgacacatcagaccatttcatgcataaaccaggaagaggacaaacaaggtccatgtaacctgttggaataatttgcttcttacttatttacttattaaaattttttttaatttttaatttttgtgggtacataggaggtgtatatatttttggggtacatgagatgttctgatacaagcatgtaatgtgtaacaattatatcatgaaaaatggggtatccatcccctcaagcatttctcttttgtgttacaaacaatccaattatactgttttagttacttttaaatgtacaattaacttattattgattatagtcatcttgttgtgttatcaattactaggtcttattcattcttcctatttttttgtacccatagaatttacttttttccttctcatgtcattttctatggctcctggctgttttaaatacaatttagcctaatgcattgactgttgtcaatttgtgcataaggacagctacttggtgggatgaacagaatgaaaaggataattcaatttagggatttggaaattatgagaagacaggaatgtgaaattatattttactgataatattttcattataagatgcccatttttctgagatatatactcagatttcttatgcattctttcttcaaagggatggagttccatgaagaacttcataatttgggggcaaaagaaggcttgaagggaagaaaactcaacaaagcaactgagagctttgcttggaacattacagtattgaaggtagatgaaacactcagatgtcccctgtgcctttacttttcttctcctcatctctccaatgtgtagagaaatgtaaaggattaaatatgatggtttggatttttaaaccttcactttagattcagggttacatgtgcaggtttgttatataggtaaactgtgtgtcgcggggggctggagtgcagattattttgtcacccaagtaataagcacctagtatgcaataggtagttttttgaccctctctctcctcccaccctccatcctcatgtagtccctggtgtctgctgttcctctctttgtgtccatgtggtctcattgtttagttcccacttataagtgagaatatatagtatttggttttctgtttctgcattagtttgcttaggataaagccctccagctccatccatgttgctgcaaaggacatgatcttattcttttttatggctgtgtagtattctgtggtgtatatgtaccacattatctttatccagtccactattgacggacatgtaggttgattccatgctttgctattgtgaatagtgctgtgacaaacagacatgtccatgtgtctttatggtagaaggaattatattcctttgtgtatatacccactaatgggattgctggggtcaaatggtaattctgttttaagttctttgagaaattgtcacactgctttccacatggctgaatgaatttacattcccaccagcattgtataaacattcgcttttctccacaaccttgccagcatgtgttattttctgacttttagctattctgactgtgagatggtatctcactgtggttttgatttggatttctctaaggattagtgatgttgaacacctttttatatgcttgttggccgcgtatatgtcttcttttgaaaagtgtctgttcacgtcctttgcctgctttctaatggggtgtttatttttttgcttgttaagttccttataaattctgaatgttagacctttgttggatgcatagtttgcaaatatcttctcccattctgtaggttgtctgtttgctgtcttgatagtttcttttgctgtgcagaagttctttaattagatcccactgtcaatttttgtttttattgtaattgcttttggtgtctttgtcatgaaatctttattaggtcctatgtccagaatggtatttcctaggttaacttccagagattttatagttttaggttttacatttaagtctttaatccatgttgagtgatttttgtatatggtacaaggaagaggtccaatttcaatcttctgcacatgactagctagttattccagcaccacttattgaatagggagtcctttctctattgcttgttgttgttgactttattgaagctgagatggttgtaggtgtgcagcattatttctgagctctctattctgttccattggtctatatgtctgtttttgtaccaatgccatgctgttttgattactgtagccttgtagtatcgtttgaagttgggtcaagtgatggcttcaggaatgtgtggcttgatctctaggttcatactctaggagatggggagctgcatactggaattaacatggtttttgccttaataaggcaatgaggttttcggtgcaggcagggtacagcccatgtgtgagattaatttgcctggtgtgtgtgtgtgtgtgtgtgtgtgtgtgtgtgtgtgtttactcacatgaatacttacgttcaagtcaatatggctgttcttgtttgtggaaagaataatgacaaatgcttctggggaagattccaacacaaatgattttgaagagacaaagtacaaaatatctagggccattgaggatttttattttaagaacagttcctataaatacatttctttttgcaaataactttggaagtcattttcttgagattatgatttgctctctgctgcacatgaattttagaattttgaagtaaatatgccactttttatattttcttacatgaaaaaagaaatgatttaggcagacaatatattcttgacagctaaatgggagaaaaatagctacaaacaaaattaataattgctgacatttaaagaacactcattttgtgctaggtactgttttatgaggtttatatgaattaacaatttaatactcacaccaactcagtatcgttattaatctcattttacaggtgagaaaacggaggcattggaagtctgtgtatatttcctgagggcgctcagctagtaaatggtgtaactaaattttaagctcaggcagtctggctccagaccctgtgtctttaacctgtgctgcagagatgctgcacatgtttatgtgaaagtgttaggttagctgtaagacatattacaaatgtctattaaaaattcagtccacaagtgataagcccctactatgcattgggctctgtgctaggcactgggaatacgtggagaacatgagatacagaccctgacctcatgaagttagcagtctgagtccagtggaggagggggatggataaggcatcatttgcttaaggagcagggatgacctagagctgtagtgttaaagaggtgcttattataaccctagattataatgtggcagtgtgtaccctgatataaacattttatgttcagaagattttatatgggcttgttaatgtgcctgtcacagaaaggtgctagggatacaaatatcaggaggattacctgggtctccaagactagtctataaggagagacagacatgtaactaataatggccatcaattgttcagcacttattttgtgatcagcactcaaggctaggtactttatgtacatttcccctttcttccttgccacaacagtgcaatcttgcaacatgacatgctgactctgataggactctctccatctcacaaatgaggaaattgaggcttgtgggggttgaaatttcttgcctggagtcacacagctagtaaacagccagcctgcaatttttaactcacgcccatggttctatccactacactgttctgcctcctctaaaactccatccatgtggctgagtccctgtattagtcttttctcacgctgctaataaagacgtacccgagagtgggtaattaatttataagagaaagaggtttaattgtctcacaattcagcatggctgggagggccacaggaaacttacagtcatggtgcaagaggaagcaaacatgtcctttttcatatggcagcagcaaggagaagtgctgagcaaaaggtggaaaagccctttataaaaccatcagatcttgtgagaactcactcactattatgaaaacagcatgaggataacctcccttatgatttgattacctcccaccaggtccctcctacaacacgtggggattgtgggaacaacaattcaagatgacatttgggtccaaaccatatcagtcccattgggtccaggcagcctagtgcaggaataagaatgcaggccctgtgtgattacctgatagtggtgagactagccaagttatataatctccctcagggtagtaataatacctacatctcagattttgtgagaattaaatgagataatacatacaaaagatgtaagtcacagtgcacaaaactagacagcatatatgttagctgttatttgtttgtttgccaggtgaggataaacatggagaaatgaggtttttgttatttttatttctttgttaacttctgacttaagcccacttagtgttgtcagagatttcttaatgtttttgtttggtttagtaacagaagctgattgttagatgtgattgagcaaatgctgttcaaattattccaagagagagcttttcagacagaattgattttctattattataactcacatactagctgctggtatttcagcttgagcactagagtagtggactactactaaacaagagtagagaacatttccacacttccaatagctcctttttctcctccattgagtttggggcctgttaatctggtgtcctttccccaagagctggacaaatgacctcctttgaatttgaattattagctgagagaaaaagagcctgggctctgttggagactttttattccagtggtgctgctctaagaagatatctttttctatacgattcttcctttagttcttatgcattagatctgaaacacttgattcccaattaattctccagacttgctattgattttcagagctcctctaagtattttaataaatgctctttgtttataagtttagtagattcaatttaccttgcttccagttggttgaatgattaataaccatcctggaaagacataatcactgaattaggaggctgtggtacaattctgcgttgcctactgaaaaagtttccttatacatgatttagactagtattccctactatctagagagagggagtgggaattaaccaattctggttaaatgtgttggtttgtatttctaaaaatatttaattccagtgtaatttccaataagtaaggaaggagctggaaaaaaatgagaaatgtgccctcagcaagttgggggattgacagcatggagtggtgcaaaggggcattggctttagagtaaattgagctgagactgaaaaataaattgtttagtgttttctgcagttcaatattacatttatctgatattaaaagctggagaaaaaaattgcagaaagaaaaatgactaacgacaatataatgaataagaattataattacagtgtccaaattgttgcagagaccaggacttagtatttagcaaggaaactgaaatcaaggtgcttctggaagatcccacacttgtgtttttctttaattcatattctagcacctacgtgggtccagtatagggacttgtttagcgtatcttttgcatttttccatacttttgccatatgtctatatccaactgtagcagtcaatttgctcttcctttctttctttttcactattgtacatgaaattggtctccttacatagccattgtgtttatttaggatgataggatgattcagtcctcactaccttttcaagacaatcactggatcaaaataactccattccattccaccctcacatgttaaaagacctttccctctgtttcttctccatgatgtccttcttgtgctgatataataaaatacctgagactgggtaatttataaacaacagaaatttatttctcacagttcttggggctgagaaatccaagatcaaggcaggagtggatttagtgtctggtgagagcacagtctcttcttccaagatggtgacttcttgcttcgtctttcagaggggaggaacggtgtctcctcaaatggctgaagggaaagaaaggcaaaagaaggtaaaagggcctagctagttccctccagcccttttacagggcactaatcacctcctaaaggccttacctcttgatattattgcattggggattaagttccaacatgaattttggaagggacacaaacattcaaactatagacatttggttgttaacataatattaaaatctcaaaatggaaatttttcctgttttttaaggctttcagaaagggatactacaacttcacttacgtagccaacatattctagtacattgttagtaattttggaagtgtttcactcatgagagttctgaagatctcttgggagcaagatgtggaattacactatatcactgataaaatgctatttgcaatgaagtggaattcatctaaagtcttgaactctatccagagtgatttgactttttaagtacaaaaagaactgcattgtaaaggtgatcacatctataaaactgaaattagaaagaacccaaggggagcattttagtgagctttcccaatatatatttttctaacttgtcctgttggctattttaagaaactaaattttattactttgtgtttttaaaagttttatgtaaaaatcaattttagcaggctggagaagtatcaagtagagatatataaaaataatattaaagaaatataattaataaatattttattacaaaggaaaaactatgaagtaggtaatcactagagcttaaagagaaataaaagggttaagaagtagctgcccttcttatttattcatgactttcattgattacttgttgaataacaggcaataaataaaaaatgaatataactattacctcttcaatggtcattcctattaaatatgtatttacacttttcctggatagatttccaacttataatttaatgcattccaatgtgtgccatgattctgggctgcttttataaatttatgtttagtatatgtgactattacttttccccataacgcttttgctttttatcactacttaagcctttgctccttctgcttttatctaaaacattttcaatttccgtgggaagagcagagattgaagcttctcacttctccgtgtgtagttatgtttctaacccaggcagattccctcactgaattcccgaatttcaggaccttacagttctggggaatcttgctacaacagaggaaattacatggatgtcagtgtagaaatacgctttcaattagagcctgaaaacacatttgaagtctctgttcattgttgagagacaaaagaaaggaaacagatgatgggctaatgggaaaagaagtatgaggagaggcatccatctctgaaagctgagtgagagtgagaagtgggctacccttcacttactggccatagatatttaaaatcattctatgagatactgtggagagggggctgttagtgtgaatgttcaaaccaggctcttccaacagacatagtgaccatgcctttgggggctgcctgagggtatataaagaaggaacatgcccagtatcatccacattgtctattgagaacttttccagtggtgtctctggcatctgccagctgttgttgctgtagaatctagagaaaggctaggattccttttgagtattcagaaaaaaaagtatatttacaaagtgtagaaacagacctccaaacaacaacaataatgcattaataataaaccatccttaatattgatattattatactatcaattattgagaaacagcaggcaaagtgattaagtgtacagacgctgcagccagacacttcctagctctgtgtctttgggaaaattttgttttgtctctatgctcttgtatcagttggggtatgctgggttgtgctatagtaacaaaaatctgaaaatctactacaatataacacaatggcttatttcttgcttgtactacatgtccatcacaggtaagtaatggtcactcaggaacacaggctaatggggactccatcccagcaaatacttctacaatcccagaggtagggatgcaaaaatggtctttaaaagcttctgcccagtagagtcacatgtcccttccactcacatttgactggtcaaagcaagccacagtcaagtctgatttcatggagtaggacaaatgtaaaccttctcagggaagaggagcagatattggtaaatacaatctaccagtgacaagttcttcaactaccccttataatgtggactaaatgagtaaatatatataaagcagtatctggcacatgctatatgagtgtttgttatttttattattaaaaatgaacattcagtgcttacaataatcaagtgatttttacacaacattttaattacttttaaggataaccctgtaaatttactcttattatacccattttacagataggggaaatgaggctcaggaggttaagaaccttcccattggcatacaggaagtgagtgatggagcaaggatttaactctaaaggccatgttgtcatcccactatgctatattgtcaaaatactgacagcaccataatagtaatggtttgtattaactgagcactttctatgtatcaagtatcctaccaagtgttttatatttattattttacttatctaagggagtgagtgtcctgcccatctagcatgaatatttcaatcaccttgacagaatatgcctactgtcagtagtcagtggttagtgcagaaagctacagcgagagagtgtatcttgagaataatttatttacaacactatatttacaaaacaactctcttttctcaatctggtttcccaggtacacttttctagtggaaaatagaatgaattgaccaagtggtataactagttccatctgcccagtagtcacatttctctttgtaagtaaatcagttaacttccttttttatttgtccatctcctatgagcttggttagcatgaatcagcttcccagggcctgatcacccctgagcgaatggatacagttgagtccttggacaggtacgattgggaatcacggaagcaaagcaaaacaacaacaacaataccaaagcagaagaccagacccaggacccctgagagcccagccagcctcctcttgtttctcttggacagctttgctattcattggcttttagtctggacattgctagctgccatttcttgatgggacagaggaagttcaagagccatgcctctagcaaaaactttacaaaggctatactcctttcatattccttcctcatgccccctcctccacagccacagttctactgttcagacctacaatctgtcctttatcaactgaggagttacagcagaatctattctgtgtctcctctaggcaacatttacttcttcaattttcattttgttgtaaagtttatttcaatttttttgtctattaaacgtttaaaaataatgttggaattttggcaaacagttacggttaacagtcatgccagaaacatttggtgaacgcaactgggaggggcaaaatagggatgaagccaaaattgagggtcttattccagtggcagccagtttagtctcgctcaacctagtaagccctcaactcacttggaatcttagccagctgctttacaatggatatcattgattaccaggaagaaggtgggtggcagaagggagagaatggatggatcacttctagaaaaacagcttgaatctcatatgtcagtaccattatttttatacacaaaagaaaatattattaagccttataaagtgtagagtatacatttagaaggcatagcatctatctgggggttataaactaagtttgatatatttatccgtggacgaggtatctgaaaagatactcctagacacatttgtagaatcttgttattgtttggctaattagtgcaaaataaagacccttctctcccacctcaagaaggtgatgttatttccacactgacatttataaataaggaagtgcaatgcataaatgaggcttctaatccataaattagcaaacaataatttaacaaatttttatttcattttatttttggtgaaaccaaatttattaattcaacaaatgtatctgttacgtctttactaggtgacaggctttgtgcttgggaatgtactggtgaataaaaatgtggccttctggtctcagagctgacagtctagtgggggaagctgtcatttaacaagcacatgatgtgtgttaaatttgtccttatgatgggtgccttaaaaaagtgcatgacactatgagagtgtgcaatgggatttgacctaatgggagaggccagggaagtattccacgaggaaataccagtacagtggtgagtaaatattccagcctttcatggattccaaaaccctgccttgtatcttgatacttgagtgtggttgccaaaacaatttgaaaataatggtgaaaagaaaacacatcaaaataaagatgtgccggacctcttcaacatggtctggggagttctaaaatttctgccttgctcatttaattaccactcattagcattatggctaatttgttattatatcaaatctggccatattaattacaaattaatttaatcatccaccttctaaaatataatctgcagcgaagttttataaccatgtgtatccataaaattcatttaatagcttatagttacagaggaggatgttataaggttggtttctgagaaatttctacaatttaaagctgaaaagatgcagagagagagagagagttatataatatagaatattagtattagtgttagatatatgggtaaattttttgaagtataattgatgcatctataatttaaaaaaagccacaagtttaaaacattatttcaaacagctcttatccaacaatataggacagtttaaatagaatgttaatgcttcttagcaataggcagactggttacatggtgtccagatttctgccttgggtggctgcatcccagctgtgctgcccaggagtttagtagagataaaagccgggctgttgacatgattatggaagcacacaccactttatctccagtagaactaaatttagcatctcttggaggtacacttttttttttcagatgaaagctgcattttataatgaatctgaataattcaaaagtggcaggatcctaatgaatagatgcatcatagaccagaggacttggctccaacttgtgaagttattgaaggtcttacttttctttcaggaaaattttccttagagaaaatttgtttcttacacacagagttttagcctaaggtgagttgtagcttaagtgagtttgatgtcttaactctgcattaagtatttcttacagtgatataagtggaaagaaaacattgataaccaaattgtttcattctggttccttacagcccttgtaggttttatactcacaagctccttttctgatattgttactcaaggaagacaaaaatgggctacatctatctaatttccttattgttaatccaaatcagagcaaaatgagttcacttctctgaatgtgtgtgtgtgtgtgcatatatatatctatatatacatatacatatatacacacatatatggtatgcacacagacattgtcaaataaagtcaaatctgaatttagatagagaatctgttcaaaagaattatcacaataaggagaggggactactgtgataggggaactattgtaatggggagaatgctcctaccttaagatctgtaagcatttgaaaggccaggcagaaaggatttttcttttatagggaagggcacagaaggtcagaaagaagcacatatgagggagtgggtagcgtgatcccacagttgatcctacagtgaggaaacatctttcctgtggtcagtcctttcttggtaagaggcgattaaggagaggctgtgtgctgtctcaggatgagagtgggtcaaagttccagggcctaaggggaagagagaagcctaattaaagtttggccaagtccaggtagtaggtatcaatattttctccagattggttagtggacacaaacagacaaacagttcagctagtcatttatgaggcaagaaagggaatttgaaaggtctgtgtctggccatgtcacagataaacaagggagattccatgagtcttagccaagtcctatggggaagaggggttctttgcagtaagtaaggtcttttgaggaacacaaaaggatgaggggatttcttaaccatccctgatttcctggaacacagggctcagataaagttgagcattgtcaacatatgcatttatatattgtattatgctgctaataaagatatacctgagactggttactttataaaagaaagaggtttaatggactcacagttccacatggctggggtagcctcacaatcatggcagaagacggaagaagagcaaaggaatgtgttacatggtggcaggcaagagagcttgtgcagtggaactccatttataaaaccatcaggtctcgtgagacttattcactaccactagaacagtatgggggaaaccacccccatgattcaattatttctgtttggccccgcccttgacacgtggggattattacaattcaaggtgagatttgagcgaggacacagccaagccatatctcatatataaaaaatttttatgaaatataaaattattaaatatataaaatatatacatataatatataaaaatatacttattaaatatataaaaatagatacatataaatatataaatatacatgtatatataaaatgttatgtgtgtatatatgtatatgtgtacatacaaatatgtaaatgtaaaaatctaaagaataatttaggttaagcataatgaaattagatgctacttttttaaagtcatattgaaaagatcgtgattatggagcagcaaaaaagttaccctggagtcataagtggttattttccagtttaattaaacatttcttatttcaagtagatacaatgtgctcaaagatacatcaaatatgagattacatactcatagtaataggccaggaggataaatctttttttctccttatttcccactttttgtaaaatgattttgtactattaattactctccatacattattgatacttttagtatttgtggtaagtgaagatacctatctatgaatgcaggataattaataactgaattttccctttaaggaaaaactcatggccttatgagattaattatagattctttgaaaaacgtatgcccttggagttttaaaaatatgcttaaattcataaaaatttacacataactcttcagataactacttgaataagacaagaaatacggatcattataataattttattaatgctttgaaaaaaggtaacttccagaaagaaaagactctcacagaaccatgacttagaattaagtattagacttttgcatcattgcataatattatggaaaggttaacaagtcgttatgtagaagctccagggtttcagagacaaagaagagaatccttccctatgcagtgaaatacactaacccctcatgatgggatttgtaaatctgccaggacgaagctatgtgttctaaaaatagctaaagtctttgagtgtttatttaaaagataactattctcaatggatttttgagtcagttatactgagggatggaaagttcttaaattgctttacaatgtattccagggaaaaaatattgcaattcaaatctctcagagggattccttaatcaactagaatattctggatctcccagttgtcagctactcagcagctggccttatgaaaaaaactagaataaaactggttcatgaatgtgttgcctgggaattttccttttcttgggtcaaaaaacattcctgatcaattacaaataaatctagtctcagaaagttgagctccttttcttaagcatgtgttaagagacatatttttcatatacatttaaaatatactggatgccctgaaaatatgacttgggtttcagcaacaaattctgatttccttgggtcagaaatatgggtctctatcagtcattttctgttttttttttctttttttttttcagattcaattgggcttcacttttttgtaagcaaagatatatagaaagggaaggttgaatgtgttagaattactcatgttctctggtggtacattattgtaacagaagtttattcctccaaactgcttggatgggcacaatttgaacatatgctgaaacagtcctatagacacttgagagttccatacagtttatttgctggtgaaatcatggatggttacacaccgcttcctcattcccttaccttccagatggctctccacacttaccacacatgttgcaggaaacaggttcttgtttatcgtgggtttgctatcaaccaagaaactgatatctaagactgctaaaaaacaaagctagcgtataaagtcttgtataggaaaagtatgttttagaggtaactatgtcctagtattaaatctgagtaggtgagactgaagcttcttaacaatgtatattgtgtatcctctgagtcagcccatagagtctttacatgtactctgaaactagagagggaaaaagccagcaacttccttcctgttctcctttatcaatagtacattttagcctgggagaggaagaataccatcaaaaggaacaattatatgtatgcatagtgtgtgcttgtatatgtgttatatcataggctcgtttcttatattaaacaactcacttattaaaccctgcttattgtaagctctgtaataatacatgtagatatgataataacaataatagaggaatgaaattttccttggaggctttggttaactaaatgtattctcagctgttcttatgaaaaacataaaaatgtgtaagcaatataataattacaaatgccatcaagatggaaattacaattttaaattctgaaaaatatagtctttgctactgaatcacagttttatcaaccatactaaatcattcggtcatcctctacttaataaccaccaccttaaaaattgctgggttcatctcaggaagcataattttgttctagagattcttctctggtcagaaagagagagagggagaggagagagagaaaggagcaaataataaagtgactactactgtccttcctctttaaataacagctcctgggaaggtcagatcctttggctgttttgtcaaagatactcaggaaaagttttcatagagatctctgaactacaggagacttgaaaattaattacatgaaactttatgaattttcattgaagttaaacatcagcacaaccagtattattttcctggagcttttgattagacatttctataccagtttgtctgtcatttcttttttgcagcataaggtttaacagtctaatccctgaattggccagagctgctgcatactcctatgtcaattgtgcactgcacaaccgtagggggtgccattcccactgaatgcatgtgagtagtgtcctctggatttgtcatgtagttaccatgaagttgtcagtctaagcatttttctgtctctaaccttttgttctccatgaagttttgagtgcctttaactattattacattaattataattattgtctaatgtagtgattttccctactaaggtttacatttaggataaatcttcagtcatttcaaaaggattcatatacagtagtgtgtcttcatgtgaaactattgttatttgtgtattgaagcacagtagagaagcccaagaatccagagtattacatacatcagatgaggaaaatgtcaattgtaactcagctagatcttaactttgattggttttgacaaccaaacatagttgattcagtttgtaacttgacaacagaaactgtaggcatttggaaaataatatcaagtcctcttttcaaatctaatacatccttcttgtgtaagaaaatttaattaaattcatttaatcttctgaaaaaaatgctctaaattcatttaagagagttaaaaataaataaatcttttaaaaagcctaagacttgagtgagagaaatgatttgatgttagtctgttagcttcaagaaaaaatgccaagttcttgacctggatagaaggtcctctgtgatgggggctttgcttacctccgtgtcttcacattttatattctccaggccctcagttctgtttcttggaaatatcaggcagttttgggattccatgccttcgcactgctgttcctgccaactgtgatgttctttccctcctcagtcacccaccagctcctcttcatcactcacatccagcactagtgttatccattgcctttccagggaagccttccctgctcttgtccctccatacccctcaccctccaattctcatcaaaaccaaattatctcctgtatagtgccagatctgtagcttatacacaattttattcccatgctcaccaccctgactcactaaatgttaatgatgtgtccctatgtctttttctcatacaaaatcctgctccttcagggtggggactgtgttttagtacagtgctgagatttaggagaaagcagaggattacagaagctctgcaagttgttcaagatgatgcgactaactagtaagccgtggggatggatgcacaccttgatctatgtgacaccaaaacctgtccttaatatccacagtcatgatgtccaaggtcactgtagatgcctgtgtaccaaagcttgttcttcatattgggcgttgtgtccaacgtcaccattggatgcctatgtgtcatttgggaagatgggcgtttctgcagttcttggcagctccgttttctcatggggttgaaattttgtcctgtttttcttacttcaacctctggggagtttcatttttcctggtctactcttaaaaaaaataatttttgtgggtacataggtgtatatatttgtggggtacataagatgttttggtacagacatgcaatgcataataatcacatcatggaaaattggttatccatcccctcaaggatctatcctttgtgttttaaataaaccaattatactcttttagttatttttaaatatacaattaaattattattgactatagtcactctgttgtgctatcaaatgcttggtcttattcattctaacttctttttgtacccattaaccatcctcatctcccctcattccccactacccttcccagcctctagtaaccatccttctactctctatgtccatgagttcaattattttaatttttagctcccacaaataacttagaacatgtaaagtttgtttttctgtgcctggcttatttaagttaacacaatgacctccagttccatccatgttgttgcaaatgacaggatctcaatcttttttatggctgaatagtactccatatgtactatcacattttctttatccattcatctgctgatggacacttaggttgcttccaaatcttggctattatgaatagtgctgcaataaacctgagagtgcaggtaactctttgatatactgatttcctttcttttgaatatatacccagaagtgggattgctggattgtatggtagctctattttcagttttttgaggaagctccaaattgttctccatagtggctgtactaatttacattcctgccaacagtgtatgagggttcccttttctccatatcttcgccagcattttttattgcctgtcttttggatataagtcattttaactggggtgagatgatatctcattgtagttttgttttgcatttctctgatgatcagtgttgttgaatacctttccatatgcctgtttgccatttgtcttcttttgagaaatgtcttttcagatcttttgcccagtttttaatcagattattagagtttttcctacagaattgtttgagctccttatgtattccgattattaatcccttgtcagataggtagtttgcaaatattttcttccattctatagtttgtctcttcacttttgggttgttgcctttgctgtgcagaaactttttaacttgatgtgatttcagttgtccagttttgctttggtttcttgtgcttgtggggtattacttaagacacatttccccagacaaatgttctggagagtttccccaatgttttcttgtagtagtttcatagtttgagggcttatatttaattcattttgatttgatttttgtaaatggtgagagatagggatctagtttcattcttttgaatatggacatccagttttcccagcaccattattgaagagactgtctcttccccattgtatgttcgtggcacctttgtcgaaaatgagtttactgtaggtgtgtagatttgtttctgggttctctattctgttccattggtcgatatgtctgtttttatgccagcaccatccagttttggttattacagctctgtcttataatttgaagaacctggcctactcttttactcagtttcatcttttcctaccagagtattccatcttttcagaatacaggcaggctcccatatgcactggactggcaatttgcttttggctttttctctcaataggaccagtgcccatctttatttttctcctccttctggtggccatcttttgactatcaggcaactggtgactgttctcagggttatttgatataattgcacaggtttctagatcagtgcttcagctccttcaagccatttccctcaattcatgctgtgtacaggcatccatatacatatgtacacagatatcctgagtatacattatatacaatttttagtggccctattctacattctactcttctagtgcccatgtttgattttttgttgttactctagaagaagcacacaaaatgtgctcaagatgtgaactgaattatatgaatttaaatctgtgaaaatattaacaattatcccagtgcaagaagacattggtcactattgcctttggttgctcataagaggataaaaaaaaagacactttaactccctttaggtttattgtctttttctagcatggttcagatattaacaatcaaagtgactgaactttagattttttatatgatcttttcttaaaatctgggtaacttttatctttgagtttcttccttcctttgtgaatcatcaccatcttcatcactgccaatctttaagtatttaccaagaactcatcatatatctagtgccataaatatatgaaaatgcttttagaaaatgctctcctccccggtattcacttatgctccaaattggcaaaccctttggtctcagttacacttttggaataatcctctcatcttgagatcatcattatttctattcaataaactagagaattattgtaaaacaaattgggtataccagaaagaagtgggacattttagagaaaatcagaatattcaccataaagctggaattaagcatatgactgattggaactgaatttgttccagttttaaaatatatttttaaaatgtaaaatacacttaacaacaaataatcacttatagttataaaatatgtattctctctagacagtgttctaagtgttttgtacttattaaatcagtaaattctaatagcaattatgtgatatatgtacacactattatgatatccattttctacaggagaaaaccaagggacagaaaggttagctaatagctaatgagtggcagtgccatgattgaaacccaggcagtgtggacccgcagtccttgtccacagtctgacaagactgccccacctggtccatagctgtttcatatacaatgaatgaaaaagctcaataacaatggtaaatccacacttcataataacaattaaactcctgaacttgtaaatatataaaagcagagagatagatgctcatcttcagtggggagggaagggtttgttattcatgttacaataggcaaactatccctcaattttaaatacagaggattctagtgtggttggctgtagataacaagtccacttgcaacagagattggaacattaggaggggttgactgttatggacttgatggtgtccccttcacaaatttctatgttgaaatcctaaacccccagtatctcaggatatggctgtatttggagatagggcctttaaagaggtaactaaattaaaatgaggtaattggtggggcgggggataatccaatatgatgggtgtcattataagaagacaaaatttagacttagacaggtacagaaggaagaccatgtgaagacatagggaaaagatggccatctatataagccaagcagtgaggtctcagaagaaaccaaccctgccaacaccttgatatgggacttttagcttctagaattgtcagaaataaatttctgttgcttaagctacagagcaaacctcgctccgtaacctgttaggaaccagaccatgcagcaatgagcattgctgcctgagccccgcctcctgtcagatcagcagcagcattagattctcataggaatgggaaaccaattgtgaactgtgcatgtgaggaatctaggttgtttgctccttatgagaacctaactaatgcctgaggatctgaggtggaacagtttcatcctgaaactatgcacccctctccagccccccagtccatggaaaaattgtattccatgaaaccagtacctggtgccaaaaaggttggggaccctggcttaagccaccctgtctgtggtgctttgtcatggcagccctagcagactaatacagggacctaggaggagaaagctaacgtttgagtttcctagtgcaaaactcatcaggacacaaacttaaaactccacaattttctcttgatctttggcagaaaaatgtaatttaattaggatgcatttttatgtaaagtggggtgcccttggccacatgacttgttctttatgtgggcagataggacagtctccttaaccagcgtgattagaatttcactagcttatcgctcaacaaatacacacattgttactccactggcttctgcctttcccagatatacctgtcataatataatgtaattaaaataattataattgtctgaccttgaaattactaattagcatgatggtcagtcctttgataattttctccagaaaagtcttgttaaaatgggcctgcataaaaagctgggggcaatgaactagttataaaaggataggctaatttttggttaagttgactattccttgccagaattaagaagttggaagatgaggtttcttgggggtggttagtcatagtcctgggaaattgggacctaggctgaggggagtaggaattcagtggcactcaattaattttttcattcaaaaaacacaaacaaagcctttgattcaacaaacacaaacaaaatcttgctttggccgggccctgtgctaactcctgggatgcctctatgaacatgatagaagcagctactgcattcagagtttatgttcttatgggagatacagatgttacaaagtacaagccataattagttattttggcttgtactttgtagagaatgaaaaataattttatttaattcattatcttgctgaaggttggcactttttagcccgtgctgtccaatgcagaaagcactagccataggtgtgctattttaagtaatacaaaataattacaattgaataaaattagatattccattcctcaggggcattcgtcacatttcaagtgctcagtagccacatgtggctagtgactaccataatggacaacagagatacagaatgtttctgcactgctgaaagtttcaccagagaatgctatctgggctctagagttgtgccagacctgcaaagtcaagaaagagggcccttagcttaattccttagagaacagaagatatatatatttatatctaccaaaatagtccacttttggctgcaggccatagtataaatctcatcttagtctggccttcaaaatgaagaatgggctggttttaaaccaaggacagatttcctttcctcttagtcttatgagtattggggttttgcattttgtgagtgctcatttttgtatgtatgagcaatttgtccataggaactaggggatttttatattttttccttttatttaaaatatatgactacataaaataaacaacatgtggtttacagatatgaggagtattggaatctgttactttaaaatagtatagcaatgtttggacttttcacagctgaaagaattaaattcagcttcagtaccaccaattcccattttttttcaagtacaagagaaaaaagaagaaaagaatatgtgggtggagaataaggaaatcagctgtgttggtttaatacccttgaaggtgacattagtagaagactttattaaaacatgcaacctgaagctgaggattataaaatataatatgtcatggtgggagatatgctttggctgccacacctaaaggtcactctttgaagggagctgagacagctgccaggatccattgatttctttctagtactaaaacatcctctggcaggtgtcagcctgggtgtgtgaacaaaaaaatatggaaaattaaagagtaagcaaaaatgggccatgggatcctcctagtagaccgagcagaatgctccagtgtttgttctgaacagacgtgtaaatttttgctttagcgacacaacagatacatgaagtgttcaaatattagtcaacatatattttctttagtggaatatagcttctcaagtctctaggataacaaagttttaaaatcctgtctaggtgtatataattctttaatttgtttctagtggggctactccctcaggttaagtaggacactttccctacaatagatttcatttttctttgattagtttccacttactccttctgctcctaacatggccatccctctgcagttctccaaatatcccatgtgtgtgcttgcctctatgtctctgcatacaccatttctcttctgtgcttaccccccaactcctctacaatctagaagactcagccttgagatctttttgaacaagaattgcatttatgatgataaatctgtgcctgtcctacaaaaaaagcccttgtctccttctgaggtgattttgcttagtggctaatcttttcaactttttgtctttaggttttgcagaaaatgagaaaagatggaaagagtgagaggtcacatgatttgctgcctgggctgtggggaccacccaggggctgtgtggagggaaccatccctacgttagcgctgagctcataaccatgacgtcaacctagattccaaatctaggtgctcacattcatttcacaccattagcaagttaaaaatgatagagccaggccaagcgcggtggctcattcctgtaatcccagcactttgggaggttgaagtgggcagatcccttgagctcaggagttccagtccagcctgggtaacctggtgagaccccagctctacaaaaaatacaaaaattagctgggcatggtggcacatatctatagtctcagcttcttgggaggctgaggagagagtcgcttgagtcttggagggtgaggctgcagtgagacatgattgcacctctgcacatcggcctgtgtgacagagtgagaccctgtctcaaacaacaacaacaagatagagccatttactaagcagattggcaggtgagggacgctggttttagctagtacagtgaatgagtgtgtgagtgtgtgtgtgtgtgtgtgtggggggtggtgtattcttagtcccttttacactgacagttgaaaaactgacctttgcccttctctctcccatgttatttctgatgttagtaggcagtttgtagcacagcaggatggaagagttgcaaagggaattgtctatggggtgaaccttttcaattgcccttccatccacataccctctttactgtgaataatcataaatgcataatgataacattttccacatgctaaatcatgctaatgacccctaccaagtagaggaaagaatgttgtcttataataccaacagattatttaaacctgagagctttacatcatgttagattaagttgtgtatattaaaattttccaaacagtaagtataaagatactgtcttatacatataagaggtatggctattttaacatattttttaaattatatgaaataaactttattggacatagttttacgttaccattttttctctctttcaccaaattgtgaaagcaaatagctagatatgctttctccctttgaagaggcatgacagtttcaggttttgctaagaaagatagtttccatctgaaaatgtgtgtacatagtgtttacttctaatttaaatgcctatttacacaggttggggatacaccaatgttttttgatgatgtggtaagttttcaaaatctatttgaggtcatttttatatgcttagaatgacttaggtgcaaatctacatggaagcagaggaataaaccacatggttttagaagccatttctgatcattggagcacaagctttttgtggacagcaggcactccctacctaagtccaaagcaggggagccacctgctggacagtgtgaaaaatcttcattttctggaggtagtcatccctgcttttttacttttaagtttaggtagatttacttacatataaatttatgtactttttattttgctgagtaaatttctcacttcacacaaataaagcggctctaaaataaggagaaaaaaattaggatgctatgaaacacaaatttgaacaacgatcagtactagaagtagaggcttttagtcattccattttgtattttgtctttttcctttcattcgtagttcagcctaactgcatttatattgtaaaccaaaaataaaattctaagccccttaaccgactgaatggacctgtcctatggggacaaggggattccaaaaaattccaaaaagctagttcaggccatgatgggaacctgatggtgtaaccacccagttgggttcacctttcatgctacctagaaagagctgattcatctagacaggggaatcgcaatagagaaagaataattcgcacagagccagctgtgcgggaatctggagttttattattgctccaatctgtctccccaggatcagagtttttaaagacaatttgtgggaggggaggggcagtgagtcagggactgctgattggctgggtcggagatgaaattatggagaggaaatcatggggcgttactgtcttcttgcgcttagtccgttcctgggtgggcatcacaggatcagatgggccaatttcttgatatggtggtgccagttgatccgtcaagtgcagggtctgcaaaacttctcaagtactgatcttaggagcagtttagggagggtcagaatcttgtagcctccagctgcatgactcctaaaccataatttctaatcttgtggctactgttagtagtcaagaaggaggtttattttaggaaagggatgttattgttcttgttttaaaccataaactataagttcttcccaaagttagttcagcctatgcccagcttggaggttagaggcaagatggagtcatttaagttggatctctttcactgtctcagtcataattttgcaaaggcagtttcaatggtaaaagggaattggatacgctgcattatactttcctccctttggaattcaggctgaactgatcggccttaaaattaaaacagagatcttaagacacagtaggctctttgtagcaataagataccaaattccaacctgactccagtatagcatcacatgacagatagcaggccctgagaaaaatcaagtattttaccccaaaatatatttctttgacatatttttaaatggccctgcaaagctatctcttgtgggggaaatttacctcctttagagaagccccttccctttccaggtctttttctgatcctgaagagtttagctgagagtctggtaccttttaaaggtatgaataggaagcatttgccatctattgcctctaaggatggccacctataagacttcatctacataataagaccgttggtctccaacaacaccccttatctttgcccagacactcctttctattgattccaggttttttagataataacttaaacccttcaaccaattgccaatcagaaaaatctttgaatccacctatgacctgtaagtctcctgcttcgagttgttctgcctttccctaccaaaccatgattgatgtcttatgtcctcctaaaatttaaaatatcaaactgtaacccaacctccttggccacatgttctcaggacctcctgaggctgtgtcacaggtcatggtcctcacatttggctcagaataaatctcttcaaatattttacagaatttggcttgcttttttcatcaacaatatgtatacaaacgggcttttctaaaggactttcagccctccttcagctcatctccttcctctttctatctcctcgcctacatagtcaaacttcttaacagggttgtttatacttgccgaatccacttccttacctcccactcacttcttagccaactttaatctttcttcttccccgacactccattaaatcattctcaccaaggtcaccaataaccaccttgtcacaaaatctcatggacacttttccagtttttatcttttttgactagttgggaacattctacgtggctaagcactccctactttttattttttttaatttttttgagacagggtcttgctctgtcacccaggctggactgtggtggcatgatcatggctcactgcagcctcaacctgctgggctcaagcaatcctcctgcttcagcctcccaagtagctgggactacatgcacatgccaccacaccctgctaattttatgttttgtagagatagaatattgtgatatttcccaggctgactccccacttcttgcaacactgcttctcttgatttctgggacaccacccccttctctcttcttcctacatctctgactctttcttcccagaatcgtttgcaggttccctttcctctgctattctgttaaatgctggtatttcttagggttctagcttaggctatcttctcactccaccttctgtccctgggggacacagttcatgcaaagggttttgattatcttcaccatgctgtcaaatctcaagtgtgtatttttggcccaggtgtcactctctttatctcttgatgatccctgctcatcctcccatatagtttatatatcaaattacctcccaggcattgtacctgggaggtcactcagccacagcaaggtcggcatgtctccagctgtgcttatccctatccatatgtcctgcttatcctcagtgacacctctggaattcctgcttgaatgaataaatgacaactcagagttatccaaacctaaatcctgggggttatccttgatccttttcttaactctccacctctaattggttagcaagcaccgttgggtcaacctccttaatacctccctaggaaacttccattcccatagccgtcaccttagttatcttcatttatcacctgagttagtgaaaagtcatttctcctctatccttttcccactccatagcatagagctggagtgatctttttgaatgtaaagctggtcatggccattctcccttcctaaagcccttccagggcttcccacagctccttcttaacttctcttctgaaactcattgtggcctgtcttctcagctcccctccttcccctccagcttcgtctctcattgccttcttcttccatgcactactccagccacatggaactttctccacttcctcagtggcaccagggatgctttcatgctgagtagtcacatggactgtcccttcttccttgaaagtgtgtaaccctgcttgtacccctgctccctgggagcccccatcctgttgttttcacactgcatggggcactgttatctgtacttcaggtgtttgctcaggtacggagtcttcaggatgccttcatggacacctcaccttctcctgcctcccatcttcaacagagttaggtatccctgtacgtattcccacagaactctgctattccactatcatagcactttaattgcttttttatctttcacgagacagtctctattattgtaagcaattaggtgatgaattttaacatagcaattttaacctgagccccaattaataaacagtagacatttagcatatgaggtcaaatcaaagaacgtctcgtcaaatccccatgttttggagaaaaggaaactgctgcccacaggagttagggacatttccaaagtcacaaagtcaattcataacttattaatcattcttcccactgcagacatcagccataacccctattctttctatccttttgactgattctggttttctctgcaagaagcttgaaagccttagccaggacatggtttaaactctattttgccttggttatcaagcaatcaaatggtgtggttaaaattgtagcaagcctgtcatttctcatttaaaataaaacgggactcattcaggcttcttgaagtgagactgcatgtgacgatgcagggaacacatctcctagaaagaagaggagccactgaatgggcagcctcatggaatctcaggctagaagatccttcacatttgaagcaggctttagaggactgtgttatcttttccttttccatttcccctttccttgccttaagagcaagaattgtagattttcactctagtgctgtgggcttacaggggctcagctctgctggtcttttattcctctctatattttctagcacttcattctgttcacaaccaactaagactcttagaatttttcagtttcagtctcagaaagagttaatccaattggtttgtctaattgctgtcattactgcctggcatcaggacatctcataggtcactggtcagctactgattggccacacttgggctgtggtgaatccttggtccaaccagttttggctgtggtggttggttcttaccttttagagcagggccattccaactcaaggtcagcgtggggctgttttctttaccagaggtctgtggacatggacagcattgcataaggcctgacaaacttctggattctctacatggtgatagtttaaagtttctttaaaaatgtgtttttttgggggggggagtccacatattcaaagttctaagaaatctcaactactgacatattaaggaattgaatatgaatgtcctctcccactagatactgatagtttgattttcacagtaagatattctgggaagaaatctggataggaaggattagggaggccttatcatgacactcacaaagttgaatgggtttggtgaatgtatggtgaattttttccaggcatatatacttacaaagttgatttaaaaataagaatgtagattctggatattagccctttgtcagatgagtaggttgcgaaaattttctcccatgttgtaggttgcctgttcactctgatggtagtttcttttgctgtgcagaagctctttagtttaattagaccccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcagatttgtcaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcacaagaacaaaaaaccaaacaccgcatattctcactcataggtgggaattgaacaatgagatcacatggacacatgaaggggaataccacactctggggactgtggtggggtggggggaggggggagggatagcattaggagatatacctaaggctagatgacgagttagtgggtgcagcgcaccagcatggcacatgtatacatatgtaactaacctgcacaatgtgcacatgtaccctaaaacttaaagtataataaaaaaaaaaaacttccaagtaaaagaaatctaaaaaaaaaaaaaaaataagaatgtaagagtgatggtatttgacatttagaagaaatgttttgacaagtgcatgtgatgatttaatggtgcatattccataaagtcaacaggagtgaagctgtggaaatgtttgtctttctgagtgagtggtatttactgctgtgaatttgctgttccatttcccaatacactctccctcactcatgcttttactctaacttcacgtaactgagttgctattttcaatgatgctagtaattaatgtgtgtttggattctggatttttaaaaaagtaataagatgttttgggacaactggggaaatttaatatgtactgtatatcagatgcaattcctgagtgaatgttaatttctttggggttaataagagtattgtagttatacagaatgtcctcattttcatggtctgcacactgaggtatttagggtgaagtatacattgttggatagatggggataggtaagttgatcaagccaacacgacacaatctgaaaaattgggaaatatggatgctactcattcaacttttgtgtagggttgaaaaatctttaaataatataaaaagttggaggaaaaagtgtaactagtagtctgttggtgtagatggcttgagtctgagatctgaaattggagccagtctcagattagagaaaataggtcttgactttccttgcagtaacattaatctggtgtttaaatgaatgctttgctgaatctggggcaccgagagtgaatatctcattaatgaccaaatctccaaaccagtcattgtggaggaagctgagttggccacatccttgatttaactaagaagtagcatgttttattttatagctgccttagcctcattcattaaaacctgactcattgggcggagggtggaagaagttgcccctttagaaatatcttgctaataactctttggccacttcagctaacacagaacctggaactcatgccagcatagaagggtggctacaaggctatgggatgggccagccgtacacatgccatgattcactctcaaagaggacaatttcagcctctttaaaagcattatgatttagcagagaataaagaataaatgtccttggtaaaaggacatatctagaccagatgtagtacaactgtcattggctgtagggaatgccatgcacgtagaaggcagggtgaattgtgcccttggaattgtgtaacacgggacagatgtcatgaaaaacaatttacttgctgaaatccagcactgtggaggtggtgaagcagctgaagccatttttgtgatcagttcactctatggtatactgttgttattgtatttgcacttttgttctggcatgtttgcagaattactttttggacggatcaagtaaccaataatttgagcaacaatttaacagtaactttttagagtgaaaccttaccaaccaaataccagaatgtatttaaaaaatattttgctaatatttgtaactatcttgatagcctttgctctggggtttgggccatcctctgtctctcaagctgttataaatgatattttttgaaatgggaatagcatgagttggtcaggtagagatttctatagaagctccttctgtattcggcttatgacactcatggcggtagtatgaattcagatctcagggtcatttattatccatggaaagttaatttgagatgttggaacttttaaacagtgtttgtttattgtgctaatcacgatctgttactaaatttcatttgaaatgcaattaattaccttcatcaccttgctaaagattgacattaatattctgtcctatcctattagttctgttgacacagagggagatgatcacaataatgggaaggaaagagcagagagcaagggaataaacaagcagtgactgctattattttattgaatggttcttttgtcaaaatgactgcaagaaaattcttagaataccagtatcatcacacaaacctaaattcataaggcttcctgcagttgaatcatatttttaaagtttagcttggggttttctattattcagctcactggtgttgaagcaattttgttgacattttctgtaagtggattaggcttgcagtcatttgcccaaagcagacagatggcttcttaaacagagcacccccgtaggaacctatcttatggtatcttcagaaataaaacaggtctgtcacaaaagataatgtttggcattaatttcttttagtgacaaatgatttcagctcatttttactttctctgctggcttaaatgaaacagctgttttacattttttattccaatagtgagcaacgctttggtgtttgacactgaacaatgttgtagcctctaaattatgagtaagaaaataagcttttgagaggggaggatgatgccttttgggatcccccaaggaaagttgccacattaatgcaattgtcatttttattttaaacatggggtctttttttggactaatgagtaatgcaatcctggcttttattgtcgcattttattctctccactttgtcaacttgtctttttaagtttcaagatgtttttgtttcctcacatttttatgaggcaaaggacagtggacttatctacaacattgttatttctgtttatataatagaataataattgctaacgatcattagagttttccatgtatggcaggcattgttctaaagaatttagaggtattatctctcttaatctcacaaaaaatctatgaggtgagtacaattattatagccattttatggatgaggaaactgaggcacccagtgatcttgcccaaggtcaaaaagctagtaagtcttggagccaggatttgagcccaggtacagtaagagtggagcttatgctgtaaattcacttataagaatggcaatatggttacgattcaaagtctctagtctagagactagagactagtctagattgttattctaagagagaaatgaggaatccttagaatcagatttattccttcatcactcctggggttccactcgtcagctagtgtgttctgccatcttgggcagccagcttatgtggaaggcttgtgggggctcatgggtgctgcaaggagaaatcagtacaggggccctgagaattgactgatgaggcctcacattagtagcatccttcaaaacgttcagtggatgcctgtcatgaatatgattcattaataatcttctttttggatctgagccatcagggcttatgacgatacctttgaagtgaaaaccagtccttttttccagcacttatcccactcatgaatcctctatcattgcttttgtatttcagttttccgaaaatctggctcagattaaaattattaaatgcttccaaaccctgtacccacactgaagacaaaagttagaaatcaaaatatcagcacaaggatagtatttatgtctgggacatttgtgaagttctatcaagaaattcttttataaaccaaagaagtcttaagctagtttttcttttctatttgatcaaatagatctatttgatgacatgtgcaccatatcatgtaatgtacctaaattaaataaaaaaacacaaaaaaacaaataaacaatatagagattaagaaaaacaactcttggcctgggaagccggcattattcatttccttcacacttatttctcgtgtgaacctgggcaatgtatttttttagctttcctgtgtccatttattcacctgaaggttataaaaggagtccttcgaatggctcgaaaatttgaaataattactaagaacggttatttagcagatctcagtgatactgtcactaaatgacactttattgttttccactttcagtgtttctttcagtataaatgtcaatgaaacaaaataaatcctaaatagagaaaacgtaaggaaaaatggaatgtattaggcaatttggtgctgtgccataaaggcggtaaccttccagaacactctcccataccatgtatatctgtatctgtaagactggaggaggattcttgcctctcctccaggcaagcataaaaaaatccttgtactgtgtttcactgatcataagatgccaagaaataaatgaagatgcctgctcatcttgcaaatcattgctttcttgttactttttatggggaggcttgtctaatctcctagtcctcacagcaatacattcttttccctcaagtacttagcataatttaaggttagatataactttatttttgtggttattttatatatacctgtatcccacactagaaataggttccgtaggggcagggatgatgtctgtgctcacttttgtaacccccagagtccagcctggtgattctcaatgggtgcagtactgccccctaggctgtgttctgggaagttgtagaggtgattgggaggattctcctggcatttagtggaaacagacaggaatatttgatgtcatgctctgggcagggcagtacaacatgatgaaaaatgtcctgtgtcctgcaagatttctgttaagtcctgcctgagtaaaccctctgtattagtcagttgtcatactgctataaagaactacgtgaaactgggtaatttataaagaaaagaggtttttttgttttgttttgttttgttttctcagtccttcacgctgtacaggaggcatggctggggaggcctcagtgaacttacagtcatggcataaggcaaaagggaagcaagcacatcttcacatggtggcaggaaagagaaacagctaaggggaagtgttacacactttcaaacaaccagatctcctgagaacttactatcacaagaacaacaaggaggaaatctgcccctttgatccattcacctcccaccaaatcccctcctgcaacaccagggtttacaattcaacatgagatttgggtggggacacagagccaaaccatatcaccctctaaaatacaaatcagaatactttagtatatgatattaattaattattattattttttacaagaagttgtttgaaggccagtacttgagtaaaaggtagttattgagaggtaagtctaaatgaaataaagacattgtttccaaattattgaataatttactcaccttgggtattttgtccacttgaccatataattgctacacagtaatattggaacaaattgggcagtcagataatggttttaacctgataccttattttttattattgataatccatggtgggcatccgcctgggccccacaaagtatcagctggtattatcaatcacaagaacaatgacctttggagtacttttaaagatttggcagttttgctgggcgtggtggctcacacctgtaatcccagaactttgggaggccaaggcaggtggatcacctgaggtcaggagtttgagaccagcctgactaacatggagaaactccatctctactaaaaatacaaaatcaactgggtctggtggcctgtacctgtaatcccagctactcaggaggctgaggcaggagaatcgcttgaacccaggatgtggaggttgctgtgagccaagatcgcaccattgcactccagcctgggcaacaagagcaaaactccgtctcaaaataaaaaaaaaaagatttggcagttttgatgtggtgtatggacattatttacttcctcatttatgggattatcagctttttctttccacagtgagggtttgtatttgtcttggcatgttatgccgaccttaattgaggttgtttctttccttcttttattctatgcaaatacaactagtctattgccattatttgttttcatactagtgtctgtctctacatttgcattatcattttccattaaatatgtattttttgagtggaatggcatctgatcttatttctctttcatatctaattgcattcatattaagtacaggcatctgcctacttcaggtttctggtgtgcctgcctgacattcacatatggcaatacatgttattttattttaaatgaccattccctttttctcctttatattacagctagggtattatatttattttaataatacatgaataggttatattatctatgaatttaagtttatgaaaataaagaaagccttacaaagtatttgtttcaaagggttggttttgatagattgagaacctcaggccaaagtctggtatacagtaattgtttaataaatatttgtttgctggataagtgaataaaatgaaaactaaggtgcaagtcctcattaatagctaagagaccaccattgtttccaaagcacagggaagagatgggtgtatctcagttcacatatacatagctttgaacaaggtataacagggacaataaatgagaatttgaaacattaaatttcatacttttttttttttccccgagatggagtcatgctctgtcacccaggctggagggcagtggtgcgatcttggctcaatgcagcctccacctcctgggttcaagcaattttcctgcctcagcctcctgagtagctgggattacaggtgcctaacaacacacccagctaatttttgttcttttagtagagacggagtttcaccatgttggccgcgcctggcccatacttcttttttaagctctggtcaacaagtgcatctcaatgcagtgggttttattgagtgatacagatgttttccaccagtaacaggacctattgtcagcattgttgccactggattattaatggttttttaaattatattattattagtgagtagtgtttaaataatgttgaaagacttcacttatatgtagaattctatatatacaagaacataaaattgtctccttatattaaaactattttaaaaaacatggctaatacaaaggttttctgcttaaaatgcagttaattactattttgaagtaactagggtccttcatttcttcaacattcaagttaaccaagacttcttgataaataaagctattgtaacaaagaaagcttgataggaaagctattgtaacaatgcaggtgttatttgagaaagaaatgtggtaaaagaagatctttcaaatttctttcaaatttaattttcattatgttgaattttaacagagtatgatttcaaaattttctgagcctttcatatggcttattaaacatgtcatctgctgcattttacaattttctgtggaccctttggcattaaattattcttaacatttctttaaagtgtcttctatactttataaattattttttcttgagaattagattctcaggaactaaaaagatttatttatattcagtttccatagttttcagaagtattcaattaatcagagtttgtgaccaatcctaaaatacatcctttatgtaactaattaaaaaattaactttatatacagttacaaaatctaatgtctcaggtgagcatgtccagtgtaattctcttcatgttcctgtacagattatttttattgcattatataataaagatttgaaaagcagagtttcatttgttttgggtttagagtttcagaagaataacagataaagcttcattcagccaagactgttagaacagaactactctacgactattcatccatatttcttgagtgttcatggagtaaaaatttaactttttaaatagcaagtagaatgcagttgaaatatttggttgctgaggtgttgcaaaacagtaaatctgagcattgataacttagtgcagtggacacttctatttttgtgcaaaattaagttatattatatgcaatttcctaatagctgcacctttgtgccttttaactcttgttaacatcttgtatataattcctacacagataggccttcattctagagagcaagaattccaggccatctttgaatagtttcacccagttttccaaacagcgtaacataccaagagtgtaacatcaaaaaaaaaaaaaaaaaagtctaacatgacatcaaaacatttttgatttgttgttttaatttctcaaatgaaggacattgtagcagttgttttacctcttcagagcaaaggattaaacttcttaaatgatagagtcccaacggatggtttttgaattagtaagatggcagttgtgcacagccctccacagtatggtccatcaatggaccaaataaataactactcatcccactatgatgtctgtgactggtttctactgcagcactgtccaagggtgattctactgtgggtatggactctcccatggataaaagaatatcagaaaacccagtctgctgatgagtgtgggctcaaaaatactcacacgagttgacttggagacagagctgcatttgtttatgtgtgtagttttgtatatgtgagggttttcctattcccagagtcccaattagctgctttaaatatttgtggtgtgctctgaaacaacccactcatttcctttacacttgatgagaacactagttatgatgttctcctgctcttttgtgtactaatatcacaagggatagtgcggttcatgggaaaagtgggtgtgaaggagcctgggatgtcttttgtgaataattctgccagactgtagtcaaaaccattttcattggtggggggaggactgcatttttttggtaaaaatggaagtaacagaaatcctaaatatcttttgatgggttataagatatattactaaaagataatttatatttagaattctaccctattttatggttaggatataatgagatgtatttgaactggtttacgtttagtatattaagtgttcagtaaatgttagctgctgtttagtgttgtgacaatatttcttgtcagtagtaaatttattagtagtaatcaaaattgtggtgatatatcaccacagcaatgcacggcagcccaatttgcaatctaaattgcatcagttatttcctgatttctagataatgtactttaattataatttaatgcagttggaaagatttaataaggaatgcttaatgtttgttttttaaatattcactaattatcactcatttttaaattcagaatttctataatgatctctgtggctttgcatgagtccatgttactttctaaatgtgttggacctgccagtggaaccttacattcagaagccaaatcactgtggaggctaaatggtggccattgctcttgggacttctattagtcttgttgtcccatcagcatcagtctacctgaggcgctctctattaccctcactttcctttgagttaaagcatccttctcttttttttttttcatgaaggatccccagtaccagaggatacttcaaatccccatgagattgctagtatagaaatgccggcagcagcttgacatttttttttcaagttgagtgttcagtggtcaacttgtacattaattctgcatttcatgccataacaatcctaaacttattttagtatacaagaggtgtttccatttctatatcaccaaataaaatgaattctcctggggttcctcctcttcccttaagacctctgtttagggagaataagattaaaacactttcttaagaatgacttgttaggttactctttaaatatatactatagacgaatacctttaaatggcttggctgacctgaataccatggtgggtgtcggggggtggtttttgggatgaaactggatcaacctcagatcaacaggcattagattctcataaggaatacacaacctagatcccttgcaggctcagttcacaatagggttcacactcctgagaatctaatgtcgctgctgatgtgacaggagtgggagctcaggcagtaatgctcactcacccactgctcacgtcctgctgtgcagcctggtttctcacaggtcacagggactggtatcagtccatggccccagggttggggacacctgctgtacctaatatattttggaggaaatgatacacaggacaaagacgtttagagggagatctggtataagctggctggttaagagaagtttgggggtgtttgtgacagagtagagagaaagagattgctagatgattagggaaaattgctgcatataaaatgggaaaaaagtcagcatgccaagggaaaatgccagggtggtggttgttaacaatcaaattcaccttctacaattttcaccagaatgtgtcttttctgattctggtgccttgattcggaagacccaaagaagagatgcaggttgtgattcctggaaccacagaacagaaagatgactgctattcctccttcataaaaaaagagaaaacagaagtttatatcatgtttcaatgtacactcttcacaacacagcctttcagttttgcttcttttattagttaatagtttacctattttttttttttcttgcctatatggtacagccagtgtgtgttgtctccagggttatcaggagatgatgtagttgtgttagttatgcactggtacaaactgtttcctcccattggccattgttttctacagagactgacttctatttaccagaaatggcacagtctggcatttggatgccacctcttagaaccaatgagatgacattctggattattaaaatatgtttcatgccatgctgtgggaaaaggggatgtgagaattttatgcgttagtaggataaaatgatgtttttgtacgtttcactgttctcttgcaattaggaaagttgccagttttgctactgctatgcttttaaaattcttgatgaaactttcaaaactaaatgaaaagggaacacttaaaagtaatactctgaaaatgaaggaggatatagtctcattactaatagattttttataaatggaaagattcctttaaaaatatagtagtacatatacattatacatatctctgtaaaacagactctggtagatgcattttaaatgttagtcaaatttttaataaaatatagatagtaccaagatacttattatatatagtagcagataatgttaaccactttctaaatcaccttatatcattgtgattcctatacttatgatcatttaaatcataaagagctcttcaacatattgtctttaatcttagaactgtaaggaaggctgaaggatattttcatcatttttgcagaagagaaaatggcccagataaaaattggttgaagatgctccaaccctcgtccctgctagtgtgttcttgctctgccctgtcttcctgattctggatgctatctctaaattgtgtcaggctgtgtcacatgggcaatgcttttctttttatctgcgttgcttccatgggtaacaatgaataggagtctctagggtgccctgcagagagtgcctgctttgctgttaaaagatgcctatcaggtagtggttaaaaccacagaccccggagccagctgctggattttaagctccagctctaccacttagcagctgtatgactttgggaagggtgactgtgctctgggcctcagtttttttaatcagtaaattgagaataatgaaagtacccatctcatagggatgttgtaatgaatgattgaatgaacatgtataaagcacaaagagtgaccacactgagcaagcacttcatatgttggtctgttattattattactgaagagttgcacttttcaaagtggatgtgacttcacttttttttttaaatttatgttctgggatacatgtgcagaatgtgcagttttgttgagcagactcattcgtgatgtctatagtgttaagaacagacttcccaaagtctgctggtgtagtaaatattttttctttagaaaatacatctctcactgacagagtctttaggctctaatctctagtctttagtctcagactagattgtaaacatggtgtggggaatagagcattgatgcaggaggccaaaggcctgaactttagtcccagctcagcgattaaccagctgtgaccttgggacagtcaattaacctcatcaggctcagcttcatttctcctcaggagaaggcaaaactgtccacctccaactcttcttccaaaatcccataccataattgatgtacttgagaagaagttcgctttaacacaaacatcaggcaaagcccaactatttaatcatcccatataattaaaagctgctattagaaggatttagctattttttacagaggatagaattggcaagtgcatatttaggttttgagaaataaaatattccaagcttttgtaaaatacaagtttcttcatacaccctaaggaaaaagcatttactggcctttcataaaataggtaaattatcctttctctgagcctctgctttgtagaataatgctccagcaatcgtcataaccccatatccacccatattgtcctttcaaggtcacactttcaggcactgccatgagaatggagaggagagggaagaagctacttcttcctctgtctatgggccatagacacctgtccctgcttccccacactcagtcattcagcccttgggccagtatcagtatacgcactttatcttcataacagtgaactaaaataagaaataaaaatagcaggaaaagatctctgttgggcactgatgtaaatgacagctaatgtgttcctgcaatcctcatttcctttttgttttgcctctggagactctttttctccatctgccaggtgggaacatcatcttcaggatgatggaaaaggcagaagtaatgtgggtgactgataatttaacaacaggcagattgcaaggatgacccagtatattaaaaaccagctcaccaagcataagggtatgtgacttactttacagaagacactttgctttgtaagctcttgtacagagggggagattttattttcacttctttaaggaagagcttctttccttgttttctcccaagactaggaatgctggatctgggcggggtaggtattgcagcagtgtgcagagtctcagaccatggtgatggaagagttgatgtcctcagcacataaagaggaggattcctcacaataggaatctcaacggactgccagcaattgcatagccagctggtcaggctcaggttgaggtacttggcttaacaagcaaagtcacttaataatgttagaaaagaaccttgggttaaaccctggaaaagtgagcttgcaggtctgggtctgtttccttattcagcaatgggcagtaagaacatagagtgatgtcactcagcacatgcctggcccataactgtcttctttgatgcctgtttttttctgtttgtagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaaaaacacttattgttttcttttattgtgaattgaaaaagcaaagctaatgaaaatgggttactacatcaaaaatatcttaaagagtttgctatttccatggaccagatatgatgaaattattccctgggtttaaaactgggcactcgaggaggaggtacctgaagtcatttgaaggcaagtttccaatgatgctacaatggcctgaaaaaatttctttaccctctgttatatttaacttgctggtaggaggaatagtggaatgcaggtgttaagccctttgtggtgaaaaagaggttctatagacagaaacaaaacccaccttacatcagctgattggttgattttactagtgtacctcttcatctacttgaattctatttggtaaatccatgtctttactggatatacagttaggtgggaagaggagataaaggatgacaaactctcaaacaatatttatacatttatttactccagggtcaaatccaatccttggaagtagcttctctagtttattttatttgtcccagagctctactcacacttaggacccacccaaaaattctcaaaaacgtaatatggattctgcctcatctgatgctatttctggcagtgggttgtcagccatactctgcttcattccactgggtgtccttgctagatggggagtgagatgtggagcagggaggagctttggattctgggagtggaggtggcaagggaaaagtctcctagtctcctgtgatgttcctgcctccagatagaatagcaaaaacaaacaatttttttttgtgtattatgcctccatgacattgttacattctatgaggagcatctgtctcctttctagacttgaactgtggtagaaaaagcccccttctctcttctatctacttagatttggtgatgctaggaatgtagtgttttagatattaattctatttttatttattcatttttacatcaccaataggatctgaggtggagatggcgggtattatcactggcattttacaggtgagaaagcccaaagccactgaggtaattaatggaataattgattttgaacttgggtctgtctgatttcatgtgcaagattatatacttagtgattttgattttaagtttattcttaacattttaaaccagactattaactcttacctttataaccacagatacaaagaactgtatcatttattttctgaatataaaatattaatggtcaatataaaaatacaaaaatagagaactatatacaacagaaaagcaaaattacccactaataacattttgatttatatccctttagacactgtttagagtttatacatatatgtaaatatgcttgtattttaacaaaattgagatattatataaactgtttgtagcagggtgtttaaaattttaacaatatgttatggatatctttctgtgtcaataaatgtgtatttacattagagttccaagcatttgaactgaa

SEQ ID NO: 2020 - DNA, 236210 bp, Homo sapiens
ccccctaggggcccctgggacgaggaggaagcgccaggtccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcaggtgagtgtcgggtctggccctggcccaggtctccagcggctgtggccccgacccaggggcggagcgcccgggaccgccgtggggagcggggcgcggggctgcgagtgtttggtgccaactcattaggggggccgggcggtgtgtcgggaaacgcgggcttgggcactgcggccgggagcgctggcggagaacgggggatccagtacccgaccgggcccgcagcgcaggtgggcgtgggcatctccaatgggcgcctagcggcatggaccgcacgcccggctccacgtgcgcagccggccgccggctctgatgcaatcgcgccgggcgcgacccagacggtaaaggggcggtgcggctggggcggaaaccaggggagggggcgaggagcaggaggagggcggggctgcggctcggcgcgccggctggcccggggttcgggaagggcaagcggagctcgggagaggcgggctcgggcccagcgccgcccgcgcgaagctccctggtgttgtgcgcccttccccgcgcgcggcccctcctgctgggctggggtctgtggctgacgtccgcttttcccggaacggcaaaggtggagccgggcccccgggacagccgccggggggaatccgagaggtctcagcgctggtttccagcttcgccgcgcagcgcccacggagtccccgcgcagctgggtttgcagggttttctgcgggcccagagcgaactgggagccccgggcccggcctttcccgtcccggtccccgcccctgggctccagccttccccgccctcgcccagaggggcgcacgggtctcgggccttgcagggcgagcccttcgggacaacttgggggtggcaagaaagccccttccgcctccctcggaactgggattaggaacgagttccaggatgcggtttccccggccagcggaccacctcctccattcacatcctcttccctttccttctagccttctttcttagtcattgcctgcttgcctttctctctgcctttccttcctccctctgctctcccattttcctccccactccccttctcccatctcagtaaaatacgtttcctaggctctttattatgtggcggatgattttaaggggccatttatttagtttttcttgttctctgtcttctttttcttttagaaatggagtctcgctttgttgctcaggctggagttcagtggtgccatctcggctcaatgcagcctccgcctcctgggctcaagcgattctcccgccttagcctccagtgtaactgggaccacaggtgtgcgctaccatgcccggattattttattttattttcatagagacagagcaccactctgttaccaggctggtctggaactcctgggcgcaagccatcatccctgcccccaaaagcgctgggattaattacacgtcaggtcattaggttttaacctgcacgttgctgagactcatcttaccggttagagtctgaagccaggataggcggcaaaaaaacttctcccgtcatgctgttttattttctaggtaaactgattattacctgaaacttccttctttgctcatttcttgtctgtctcacccacctggaatatgagcttcatgagacagccgtctcttcggtgctatatcctaggtcctggagagagtgcccagcatgtaataagcacttgtgaaatggttacagaaggaatgcttcaagatttggggtcatctgtgggttttattcatacatattctttttttttttttttttttttgagacggagtcttgctctgtcactcaggctggagtgcaatggcacgatcttggctccctgcaacctctgcctcccaggttcaggcgattcccctgcctcagcctcccgagtagctgggattacaggagcacgccaccacgcccggctaatttttgtattttgagtaaagacaggatgtctcaccatgttggccaggctggtcttgaactcctgacctcaggtgatccgactgccttggcctcccaaagtgttgggattacaggcgtgacccaccgcgcctgggctattcatgcatacttttaggtttaaagccatgactgccttagagatgagtaaagaggttagtagggggctttagggcctgcactgggttctccaaactcaattccttcaggaaaatgggaggagtaacagtacttacctcaaggggttatggaaacaattatgtgagaggacacatgcaaaatacatagcccaggactgtcacatacaagacaagtccctcaacaaatggtggctattaattttttttttttttttttgagacggaatctcactctgtcgcacaggttggagtgcagtggcgggatctcggctcactgcaacctccgcctcccgggttcaagcgattcccctgcctcagcctcctgagtagctgggattacaggctcgcactaccacgcctggcttattttgtgtttttagtagagacggggtttcaccatgttggccaggctggtctcaaactcctgacctcgtgatctgcctgcctcagcctcccaaagtgctgggattacaggtgtgagctaccatgcccagcaatatttttacaattcactaagccaggggtccacagacgttttatatataatgggccagatagtaaatattttaggtttagtgatcctagaggcaaatcaaaattattagtaggtacatttataacaagagaaaagacaaatttaggccaggcaccatggttcatgcctgtaatcccagcactttgagaggccaaagtgggatgatcacattcccaggagttcaagaccagcctgggcaacatagtgagacacccatctctgtaaaaaattttaaaaaattaactgggcgtggcgcgtgcctgtagttccagctactcagaaggctgaggcaggaggatcacttgagcccaggaggtcaaggctacagtgagcggagattgcgctactgcactgcagcctgggcaatggagtgagaccttattttttatttttgcaattaagtatttttaattaaggtatgtacattttttagacaatgcttttgcacacttaatagatggcagtatagggtaaccataacttttatttttattttctattttactttaagttctgggaaacgtgccgaacgtgcaggtttgttacataggtatacatgcgccatggtggtttgctgcacccatcaacccgtcatctaggttttaagccccacatgcattaggtatttgtcctaatgctctccctcctcttgccctcccaccccctgacagaccctggtgtgtgatgttcccctccctgggtccacgtgttcttattgttcaactcccacttatgagtgagaacatggggtgtttggtttctgttcctgtgttggtttgctgaggatgatggtttccagcttcttccatgtccctgcagaggacatgaactcatgctttcttatggctgcaattttatttttgtagagatgaagtctcactatgttggccaggctggtctcaaactcctgggttcaagtgatcctgctgcctcagcctcccaaagtgctgagattgcaggcatgagccaccacgcctggctatattgtacctttcaattgagttatgtgcatggtttactgaaactctagccctgaattgattctccgaggattggagcaaagtgggtgggggtgtgtgtcagctagaagtcacctggaatagacatccaggagcggaagtgtattagtcagaaaaattaaagaatgagctccctcaaaagcatagtgacctgttgttcctggtgatgggactagatgaccataatccctcagcctcccaagtagctgggattacaggcaggcaccaccacacccagctaatttttgtatttttagtagagacggggtttcaccatgttggccaggctagtcttgaactcctgacctcaaatgatccacccgccttggcctcccaaagtgttgggattacaggcatgagccactgcccctggccagtaataatacattctgtataatagtcacagtaatggtgaaaataacaaagctgctgctgatggcttagttctgagttttagctacacatggcaacctagctagagagctcacattccttcccactgtcctcaaccaaagtggaagctcacaaggccatttttctgccccaaggacatgaaaatctctgattagaaacatttatgctactttttggatttattgagcctaatgactcctttttctttcttgctttgtcactgtaggaatgagtaaccccaaaaaatgaaacattacacatataacaagttgtagggagcatgaacctattttgttttattagcttgggtggtagtagcgttgaactcctttacatacctgtacaggcacccctaagatattgtgggttcagttgcagaccactgcaataaggggaatatcgcagtaaaacgagtcacacaaattttgtagtttcccagtgcatataaaagttatgtttagacaatactgtagcctattaagtatgcactagcgttttgtctaaaaaaaaacccatatataaggccgggcgtggtagctcatgactgtaatcccagcactttgggaggctgaagtgggtggatcacgaggtcaggagttcgagaccagcctggccaacatagtaaaaccctgtctctactaaaaatacaaaaattagccaggcatggtggtgtgcgcctgtagtcctggccacttgggaggctgaggcaggagaatcgctttaacccgggaggtggaggttgtggggaggcggaggttgtggtaagccactacactccagcctgggaaacagagcgagactccgtctcaaaacaaaacaaaacaaaaaaacccaaaaaacatatatatatatattatatatataaaatatatataatataatataccttaattataatataatataattatatataccttaatttatatatataccttataatatatataccttaatatatataccttaattatatatatacacaccttaatatatatataatatatattaatatatatcttaatatatatatataaggtaatatatatatacaccttaataataatatatataccttaattttaaaatactttattaccaagaaatgccagtgatctggtggaggatttgcctagatgttgatggttattgactgatcagggtgattgctaaagattagggtggctgtggcagttttttaaagtaagacaatgaggtttgctgtattgatggaactcttcctttcctggaagatttctctgtagcagtgctacagagaaaatggtaacattttacccacagtagtaggacttctttcaaaatgggcgtcaatcctctcaaaccctgcaactgctttaccaagtacttgatatcaactactgtaatcttttttttttttttttttttttttgagatggaatcttgctctgtcgcccaggctggactgcagtgctgcgatctcggctcgctggaacctccgcctctcaggttcaagtgattctcctgcctcagcctcctgagtagctgagactacaggcgcctgccaccacgcctggctaatttttttgtatttttagtagaaacggggtttcaccatattggccaggctggtctcgaactcctgaccttgtgatccgcccacttcggcctcccaaactgctgggattacaggtgtgagccactgtgcctgcctaactactgtaatcttataaatcctttgttgtcattttattttattttaattttattttattttattttaatttaattttattttattttattttttgagacagtctcactctttcacccaggctggagtgcagtggcgcgatctctgctcactgcaacctctgcctcccgggttcaataaattctcctgcttcagcctcccgagtagctgggattataggcgtgcaccaccatgccctgctaatttttttatttttagtagagacggggtttcactatgttggccaggctggtctccaactcctgacctcgtgatccgcccgcctcggcctcccaaagtgctgggattacaggtgtgagccactgcgcccggcctaataaggctgttttcttatcatttgtgtatccacgggagtagcacttttaaatttcttcaatagcttttcctttgcattcacagcttggctaactgtttggctcaagaggcctagcttttgacctatcttggctttcaatacaccctcctcactaagtttaattatttctcggtttttatttaaagtgagagacctgcaactcttcacttgaacacttagaggccactgtagttactaattgtcctaatttcaatattgttgtttctcagggaatagggaagccagaggagagggagagagaagggggaacagccagtccagtgaagcagtgagaacacacaccatcatgaaccatcatggccacggtttggccaacacaattacaacagtaacatcaaagatcgtcaatcacacatcaccagaacaaacatactaaaaatgaaaaagtttgaaatattgtaagaattatcaaaatgtgacacaaattgagcagatgccattggaaaaatgactcccatagacttaaaacacaggttgccacaaactttcaatttgtagaaaaacacagtatctgtaaattgcagtaaagcaaagcacaaaaaatgatgtatgcctgtatttttttttctatccacatccaccccccaactttttttttttttttggtagagaccaggtcttgctatcttgcccaggctggccttgaactcctgagctcaagtgatcctctcacctcagcctcccaaagtgctgggattacaggcatgagccactgcgcccagcccccatccccaactattttaaaagtctaattactttttgacgattgccgacttacctatagaagtgttcctttcagcccggcgaggtggctcacccctgtaattccagcactttgggaggcctaggtgggcggatcacgaggtcaagagatcgagaccaccctggccaacttggtgaaatcctgtctctactaaaaatacaaaaattagtgggacgtggtggcatgcaccagtagtcccagctactcaggagactgaggcaggagaatcgcttgaacctgggagatggaggttgcagtgagccgagatcgtgccactgccctccagcctggaaacaaagtgagactccgtctcaaaaaaataaaaagaagtgttcctttcatcaactatgaatggatcaagactatgaatgtttctgagaaaattattgctgttagtaagaatgtttttagtgtttaagggtagctttggggcacagaaaaaaacaaacgtacatttataagaaaaaggggaaagagccactgtagtatacctgttttacagatgaggaatctgagactcttagagacttgtccacgctagtaaatgaaatgcccagtaccaatcctgggccgtatttccacttagtgtctcagaattacctggactctgttaaaaatgcacatttctgggctccactgagacacgttgaatcagactttctagggctggaactgttattttttttgagacagagtctcgctctgtcacccagctggagtgcagtggcatgattttggctcactgcagcctctgcctcctgggttcaagtgattctcctgcctcagcctcctgagtagctctgggattacaggtgtgcaccaccatgcctggctaatttttgtatttttactagagatggggtttcaccatgttggccaggatggtctcaaactcctgacctcaagtgatccatttcaccttggcctcccgaagtactgggattataggtgtgagccactgcacctggcctggaacctttacttttaccaaactctccagtgatccttataccatgaaccgcttgggtcccacactccggtgctttcctggacccagacaaaaataagaacccagcatagccaaattaacagtcacgacaggctggaaagagtgcggtatatgggcctcagtcacccattattggatggatggattttagtgcttatttataaggtgatttgtaaactttcccatatggtcacatttattcagcacaataatacaattaattccctgggaatgaagtagctttatcccaagtgtttccaaacaaaactaactgaaatgttcccaggttatagacagttgcctgcacccagtccatctgttccggcccagctggcagtagaaagactggtcctggttgtgaatctgagcagctctctcccctaaagccccgcctgggaactgcagtgcctctggttccatttgtcagctgtgtctctctgaaaactggggaaagcttcccgatgcctttctgctcttggcagtgtaccgttgatggcattggctggaacttcttcaccccgcatttttgttaggtgcagtgcaagaccctgtcggagactgaaaacaaaatgtaaaggtggtcttagcactgaagcctgggggctcctgtggctgcgcctttggtctattgtgagagggggaaaagccagctcccagtgctcatgtgctgctgagaacatatcatagggtggtggcgaaggtagcctctgcagtcactcatcccagaaggttccataaagagctgagctcctaacacttttttttttttttgagacggagtcttgctgtgttgcccaggctggagtgcggtggcacaatctcggctcactgcaacctctgcctcccaggttcaagagattctcccgagtagctcagattataggcgcctgccaccacacccagctaatttttgtatttctggtagagacggggtttcaccatattggccacggtggtcttgaactcctgaccttgtgatccacccgcctcagcttcccaaagtgctgggattacaggcgtgagccaccgctcctggactttttttttttttctttttttaaaaagaaattgagtcttgctctgccacccaggctggagtgcagtggtgcagtcatagcttactacagcctcaaactcatgggctcaagcggtcctccagcttcagcctcccaagtatctgggactacagtcacgtgccatcacgcccagctaaattgtttatagagatgggatctcgttatgttacccaggctggtctcaaactcctggtctcaagcagtcctaccgccttggcctctcaaagtgctgggactacaggtgcatgccaccatgccaggccttctaccacttttacctaggcctgctcaccccaggctggcacctccctcagaggtgggaggtgaaggtggctgctgctgggcatttaggaggtacaggtgcagactatgttgtggattctcagaggactgagaagctctctgtctctctctctaggaggctttgatagtgttatcaaagtgggtctccagtgtttctggaactttcctccccttccttccttacctaattccttctttaaattccaggacctggaatttatcctgtctcgacacttcttgtccaacagtgagccccctgtcttcacccccctaatcccctgtcttcacatccctcttcccactttatttgctttccccatggacccatactcagggttttgggaggatggcagcggagtatggtggaggagagcgattatttaaagtagaaacccaaagcttttattatagtaaacttggaaaatacaagagaaaaattcacccctagaaaattattgtaaacatctagtttgtttccctctgcatattttaaaaactggattgccgcattttaccttgtgttagtgtcttgatttcattgttacgccgcctaccccctccacagtgtacacttggagtgcgtccttctgtggtctagttattttcacttggaggaaggaactttcacagaaaatgtgttgtgtcagtcctttctactcattaaccaagaaatcacaatgttgttttctttctcaatgtagagaagtcattcagaattcaaaagaagttctaagtttattgcaagaaaaaaaccctgccttcaagccggttcttgcaattatccaggtaagccgagaacaaggttcagtcctactattttaggatgcctttcaatttagaaaatgattgtatacaaaagagcagctgcatttcttgccaaagaggagagggctcagttggcaatgctgttttctttggtcttttgcttctttggggtcacgggtgaagtactgccctgcttgagtgtgtcttcttttgtgaattttcctctctgaggtatgggtagctttcagaggtctaggaggtaagcacttacatgcattgcattacacaggatatatcgtggtccatgtgtcctcacaaatgcttaccaaatgtgatttgaaggtgctgggggaaaaagtggcactttgtttcaatggacacagatgctagatgaaacatggatatttggtaatctttttactctatcttttaaaacctgccataaacttaatgggacaaaagtcattaccctgtcaaaagggctttgcattccacatacttcttttggctgcaggctctggttctgagccacagttggccccagttgccatcctgcttggcacacttgtgtgatggcaggtgctgagaaataaggaggtgagccaagcctggaagcaaacacagcctgacagttgggctgctaccgcagggcttggcatgcccttagcgtatcaaaatagcagcctctggttccaccgtgctgcgtatttcaggattacagagctgtgctcaagttacttacattctctgggatctgtagccacatcttgttacaaagaaagacaagttagaacaatagaaagaaaattagattagggctcgggcctcctgggaatctgcttactccctggctttccatctaaaggcaaaccatttcaactcctacctttggtatccccattttttggcttctttttgtgatggggtcttgctctgttgcctgagctggagtgcagtggcatgatcttggctcaccgtagctttgaccttctgggctcaagtgatcctcccacctcagcctcctgagtagctaggactgcaggcatgcaccatcacgccgggctaatgtttgtattttttgtagagatggggtttcaccatgttgcccaggctggtctcgaactcctgggctcaagcaatccaccgcctcagccttctgcagtgctgggattacaggcatgagccactgtgcccagtcggtgtcctcatttttagagaggaaagctggctaggttactatgtcttctaataggagggatattattttccttaaaaaagtgacataatttgaaggcctgaggaattactctgttaaatactggccccaagtccctttttataagcagcaagattgtttttctgcaccttccatattatctttgtaattagatcatctgtaatcacaaaattcatctctggattatcttttgtgccttttcaagctatttttatgttgttatgttgtttttaccttcctaaggcaggtgacgacaacttgatgcaggaaatcaaccagaatttggctgaggaggtgaggactgctgcttttaaaaaattcactataacttttaacaatacattctcttatagtgacgaataaccttgtgttcctttttcaggctggtctgaacatcactcacatttgcctccctccagatagcagtgaagccgaggtaataatggcagagctctaaactcttgcttcttctttcctcttgagacttaataggcccattggcgtctcttagtggtggctgggacagatctaagatttgcttgtgactgaatgttagagggaagacttcacttcttttctctagggtaaatgcttcatgatatccttgtttcttgtcatttgtatgtttctactgaagacttgagttgcgacttgttgagttcggttgtgtttcttcagctgcggtggcagcgtcatctagtggaaattgtcaggccgaggcgaggaaactggaccttggaccacagatccctgtgccagggcccggcccttctgtggttagcttttcttcctactggcttcatgtgacagaaaacctcaaataatggaatcttaaataatgtacaagtttatttctctctctctctctttttttttttgagatggaattttacttttgttgcccaggctggagtgcaatggtgccatctcggctcactgcaacctccgcctcccaggttcaagcaattctcctgcctcagcctcctgagtagctgagattacaggtgcgtgccaccacgcctggctaatttttgtatctttagtagagatggggtttcaccattttggccaggctggtcttgaactcctgacctcaagtgatccaccctccttggcctcccaaagtgctgggattacaagtgtgagctactgtgcccggcctagaagtgtatttttctgggacatgaataaagtttggaagtaggcagtccctggttggtgatatcaccaagtcgcaggagctcaggctcctgtccctctgctctgccgcctttgtggtttggttaacaagcactttgttctgattgatcagtgaggcccagcaggtctgctagtcatttgtgagacaaagaatgggaatttgtagagtttgtatctggccttgtgctatgtaaacaagggggcattggtgagtcttatttgagtcctatggagaagagcagttctttgcagtacacagaggctgcagggatttgttaaccttccctcttttccaggatcacagggctcaggtaaagttcgttgtcaccaagaagaaaaaggaaggacaaagacaggcccctgctgtctttaaagacatttcctgaaagtcacagttctacatccatcccgttgtcccctacttagttgcctggccaactgcaaaggaggctgggaagtgtagtttttataccaggaagccttagatcatttattagcaagctaaaaaccaagagtttattactaagaagagaaaggaaactatatactgggcgataagtgtttgccacacttgccattgtagcgtggtacaaatatgaagtgttaaatatgtaacaaatacctatgataccagcagtgacagcatgcaaaggaagttgttgttcatttgcacgatacccactgtctgcagcagaatttgcttttctttctttttttttgagatggagtctcgctctgtcaggctggagtgcggtggtgcaatcttggctcactgcaacctctacctcccgggttcaagtcattctcctgcctcagcctcccaagtagctgggattacaggcgcccgccaccatgcctggctaattttttgtgtttttagtagagacagggtttcatcatgttgaccaggctggtcttgaactcctgacctcaggtgatggcctgcctctgcctcccaaagtgctaggattacaggtgtgagccactgcgcccagctggaatttgcttttctttaggttgttttgccactggtgtttttttttttttttttttttctgagacggagtctcactctgtcacccaggctagagtccaatggcgcaatctcctctcactgcaacttccacctcccatgttcaagtgattctccctgctcagcctcccaagtaactgggtttacaggcacccgccattatgcccagctaatttttgcatttttgtagagacggggtttcaccatgttagccaggccgttctcgaactcctgacctcaggtgatctgccctccctggcctcccaaagcgctgggattacaggtatgagccacctcacctggccttgacactggtattaatagcccttgattttcgtcgttgttgtttataattgacacataataattgtgcatgtgtgtggggtacagtgtggtgtttcggtacttgcatatgttgtgtaatgatcaaatcaggttagttacattcatcacctagaacgtttatcatttctttgtggtgatagctttcaagatcttttctagctgtctggaaatatacaatacattgtcattagctttagtcactctactatgtaagagaacactggaatttattcctcctatctaagtgtaactttatacctactgatggaccaacctctccccatttcccctcccccatccctctccagcctctggtaaccaccattctattctctatttctatgagatcagctttcctagattgcacatgtaagtgacatcctatgatatttgcctttctgcacctggcttatttcacttcatgttatgtcctccaggttcatccatgttgccacaaatgacaggatttcattcctttttatggttgaatgatactccattgtgtatacacaccacactttctttatcctccattaatgggcatttggattggttccatctcttggctactgtgaatagtgctgtaacaaacatgggaatgcagacggcttctcagcatagcggtttcagttcccatgcgtatatacctagtggtgggaatggctgggtcatatggtagttgtttttttaattttgtgagaaatcttcatactgttttctctaatggctatattaatctgcattcccaccaacagtgtacaagagctcccctttccacatatcctcgccagcatttgttattgtcatttttgataatagccattctagcttgatatctcattgtggttttgatttgcatttccctgataattaatgatgttgagtgttttgtcatatacctgcaggccatttgtatgtcctttgggagatgtctgttcacgtcttttgcacattttttatttgaattatttgtttttttgttattaagttatttgagttccttatatattctggatgttaaccccttgtcggacgcatactttgcaaatattttctcccattctgtaggttgtctctgctttgttgattgtttgctttgctatgaagaatgtttttagtttgatataatcccactgatgtatttttgctttcgttgcctattttgttgaggtcctatccaaaaaaaccttgtccagaccaatgtcatgaagcatttcccctgtgttttcttctagtagttttatggtttgagaccttatatttaagtctttaattccttttgagttgatttttatagaagtgagcgatgagggcctactttcattcttctgcatgtggatatccagttttcccagtgctatttattgaagaggctctctttccacaatgtgtgttcttagtacctttgccttgacttattttttgacaaggaatcatttattccgtatttttctttgggaaaattctcatagagtgaatttgtatggtgttatattgaaaaagagtaggtaccttaatttattagttaagatttgtgttggcatttgttgcttctaccaaatgcttggtacaggtggcaatagtttcctcgcttcattctggtctctgcttggacatcgtggcctctgaccaccctccacccatcatcactctgttagccttttaccccactgaacctttatttttctgcatgtcatttattctttccagtgattttattattattattatttggaagggaggaacttccctcctccactagagtataagatccacgaggacagttttgtttatagctgtatttcctttacttagaactgatacagagtaagtgctcaaaccatttgttgaatgaatgaaagaatgccaaatgaatgaaacaaagctttctttctgattttgtacctcaaatggtttcccctgccactgcacaggtagtgatttttgctaggcaatgaaacaaaaatggtaaaccaacccttccccagagcctctgagtgagatctatatgcaaagataagtatcttctcacttgtgagcaaatatttttgttaagtgagatgaatcaggatcttatctcctggcataaaatagacagagaggacaaagcattgcttatttagagacacacccagacatttattagcttcccaaaatgtagcttggtctttttcctaaatagtgaattattttagtgtttcccataaaaggagctgtgcatgctaagaatttttctagcataagcctttggaaaggcttcttgtgtgtcattgaggtccagataacccgagggcctctgtgactgcttggacgtcatgattagtgagctgtgttgaacacattgtgtttgaaacgcacaggcttagctgggccagattggaatgcttcagattcatgcttcctgtccttcctgaaaactggcagtgtgtttggcttaaagtatgcttgttgacagagaagtgtcctttgtctatctaaaccttaatagctgttgagctttggttttgttctgttttgtctttttctggcacagagtagagccatagaaaggcagagaagtcactaaaaaattcagccaagccttttaattttttttttgagccttgtacacatgatgaaaagaaaaaaataggctttttattatgctttacaccaagtttccaacaaggagcaaaacaacaacaaactataacagatgcattttcatgaatccactttttatataaagcttcctttgttgggtctcattttcacaaaactaatttttattttgtttttttgttttctctttagattatagatgaaatcttaaagatcaatgaagataccagagtacatggccttgcccttcagatctctgagaacttgtttagcaacaaagtcctcaatgccttgaaaccagaaaaagatgtggatgggtaagaaaataaaatcaaataatcaacctttatggctaaatcactttttctattgtgcctgcttttatttttctaaatttcttctatttatttcaactgtgtcagtaattggataaaaaaatcattttaaatatttcaggagtctataggatttttttttttttgagatggagtctcgctctgttgcccaggctagagtgcagtggcgtgatcttggctcaccacaacctccatctcctgggttcaagcgattttcctgcctcagcctcctgagtagctgggattacaggcatgcgctaccatgcctggctaatttttgtatttttagtagagacggggttttaccatgttggccaggatggtgtctatctcctgaccttgtgatccactcacctcagcctcccaaaatgttgggattacaggcgtgagccaccgtgtctggccatctgtagccttttaaaattctgcatgcaaaagttacatattttggaaaatacattagcccttttatagtgcttcaatgccatatgatcttacaccatcagattcatttaataaattccggtctgacttatacaatctttagccagctctattcttctaatagttttttccttggtaattctaccagaccagagaagaaaacttagaaacctgattccccagcagtaccatattctgtcttagtcccaggccagttgagaaaagcaaaataaatacttttcttaatgacacaaggttttatttgaaatttggaggggaacatcataactattgggtgctgtaatgttggcctgtgattcatgtcatggagtgacataagcttcatagaacaaaggataccggccgtctccagtgggggataagcatgcttcctggggattaaaaccccattttcctccatggaaatataggaagtgttttgtactgtggccaaaaagaacacaatgtgttaatggttataggttgtaagcagatttataaagttagattccagatccggtagaccctgcaggggctggatggggaggctaccaccttcctgagacacccagcaatcttccattctagccttttattgtgacttgagtagacccaaacacaggctgaaaaggtgtcatgaacacctccagtcctggctgggcacagtggctcacacctgtaatcctagcactttgggaggccaaggcaggaggatctcttgatctcaggaggtcaagaccagcctggacaacatagtgagacctcatctctattttttttttttttttttgagacagagtctcactctgttgcccaggctggagtgcagtgacacgatctcggctcactgcaagctctgcctcctgggttcacaccattctcctgcctcagcctcccgagtagctgggactacaggtgcccaccaccacacctggctaatttttgtacttttagtagagacgaggtttcaccgtgttagccaggatggtctcgatctcctgacctcgtgacccgcctgcctcggcctcccaaagtgctgggattacaggagtgagccaccgcgcctggccccttgtctctatttttaagtaaataattaaacatttttttaaaaaacgacaatctccagtcctgtcgtagactaactgtaaaaggagaagaagcactaatccatgagaaaactttcagaacttgaaggtcctagggcatagtttcaagtctttcataaaaggaggggaattcatgctgaggcccagccaggaaaaaccaaccaaacaaaaacaacagagagtaaaaggagaaattacgaaaatggttctaaatgtctccattctgttactgagattgacgtgctcagtttaggctagatagctgtggaatgttttgtcctagatttgaacagggaaaggcacagaacccttcagaagtgtgtggtcactcattttttccactgccccccaccccgacttctcaaggagataaatatcgaggtcaagttgaaatcagacctgtgacctgtgcctcaatcccaggtcttactgggtcactccagatttataggattggttctgggttttgagtggactgcaggaccatgcttctgtgtaactctagggatgctagtccattggggtccattgaaaggagctccctggagttgcgaagtgaagccctgtatggctttaggctgtgtcctggtatattggcagaaccggaacacccaatgtcagggccagggtgaagtttcctaaggtactgccttagaattttctaagacctttattgaatggcctttattgcctgctttctctttaattcattttttatgggtttttttttttttttgagatggagtctcgctctgttgcccaggctggagtgcagtggcatgatctcaactcactgcaacctctgcctcccaggttcaagcgatcctcctgcctcagccccctagtagctgggattacaggcacgtgccatcacgcccagctaccttttgtatttttagtggagttgaggtttcgccatgttggccaggctagtctcgagctcctgacctcatgtgatccacccgcctcagcctcccaaaatgctgggattacaggcgtgagccaccatgcctggtcctctttaattcatttttatgtattctgtctatcaaacattgacttggatgttatttggggttaatatatgtacattacacgtgagtgatttttttggctgggctttgacttaacctacttctttattttctgattcagagtaacagacataaacctggggaagctggtgcgaggggatgcccatgaatgttttgtttcacctgttgccaaagctgtaattgaacttcttgaaaaatcaggtaggatgctccttgagaaatgccgctgatttctatttattggtatttacattatttttaataaggatttgtttggggaagaattaaaaatttttttaaattattattctgatatccttttaggatgtttctagaagattctaattgaacatagaagtgatatttcacgttgactttttttatttttctcatcttttgggagatacagatgaatacctagaaactttttctagtaagaccatcttataaattaaaagagaaattagtagagataaacgattagccctgttttaaacatgctcaatttctctcatgaaacagtcaaaataaccacagtaaaatatgcttccagtttcagcttactaaatctatcaatatgtagccttagataagacttacgttgaagacttaaatgaggccaggcacagcggctcatgcctataatctcagtgctaggcgaggccaaggccagaggatcacttcaggccaggagttcgagaccagcctgggcaaacatactgagaccttgtctctacaaaaaaaatttaaaaattagctgggtatggtggtgtgcacgtgtagtcccagctatgctggaggctcaggcgggaagatcgcttgagcccaggagtttgaggttacagtgagctgtgattgcaccactgcactctagcctgggcaatatagcaagaccctgcctcaaaaaaaaaaaaaaaaaaaaaaagagaagaagaagaagccggtagatgtagtttagggcacaggagcctaggttgggatttattggtgagcagcttgcttttcagtagtcaggacttaatttccattgttgtccccttgacttggcgtttttatgtcagtgaaatagaaatgaatattttctctttcttcattattaagtttaatgagtaaattactaccaagtatttatatatttaagggctttctgagaacataaagattcaactaattgggccggcacagtagctcacacctgtaatcccagcactttgtggagccaagatgggaggattgcttgagcccaggagtttgagaccagcttggggaacatagggagactccatctctaccaaaaaaaattttttttttaattagccaggtgtggtgacttgtgcctgtagtcccggctacttgggaggctgaggtaggagaatggctggagcctgggaggtcaaggcttcagtgagctgtgatcacaccgcagcattccatcctgggcaacaagcaagatcctatctgaaaaaaaaaaaaaaagaaaagaaaaaattcaacgaactaaatctttttctctactccagtttgaatagaaatgaagcaaatgcccctccctacccctgaacatccaacaatcaaagaaaaatttcaaaaatatatggcaaagttttattaaaaggttaacattcaggatatatatgctttttggacagtaatattaagctcaaatctatgaaataatccatatatacagtgctttttcattacgtggattatcaagatgaagattctgagccacttcattagaaagtactcaaagaaaagagtaaattaggctggtgagttatagttacatattgtggaaagaaattcagcaacaggaattggaaccaaaagggtttgaatagagaatttttgttgattacaacaccccactcctagttcctagtcattgtaggttggtgctgagaaagttcaagttttaaaagggttttttgttgttgttgagacattcttgctctgttgcccaggctggagtgcagtggcgtgatcttggctcactgcaacctctgcctcccaggttcaagtgattttcctgcctcagccttctaagtagctgggattataggcatgtgccatgacgcctggctaattttctatatttttagtggaggcggggttttaccatgttggccaggctgatcttgaactcgtgacctgaagtgatccgcctgcctcagcctcccaaagtgctggaattataggcatgagccaccacacccagcctaaaagggtctttttttcttaagataaagttcttaaaggaaggatctgaagttttgagtataatattgaattttcatttggttagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaaggtaaatttcatgttagaaacatacatcttgaaggcttctgttagaacagaagaaagtctagaaatgtataagctaagtgcttaattcaagaaattagaggaagaaaattgaatagacccatatccattaaagacattgaatgagtctactcaccagacaaacaaacaagaaaaggcaacaggtggttttacaaatgagctctatcaaacaaagaacagatcattctaatacaatccttttctccagcaaatggaaaaagaaggaacgtggcctaacagactttatgagtgccaaaaccaaagaagggtaacatgctaaaggaaaattaacaggccagtttcagctatgaatataaatgaaataatcgtgagcgaaatctgagaacaccaaatacagcaggaagtagggtttattttaggatttccaggtgattgaacatgagaaagtctgtcactgtaattcaccacattgtgattaaaaactaaattctcaccatagtaagtacagaacagtcatttggtaaatctaatatgcattatgaccttttgaaagtaattataattttgatgaaaattattaagaagacccatataaaagcagaggtatcatcttcatggagaagatgcaatatcttaaagatactaattgtctgcaaattttgtagaatttgacagtctgattctgaaatccaaatggaagcataaaggacaaagagagtcaagacaattttgtggaaaaactaggtgggagacattcccagccacacagtgtgaattattatgcacttacagtaattaggataatatggtagacaaacagacgatcggaacagaagaaagtggaaatttatgcatatatggaagcttgagagcaggtaccacagatcagtggggaaaagattaactattaaaggccgggcgtggtggctcatgcctgtaatcccagcactctgggaggctgaggcgggcaaatcacttgagctcaggagtttcagaccagcctggccaatatggtgaaacaccgtctctactaaaaatacaaaaaaattagccgggcgtgtcggcgcaagcctgtaatcccagctactcgggaagctgaggcaggagaatcgcttgaacccgggaggcaggggttgcagtgagccgcgatcgtgccactgcactccagcctgcgcgacagagtgagactccgtctcaaaaaaaaaagctaaaacattaactattaaaaatggtgctgacttaactagttatgtatatgagtctagcataggattactaacctgccactacatataaaaatcacttctatattaaaatacctaaatgtggaaagcaaaactgtaaaacttatagaaaaaaatataggcgtatgcatttaagaggttggcgttggaaggatagcttaagagaccccaaaagcacagattgctaaagaaaaggtatataaatctgactgcatccaaatttttaaaaaccccaaagtttttctttctgaaaagaagttcttaaaaaagtgaaaagacagctatagtgtagaagatatttacaacaaacatttagccaataattagtgtcttataaaagattcctacaaatcagtgagacaaagacaatctgttagaaaaatggacacatgacagaccactaacaggtgaggaacccgaggtttaaaagacacgtgaaaagctgtctggtttcctgctgtttttgctcaccagtcatattggcagtaggtaaaaagtgccagttagccatattgacaaatgtctggagctatgggaattcatatattgctggcgggagtttaaatttgaaataggcatttcggaaagcagtttaatggagtttgagctactctttgacccaggaatttcactctaaatatatatgatatggccaggcatgatagctcacccctgtaattccagcactttgggaggctgaggcaggcagaccacctgaggttggggtttcaagaccagcccgaccaacatggagaaaccccatctctactaaaaatataaaattagctggatgtggtggcacatgcctgtaatcccagctattcaggaggctgaggcaggagaattgcttgaacccgggaggcagaggttgcggtgagccgagatcacaccattgtactccagcctgggcaacaagaacgaaactccgtctcaaaaaaataataataaaaagtgtatatatatgtgtgtgtgtatatatatatataatagacaaaacttgcccatatatatacaaaggtgtgtttacaaatggtcagagcagcatgtttatagtgcaaaaagttttgtttgtttgtttaagacagaggggcagtggtggttctgtgggtcttggcccctttctgctgtcagggctgagttggctccatgagttggtgaaagcggtatctagccaggttcaagggagacaggggcaggatttcgccttcactgatgggcaggccagcggtcccctgtggaacggtgactattgaatattgagaggacagtatccctccctgagcatcttctggagcttgatgaccactagggaatgtatctgagtcacgcgcaccaaatgtgttaccggtggcagctattcgagttatcccgagttcgtgctggtgtatccgtacagttctgcagcaacttcagctcttgcctcctcggaagaaagaattggactgagggccataaggcagaaggagagactgaggcaagtttcagagcaggacggaaagtctagcaaaaagctctagaacagtaaggaaaggaaagaaggaaagtataacttggaagagagccaagcaggcgacttgaaaaaccaagtgcactgcaacaagtatttaaacagtgatctaaatgcccatcagggtgaaaggataaatcagtatagttgcatgtagagtatgcatagtcatagttcataaaacaatgatatacaagcagtgaaaattaataaactagagctgtagatagcaacatgttttcttgttttgttttttgtttgtttgtttttttgagacgaagtctccctctatcccccaggctgcagtgcagtggcgcgaactcggctcactgcaacctctgtctcctgggttcaagtgattcttctgcctcagcctcctgagtagctgggactacaggtgtgcgccaccatgcccagctaatttttgtatttttagtagagacagggtttcaccatgttggccaggctggtctggaactcctgacctcaggtgatccgcccacctcgacctcccaaaatgctgagattacaggcatgagctaccgcgcccgggctggaagaattttttaaaacactgttcagtgaacaaaaacccaagttgcagaaggatgtatttcatacaacaccatttatatgtgtctgaaagcaacacaacatatatatatatatgtaatctaatacatacatacatataatatgtattacatataatccttatatatatatagaatcttaatatatatatttaggtcaggacatttagatcactgtttaatatatatattaggattatatataatatatattatattattatgtattaattatataatccttatatatatattaggattccatgcaaatgaagtaaaaatataaagaaataatgcaaactacgaaccaaatccgaaaagcatttattgaggcaaggatgtggatatagatggaaaggaaacctagacaccttcatgccttttttcttaaactgggcaataggtgttgtctaggtatgttaggttattgttttccatttctatgtctgaaatgattgtttttcattttaaaaaatgatggtacagctcacagatctaaagcaaagtgaagttttaaatgaatgcattaagtacaatcagtaactacagaatgtgatctaaaaatacatgttcctcatgttgcagggtgagaatggaaatgaggagtaaattgtaatcgtgccagggaagccaggtgtctcagcagatttggaatctttgcatggcaggtggatccaatttatgtaatgcttgggttaagacagctcaggaaggcagccttgcaatgaaacgtgaacctgtgtgcgtttttagcagtcaccacatggtggcagcctatccaagaaaattcaagggcaatagtttgcacttgagagcccagaaattttgatttggaagctcagtggaagaggaaaataaaccgtgccctgcactgaacagctgtggtgaagagagaaaataccttccttggcaattgaatgttttcgcagctgtcacagatacttttgctagttgtatctatatttttgaaaaacaaagacatttttcaaagtacttttttattacgggaataaatcaccttgtctctgtactttgggatgaatctcatctgaactttgagaacgattaagtggcttcactttctggagaatctggtcattgggtaacattcttgttttcatatggaccagaaggttctctttcatagttgatgttgcacacacgtttttttccctaagtccttggtatttatagtggcaccattgcgaatgttagaggctatcaactttcattcttattattgcttcatctttgtagccaaaaatatgggaagaaatgttcatagccccgccccatacttgtccccctctacctggcctacctacctacgtcaggctcctgtcccaccacaaatgacagcctgtgtctttcatgttagcagctagtctttcactagccacatacttccccgtaacccatatgcctccctgtgtctgcctgacgtttgaattgtcactattctgttgttgtatttttacaagaagaatgtatggggcagaaaacccttgccattcatttcctgagtaggaattctagccttccttggagtcgtggtaatatggagacatggtaatatgtggattgtaccactcaatggctgtctggaggccacagtggtgcaaaaagccacctaggcatgggttagtgtcctggggcacccaatcaggacaggacacctggcacacccttggaaaagcttcactgtgaaaaacactggaagtaaaaattttaacaacagatagggatttttttccccttgagacagaggctcactctgttacccaggctggagtgcagtggcgcgatctcggctcactaaagcctctgcctcatgggttcaagagattctcatgcctcagccacctgagtagctgggattacaggcgagcaccaccatgcctggctaatttttatatttttagtagagatggagtttcgccatgttggccaggctggtctcgaactcctgacctcaagtgatccacccacatggccctctcaaagtgctggaattagaggcctgagtcactgtgcctggcccacatggggatttttgttgcccagcttaatcaaccaagaataaaagtgcattttaagattataatctatttaacttctccttattggcaatggtaaaagagttaaggaaaaaagagaataagcttaggattatggctactaagtagaaggacgttatctttgacgggcatttctgttgtgcttatttgtacctgacatggaacaagacccccccatcccctcaacacatacctgctgtgggacatctggctagagatttccaaagctgagggtgaaaggtttgggcatcggtgtgactgtgtaacactagagttctatctaccatctcttaaactacaggtagtcttaccggtgtgggctgaccttccggttatcaggcagcctgctgcaaccactagaaactgcctttgaaggtttccagtccggcacaacatttgtgttctcattaaacagtagagcataggctttggggacacacagctctgggctcaagccttagctgttgctgctctgagcctgttccctcgcgtagaaaggcaatcataatactccctactttatggggcagttgtgggaatggaattaaatgctaatgtgggccgggtgcagtggttcacgcctgtaatcccagcactttgggaggctgaggagggcagattgcttgagcccaggagtttgagaccagcctggcaacatggcgaaactccatctctaaaaaagtacaaaaattagccaggcgtggtggctgtagtcccaggtactttggaggctgaggtgggatgatcacctgaatctggggaggtcgaggttgcagtgagctgagattgcaccaccgcactgcaacctggagtgcaggctggaggaagagaaatatatgggtcaattaggcaaatcactcagatcgtaagtagatatactagtaaaatagcgtgacttagggtccttcactggaagcctggtattaatgcttccattgtgtgggtgggggaaggagagagtgtctccagctctctgtctgtgaggtctcccagccgaatattggccaagggagtgaaaccagaagcaagactaccatgagacaacgttccagagaaaggagggactaaccagagcaggtgcccagctttggccagtcaggctcatcttccagtcctcagtagattattatcaactttaagtgatgtcacagactcccttcctccaaagctgtggacctcttccttcccatgcctcttgttacttggaagtcactctacttccaaacatgtcggctggagatccctgatgggccagttactactttcaggctctgtaggtttaaagaatggttatatccagttagttacaaatagaaatcgatcctttctctgtccgtctgtctaaacggaaggatattctgtggacgctgattaggtataaaatctccacggagcctgagcatgaagaattgaccttcttagggttccacagaaaccagaatagacttctgtgtttggtagctttgtaacttacgcccgttgaggtgtacggttgaaaattgagaataaatttcctgttctgtttctgagcatcttttccaggcttggagatgcgttgagcatttccacggagaccctagaggtggggaggggaagaacgcctgggcatttgtccaaattagccatatgctgtggagtgtcacatgtcaggaagccaaggcactggagctagtgtttttgggcagggctagggaaccccccgcctttcctccacccaaacgcaggcccccacacccagcgtcctgggccctgcaggggaatgacactgttggtttcactctcaggaatgagcctagatttggaggtaacctcttcctgaccccgatgatttcactctgatgccaaaaccagtctgaagtgggtgtggttttgcatttggtgtttacaaggtggagtggtgccctctgcacggaagggagaggtgggcaggtacggcagggccctgctccctcgggagtctcctctgaacctgtggttagggcacagctggacaatgctgaaatggtctccagctgggagatgaggtaaacctcagctgcatgccgaagaaataacctagaaatcagagaaccgttttattttgtttttctcagaggatctcatttctccctctcctcctgagcacagagaccctcaaaactggtattcacagaaggaaaaaatataggtctttcacctttgaaggatcaaagtgtctagggttttttgtggttttttttttttttttttgaacaaagctgaactattacaaagtccttttcagtttaaatttagtgcatggcatggctcatgaaagacttttaaaagtgaattggaaaattctaaatgtacttgtattatacatgtgaaaggatgacttcttaaaaaaagaataatgtctgtcccaaacgggagaaggaaggaactctagcttttaaactgcactacattagtgagttacatgacaattctccttttaacaggatggaatgcacttaaagcagtaatgtgctatggtgacagtaatgacagacaatgttaattgacagaatggctactctgaaccaggcactgtcttgtactcctgttatctcagtggtcttcacacttattctgttaggcaggactgtcatcctccccacattacagatgaggaaactgactgaggcttagagaggagactttgcaaagatcatgtgattaaaaaatggtagaggtggcaaaacagcctgtgtttttaacactgtcccatgtcagctcttattccagatcatcacataaagtctaatctctaatcttgaaaaccgaaaagcacctgccacctcagataagagagaccaagaccctagacattcgacttgtgttgaattcactcttattttgttttgatgtttgtaatcccagagccatacttgttaatgagctgaagtagagtgaatgctgtcccctccctgaggcctggggctcatcatcagctctccaggctcccctttcagaggggatggtgagcaccttcggagagggcagggatggacacacaagacagcctcagttatgtgagttcatcccctcccctgcctgctgtgggtgagatggagaaaaaagcactggaccctcctgggcatcacagccttgtacttagcgagtggctgaggtcatcagtagcccaggtcatcagtagtgtggaattaagtgcactgaatagtgttggcccctgagctttgtttgacagatttagggggtcagctcaccactttcccctcttgcttctgtctgatcattgctctgtttgttaataccaaggaagaaagtgaatagaactttttagagagccaaaaaaactttattagactttatgccattcattatacttagcagtgttgagggaaggatttgtgagacgatatattcaaactaatgggcatgagaccaagaaggggctgtgtggcgggcgcggtggctcacacctgtaaccccagcactttgggaggccgaggcaggtggatcatgaggtcaggaatcgagaccatcctggctaacacggtgaaaccctgtctctactaaaaaaaaaaatacaaaaacaaaattagcagggtgtggtggcaggcacctgaagtctctgctactcgggaggctgaggcagaagaatagcatgaacccgggaggtggagcttgcagtgagccgagatcgcgccactgcactccagcctgggcaatagagtgagactccatctaaaaaaaagccggttggggtgggggcatgtaattaacagactgattggtcttaggtggctcagaatttaagctgagaaattaagattgagaagaaatgatgtattgtcgttatatcaaatatgtgagtaaaaacataattaaaacaccatctatctccagttttcccaacattacctcccttttatgatgcccttcctgtaccttattaggcaaaatattctaatttcagtctcattggattatgttctaaatgtttgaaggttggtctgaacatggaatgtattttctcatagatataatagtataaatggtgttagggtcatgggattgcgaagccagttccactgcagtagaatcatattgacttgctttccgatttttctgtgggaaacttcatctggagctttaatgcacttcttagctgtggggtaagtttcagcctccatgacgcttgtgttactttgtagtcacctgtggccaaccacaaataaatctttgtggtcatcaggggccagtgaagtgtatactgcacaaaagagagcctaccccaattctggaagaagggctgcaggcctgtgtcccacaaagaacaggcaggaagcatcaccttcagcccactggcagcaggtcatctcccatttgcttttctgcactatcagcagagtctggcttccttttccaccccctctccaatgtgaatgctttttaaggtcgtggaattagaatttaaaaaaaaaatttttttgagacagagttttgctcttctcgcccaggctggagtgcaatggtgcaatctcagctcaccgcagtctccgcctcccaggttcaaatgattctcctgcctcagcctcctgagtagctgggattacaagcatgcgccaccacgcccagctaattttgtatttttagtagggacagagtttctccatgttggtcaggctggtctcgaactcctgacctcaggtgatccacccacctcggcctcccaaagtgcagggattacaggcatgagccaccgcgcctggccagtattagaatcttttaatgggaacgtcttaaacataacctataacaatgaagcaccttataagtgtgtggagatttccttttcatggcttttcatatatgcctcgcactcacccagcaaccctgcaaactggatgttatactcaccagagagccttgaccctgattgtcactggcaaggagcagtgtctggacttgaacgcaggtcgcaggactccactcatggtgctctccccactgcacctcaattcctcacttttcaaaggaggcagcggaagcctggagagtttctcaaaggaaacggaatgcagaaatctgtctgtgtgcaatgtgaggctcagaactgaaaaccataaatgtcaggaaatgcaaagcagaattttcccctgcaacggcagtttgcatgaatatgaagacgctgtatggatgaaagtttgtggctgcagcatgagcataaatcctcggggctgctgttcgtctaggagcctgacttgcctggtgttgccctgagaactgcaacttgagcatttccttaattttgtactaaaggaaccaaaatgaggtattttggttctaagtctttgtcatgtgaaggaagcttcctgttaccaccccccatctacatacacattctctttcttagccccacgtttgaattttatgtttttcctaaagtatagggaagattattattattattattattttctttttcagacggagtctcgttctgtcaccaggctggagtgcaggcgcgtgatctaggctcactgcaagctctgcctcccaggttgaagtgattctcctgtgaaagggaattatttttgatgagtcattaaagtatatccattcccagaatggtgctgcatttttccttttatcatctgtcatgacttttttaagtgtgaagcttacttccagaggaattgtcttttctagcattttggacacaactaaatatctttgatattttcttctcatatgttgagcagtaaattaagttgaatggtgaagtcagaggtgaacttaggaacatttagaaaaaggaaggtcatttattatttttcaggggaaaagtttggtagaaaaatgctgtaatcctaattcccagatgtccatttggcttgtagtcattttgatttatgaaataatcataagaaatgtcttcaaattttaaaagccaataatttgttctactaatcacagatgagagtagaaataaaagaaacacacccaattcctgaaaggaaaaaaattctcccaggatgagatcactgggtggacgtgaagtgggtaaaataccttttgctgcaattgtcatccccttatcttgccaaagtacgacaacatctgaatgaagatggtttgatgttcttagtttagagtagttatactattattttaacattcctatttaatgatatgttttaatactgcaggggaaaggtagatacagattcatagctacaaagcaatactcttatgatcaatgttcatttaatttcaaatacaaagttagacattcagagttaaaaaaaattaatgcataggctgggtgcagtggctcacgcctgtaatcccagcactttgggaggccgaggcaggcggatcatgaggtcaggagtgtgagaccagcctgaccaacatggggaaactccatctctactaaaaatacaaaaattagctgggtgtggtggcatgcgcctgtaatcctagctactcaggaggctgagacaggagaatcgttgaacccaggaggcagaggttgcagcgagctgagattgcaccactgcactccagcctgggccacagagtgagattccatctcaaaaaaaaatagatatatatatattttttatattatattatatattatatatttatatttttatatatataaatgaataaacaaggcatctgcttatgaaacagtctgcctgaatgaaatctccatttgcaggcaacacagtctacagtaatggcaggactgtattaggcatggttcctaatgcccatttctgtagcaaagtcaccagtagttcctaattgccaaaagtgagtcaccggtagttcctaattgccaaaagtgtattttttgcttttatcttgcttgaccacagctgtcatataaacctgttggccacacccttttcccttagcctgaatgaaaatgccccttcctgcccttcgtagctcctgagccaccaggacatggtggtctccatcatctgttcgttatctctaaccatttaagattagtgctccccaaggatgtctgttaacctgctttccttcccattctgccagtttcccctggggaatccacacttctggttttaaccatcacctaaatgctgtgtgtcccgacccgcatccgcatgctcccaggccattctcagttccagacccgggcccccagcttcctgcagacgcctcctccaggagatctcagtatcttgcttttcctcctaccccttctaaggcattctcaatccagcttccagaggaatcttcctaaaacacatctgactgtgtgagccacatactgtagcccaacctgacagcttcttttctatattaagaaaaagtgcggccgggcgcggtggctcacgcctgtaatcccagctctttgggaggctgaggcgggcagatcacgaggtcaggagatcgagaccatcctggataacatggtgaaaccctgtctctactgaaaatacaaaaaattagccgggcatggtggcaggtgcctgtagtcccagctactcgggaggctgaggcaggagaatggcatgaacccaggaggcggagcttgcagtgagccgggatcgcgccactgcactccagcctggacgacagagtgagactcgtctcaaaaaaaaaaaagaaaagaaaagaaaaagtgcacacattttgacatctgagaaaagtgatgtttttcttagaaaagtgacatctaactctttatagaaactttgccacaaggtagtctaggagtccccttactacctaagattttcatggacatgccctgtctgatcataaagcatgtggcacagtggctcacgcctgtaatcccaacactttggaaggcccaggcgggcagatcacttgagcccaggaattcaagaccagcctgggcaacatggtgaaaccctgtctctacaaaaaatatttaaaaaacaaaatgaactgagcatggtgaagcacatctatagtcccagctacttagaggctgaggtaggaggatcgcttaagcccagaagtcagggctgcagtgagctgagactgcagtgccactgcattccagcctagaggacagagtgagaccccgtctccaaaaataaataaattaattaaataaagccttgtgaagaatctgccgtggagcataatgtaacccataaagccacttaactgggcgcacataaactacataaactacagtgtgtcccagttcattgagagtgaaaatcaagcaagggaccacctcagtgtggtagagccccctccctgccctccagaccctgctctgttctctgtgtctgaccattgactggccatcactcaggcactagttgagaatgccaatgtctttagttattgtaatttcagaagcacatccttgctggacaaagaacctacctgttaattttttaaagtaatgttcatcattttgaacattgttttctttcttttttattcagctgaccctcatgaggaatttaacttggttttctgaactgtgttggtaacatttgaaggacatagaaacagttttcataggtctcaagtgatataaaccacaattctttagaaaatatctttttttttttacccattctggattttgaaatatatacagatctcatacctcagattctcatatgatatgaactgtttcaaaacacattgatagcagaagatacatactgtcttctagtcaagagggtagcgctgtatttagtttaaaacattttaatgcattttatttgctaaatacaaaattataatattctgtataactttccaaatctcatctgtcctccctttcccccatctctttatattcagatgcttgtccctccagcttaaaaattcatgactttgagaaaattcgtcttcatgttatctaaactactgcacccccacacgctccctgttaagtgtctgcatatctgtgtcttactgttgtttaaaattcacttgtctgcctggggagtggggtggtttgctttaagctgctccactcaagtctcagcagagaaagcaataatttgttatgagatagagttttaagccaagctttggccagggtctctcccatttgggaggaggaaaataggaacaagtgagatgataattttccttgaattttagctcattaaaatcttcccttgtcctgggcaggctatttactgatttaagcatctagcacttttcctttccagaaagaattaacatctatgatgcaatcattgctaagggaggaggtttttgtgttttctctgtggaattagctgttctccagttgcagatgagcacagcccactttagagttgtgtgtaggtatggagttgaggggtcggaatgagatttccaagatttataggtaatgaaaagaacaggttgtatcaaagacaccacgtgtaggaaactaactgttcttaggggacttgtgtgaacctgtgatccttggctttctccaaaatgaacatttcagccttgttcatattaacctcctttttacagttgttttaccgtgttctggttttgctgctattctgcctgaaaatctagcaaaatggcgtttcttatctgcagaactgcgacaaagcttaaacatttgtatttctcttgaggattactgtggttgaatttttgacagtactatatataaatgaagaaataaaattttttatacagatgtttaaaatcctctttccactagaacatttctttctccctaaatatactattacctggaactctagctgtttttcagatctgtagagatcataggtggcttaagggactagattgctggtgatattggctgcaaaattttttttttttttttttttttttttttttttgagacagagtcttgctccatcgcccaggctggagtgcagtggtgcaatcttggcttcactgcaacctctgcctcccaggttcaagtgattctcatttggctgcaaagttcttagtgaggtttagtggtattttggccctgtggcacagaagaatggttatttagcaaatgtgttttgcttttgattttgttttgtttttgagacagggtcttgccctgttgcccaggctggagtgaagtggctcgatcacagctcactgcagccatgacctcctgggctcaagcgatccttccacctcaacctcccaagtagctaggaccacaggcatgcctcaccacacctggctaatttttattttattttatttttgtagagacagggccttactatgttgcccaagctgttctcaaacttttgggctcaagcagtcttcccaccctggcctcccaaagtgctgggattacccagcatggcagcatgagccaacaggtctggcctcggcaaaggttttagtagggctttctcttttcttttgaagatgattaatacagtagattcatacagccagaagctgaaaagcagggaatactgtttggcttattaatggataatcaatcagtgttaatacacttttccctatttacatggtcaaattgatcaaatatttccaaggtattagcttttaaaagttgactttgtcagctctatgaaaagacatgcatttacatttttatcgtgctcctcctctgtcaggggacttggatctgtccttgatcttggcttttctgttcataaaccaggtaggactgtcatgggtttgctcccattaccatctcttgtcccaagatttctaaaaggcatcacctgatgcacccttttgcccaaatagtgttaaaagtcctcaggctgaggagctgtcctggttcttctacaggatctttaatgatcagcctgtctaagctgagaatggataagggtgtccccaacacgtttatttggtggtttggtgggggtagtgacactggggatgcttttgtgtgttgtaatctgcccctctgtctgtttgaccccagagactctgtggttagttgcaggacatcaaaatacgcaggaaagacagtgggggaagagaccatcagtcgccctcttgctgcctaggttcactagaatctctaagactgaattcactaggagacacaggacataccgtagagctgtttatgtcttgagagccccagtttcctagtctgttaaatgagcatagtaacaccaatctcactcctttggaatattcaatggtgtaatacttacaacatctagctgacctgtacaattatagctattctcttctgcaagtctaatattcctattcacccctccctctgcatagggatccagtttgaaatcatcagttgctcagtagggcctggggagctagctggtcattctttggttaaagtcaaagccaacctctttgcctacctttttgtcttaatgtcaacttcctaccagacatgttcctcccgcactggatgatcaaaatgcaaataggatggacacgatcaatgcattttgttggagtggttgcattctttctactttcttagggcaaaaaaatgaatggttggacaagagactaaccaaggcctcaaagaaagtgaaattctttctcaagctcctgaaagtcctttcatgggtatagtaacagttctataggggtctcattgtgatggtgccattatacaggccagcaagccccctgtgtgagccagacctcatggccttagcccttgttttcctctttttttttttttttttttttgagacagggtctcgctctgttgttggagtgcagtggtgtgatctcggctcactgcaacctctgcctcctgggttcaagtgattctcgtgctgtagcctcctgagtagctgagattacaggcccccaccagcacgcctggctaatttttgtatttttagtagagacagggttttaccatgttggccagtctggtctcgaactcctgacctcgtgatccacctgcctcagcctccctaagtgctgggattacaggtgtgagccactatgcccggctgccccatcctttttcttgatattatagttagtggtgaaaacatgtaaatgataatactccatgcagtatgtatgctgaagtgactaccctgaagacattttttaagtcctattttcttttctttctaggatatgataatcattttctgtttgtattaatacatgcttgaaaggaattagtaaagcgattccatccttgtcagcagcttggaacaaagctgtggatctgggattgtgtagaactcatttgacatcagtagttacttgtgtctttatgcctcagatcaagatgtgcgtgtttttttctttctccttttagcttcacgaggctgacattgtggtcctaggctcacctaagccagaagagattccccttacttggatacaaccaggaactactgttctcaactgctcccatgacttcctgtcaggtaaatgtcttcacattggtgttgagccactgattaggtcagatagttcaaagaaatgttaaccttttcctaagaggttatgtttctgaaatgttagcagtcgtcaacattaatatatagggtaggaaacttagactgtgggctacctgatagaaccatgctgttgagcaaagagagaccaagatggcggttgaggtgtctgctcccacagtgaagtgccccctactggcctctagcagtcaggtcagttgtgacctcaagtagatgatttgtatgtgtgtgaggtaaactagaaatagcggttttcacagtttcttaaaaattagtaaaaccctttcttccaaagaaatcttcgtggaatctcactatgtaaaagcagatgagcgccggattgttgggagggatgggaataggatcagcctgtgtgtctccctgatttcctcttgcattgacccatgaagcacatccttggagccccagagtcatctcagaacagtatgaaaatcaccactagatgcagaaactgttgtaggattggtcctgctatttgatggcattttgccaaggtatccaggaatactcaagaccacaccaggcccactttgggggcagcccaagcagtgcccgcaacagggcagccagcagccccgggtccagcaggagccggcccagagtgggttcctttttccagttcgtagaaggactgaggctaagaaagccttggagcacacccaggccctcagcaagtccctgagtagcacaggtgagccagagacgatggcacagggaggcagaggagagcccctcttcctgattccttctggctttggcctccaaatgtttgtgtggaagagaggactgtgctgagctgggctggaggacaggggcagcttttatccctaaagctgggcagaacatgcaccaaggttggcagcctctgctctccttctcctccaccaggaccatacttgaggttgaaatcttgaaaccttgtaggcagctccataaaagcatgagccctagccagaggttgttactgaccctcctctctaggaaatgtagctcctgccagaattgaccgatcagattaaaaaccccttgggggctggagagggtggaatggaacagagtccaaggaaagaggcattaagagctgtggccctaatggctctttttaacaaacagaaagcatgtactaaataacattttaaaaatatgtgtaatttattcatataactttttttcccctgaaaaaaaaaaaaaacaaagcctaacctattaatagtggacagggcttcctctgttcagcatcccagtcagattaggaaaatcagttccaacatttgtttcttgtaaatgaatgctgctttgctgtaatatttacttgctgtgttttattaaagttttcatgtaggacagttttggcagtcatggctggagataggagtctactttgatgttctggaatctctttgagctctgtggttatatgacagtgacatatattttgttagtgaaagtgctttatttttaataaggtttccttttaggacccttatttttgaaaaaaagtattccctgaaatattagatatcaatgtaatgattctctgggggaaaaaaagaccaaggcgttacagatgttcctcgactgaccatggggttatgcacagataaacccatcagaagttgaaaatatcattagtaaaaaatgggcatttgtagccaggatgggatgtgaaaacagaaaacaacgtccaaaaatgctggcagcacagtacgctgtagagtattggttgtttggcctcgtgattgcatggctgaccggaaaccacgatttgctgtcactgctgcccagcgcctcaagacagccttgttctttgtatagctggcctgggaaaagatcaaaatttaaagcacagtttctactgaatgcatgtccctttcccaccatcataaagtggaaaaatagtaagtgaaaaggttgtaaatcagggatggtctgtgtatttcaaaatgattctataagtagaatttatttgaaatttatctggcccaactgtaatagttttcttgttggtttttgaatgcccagtgtccagaatagtacctgacgcttagtaaccgctctgtgaaattttttttttttttttggagacagagtcttgctctgtcaccctggctttagtgcagtgggtgtgatcttggctcactgcaacctccaccttctgggttcaggtgattctcctacctcagcctcccaagtagctaggattacaggtccctgtcaccacgcctggccaatttttttttttttttgtatttttagtagaagtgtggatgcaccatgtttgccaggttggtttcgaactcctgacctcaagtgatccacccacctcggcctcccagagtgctaggattacgggcatgagccactgggcctggctaactctgtgaatattgagtgtttgacaagttaataagcatgaatcaaaattctactctgcttgtagttttaagttagtggcatgtttagaaacatttccttgaatttgtctcccacttaaagatggggctgatggccaggcacagtggctcacgcctgtaatcctaacactttgggaggccgaggcaggtggatcacctgaggtcgggagtttgagacctagcctggccaacatggtgaaactcttgtctctattaaaaatacaaaaaaattagctgggcttggtggcaggtgcctgtaataccagctactcgggaagctgaggcaggagaatggcttgaacccaggaggtggaggttgcagtgagccgagattgcaccattgcactccagcctggatgacaagagcttttttttttttctcaaaaaaaaagaaaagaaaaaaaaatgggctcaactaggcagtcattgagataaagatgaggaatgctatgttgatgaaacagatgaacagtttcggggtggtgctacccataatagcacatttctaaatagtctacaagttttaattttagcaactttgtttagtatgaaaatttgatctaggaataatggagaaaggttttttttcccctctttttttcataatcccactactgtaaagaaatgaataaactttttgaaatattaaaaagaaaagagctcttatttaaacttaagatgagaagaacttttaataaacttgtggctgggtgaagacagagttttataatgaaatttttattcttaccttcatggtacagagtccctcctccttacccccgtaaaaatagatgggatgttgtgatttatgatgaggcaattctgtagagacattttatggaatacgtaatcctaggagagattttcctgatggctaatatcccagacacagagctcagaaaacaattatacccagctagttggttctgttcactctactattgcatgagtccaatgtttagattttaaaacaaggaaatttcaacattctgttttctagctgtaagagtaactactttaaaaaaaaaaaaaaagacaaccaaaaaaacctatttcttagaaaaagtcttgctctgttgcccaggctagagtacagtggcacgatcacagcctcaaactcctgggctccagcaatcctccctcctcagctaattaaaacaattttttttgttgttgttgaggcagggttctcactgtgttgcccaggctggtcttgaactcccggcctcaaatagtcctcccgcctccacctccaaaaagtgctgagattactggtgtaaaccaccatgtctggcctaaaaaaattatttcaaatgaaaaaactacgcactgctcttgtagtgccctgcttgctaaacagcagatttcatcataagcaaaatcattttgtaccctaaatattaggacttatttactgatgtaacaaatgggaccaaggagaagctggtcttccgtcttaggctcagaaaacagtatcaaaacagcaactctgtggctcagagtaatttatagcatcattttaagctaatgtaattctatttagtgtggaagaggggaagagccctgggatgctgatgtgctgggggtcccgagggaccttgagactttctctcgtatggctctgaagggagacattagaacttactggaggctgggcgtggtgtggctcatgcctgtaatcccagcactttgggaggccgaggccagtggatcacttgaagtcaggagttcgagaccagcctgagcaacatagtgaaacctcatctctattaaaaatacaaaagttagccgggcatggtggcaggcacctgtaatcccagctacttgggaggctggggcaggagaatcgcttgaatccaagaggcagaggttgcagtgagccgagatcacgccattgcactccagcctgggcagcaagagcaaagctccatctcaaaaaattaaaaaaaaaatgtagtggaaagaacatggactttggagtcaggattaacctaactcaaggacaagggagctgtttttgtaaaaaaaattcttggccggatgcggtggctcacgcctgtaatcctagcactttgggaggctgaggcaggcggatcacctgcggtggggagttcgagaccagcctgaccaacgtggagaaaccccatctctactaaaaatacaaaattagccgggcatggtggcgcatgcctgtaatcccagctactcaggaggctgaggcaggagaatcgcttgaacccaggaggtggaggttacggtgagctgagatcgcgctccagcctgggcaccaagagcgaaactccatctcaaaaaaaaaaaaaaaagaaattcttaattgcattgcacttacaggctgtgtgactttgaggaaataagctctctgattaattaataagattcccaatttctttgtgggtaaattgggagcaaggctgttgggaggaatgactgagatgatacctcggggcagtgcctctttgatggtagctgccaataaatgctggtccacttcctgcattcctccctccacttccttgttgccatgtcacctgcacacaaaacagctttcagactccatcttggcacaatatacatttatatttgaaaaatcaaacccaagaaaggaagaagtccaatgaaattctgaacatgtaagaaaagtcagctttagagaaattggacatccgtgtaattttcattatgccaaagcaattgatataaaattaggatctttgcttgtgactcttgaactttagtaattccaaaatccattgtacctatcactgttttcttttatttattttttcctgtaaattctggatattctagatctatccctgaagtatattgccagttttccatttcaaattttaattagttctcaatacaatgtatttaatattttgctttttttaaaaaaagtaaaggttcatgtcatttagaatatgcagcactgtataaatttccttgttaatttggtttcagtggtccaaattaagttattactaatagcttattagtatcagtttactaatattttaatttttttaatcatgtcttacattgcattcttttaaaaactagtgatatgctgtcatttgacagtaagaattcaaataatttaaactaggattgcaactctcaagaacactgtcacaaaaattttaccaaatgatatgtattagtccattctcacactgctataaagaaatacctgagactgggtaatttataaagaaaagaagtttaattgtctcacacttccacggactgtacaggtagtatgatgctggcatttgcttggaaggccttctggaaggcctcaggaaacttacaattatagtagaaggggaaggggaatcacatatatcttacatggccagagcaggagcaagagagagggagggcgtattagtccattttcgcactgctgataaagacatacacgagacggggaagaaaaagaggtttaattggacttacagttccacatggctggggaggcctcaaaatcatggcgggaggtgaaaagcacttcttacatggcagcagcaagagaaaatcaggaagatgcaaaagcggaaacccctgataaaaccatctgatctcatgagacgtatttactaccatgagaagagtatggggaaaaccacccccatgattcaaattatctcccactgggtccctcctacaacacgtgggaattatgggagtacaattcaagatgagatttgggtggggacacagccaaaccatatcagaggaggaggtgcatactacatacttttaaaaaccagatctcaggataactcactcactatcatgagaacagcaccaatgggatggcgctaagcctttcatgaagggccacccccatgatcctgtcacctcccaccaggccccacccccaacactggggattacaattgaacatgagatttggtggagacacagaaccaaaccatatcatgatactcattttatttattgcattttactttatatcctacaaagtcaatatatttaactgaaaaactggctaccagtgtttttgtttttttttttcaagttctacctgtactgatttctaatttttagccattcctgattttaaaacctcgcatacattttggggataatttgttctcctagatggcgagaaaatatttaagtctgtgggcttggagaatgcttttttgataagaaggatgcccttggccagactgcatagaagctgagatgtttccgcagagccgagatggcatgaaggctgaagaattttcctgcatccctcccactgcagtgattgttctggcaaagttcccagggtggtctctgcactgctcatattagtgaaagggtggttctgatttctgaggaaggcatgataacactttggccttaaattttctttttgcagaaagtttgattatcattagaagaatggccatcttttaaagtgattcattgacttgtccctggagaaatcatgagttagatgagagtgtttagtgggaagtgaaaagacccgtccacggtttcggatgagatcctcgttggactgtgatcccaggatattacccaggcccagatcgtagacaacctcccaatggagtcctgcccctacacgggcagggggtgaaataatgattccctttcttaattttctttagccatgaaatttattaaaaatgtatgtctgattctgagttgccagtcttaattgcttgagattctctggattcagaacttatttttattttttttatttttattttttgagacagagtctcgctctgtcatccaggcaggaatgcagtggcgcaactgcaggcccactgcatcctgagctcaagcgatcctcctgccccagcccccaggtagctgggactacagacatatgccaccatgcccaactaatttttttttttgaggcagagtctcgctccctcccccaggctggagtgcagtggcatgagctcggctcactgcaagctccgcctcccgggttcacgccattctcctgcttcagcctcccgagtatctgggactaaaggcgcccgccaccacgcccggctagtttttttttttgtatttttagtagagacggggtttcaccgtgttagccaggatggtctcgatctcctgacctggtcatccgcccgactcggcctcccaaagtgctgggattacaggcgtgagccaccgcgcccagtcccaactgatttttgtaccttttctagagacgaggtttcaccaggttgctcaggctgctctcgaactcctggacttaagcaatcctcctgccttggcctctgaaagtgctgggattacaggtgtgagctactgcgcccagcctgaatgcagtcttaaaactgaattagaaaatctgagtgcaggctagagttatatataattaagagagtgtgggttttaagttgtgtcttaaaattgtgttgtttttggtcgagtctggtggctcacacttgtaatcccagcactttggggggcctaagtgggctgattgcttgagctcacgagttcgagaccagcctgggcaacatagtgaaactctgcctctacaaaaaatacaaaaattaagcccaggtgctgtggctcatgcctgtaatcctagcactttgggaggccaaggctggtggatcatctgaggtcaggagtttgagaccagcctggccgtggtgaaaccctgcctctactaaaaaaatacaaaaactaaccaggcgtggtggcacatgcctgtagtcccagctacatgggaggcagaggcagaagagtcccttgaacccaggaggcggaggctgcagtgagccaagatcgcaccactgcactccagcctgggcgacagagcaacagtccgtctcaaaaacaaaaaacaaaaattagccaggcattgtggcatgcgcctgtagtcccagctacttgggaggctgaggtgggaagatggcttgagcctgggaggcgggggttacagggagctgagatggtgccactgtactccagcctgggtgatcgggccagaccttatctcaaaaaaaagtgtttttaattacttgtaattttaattgcttgtaattaaaaaacagtaattaaaaggaccaaaagttaattttgcaggtagtaaaccttagcctactgtacgtaaaaatcagaaggccaaggcaggaggattgcctgagtccaggagctcaagaccagcttgggcaacatagtgagaccccgtctctataaaacaacttaacaatgtgccaggtgtggtggcacacccttgcaatcccaactactcaggaggctgaggtggacggattgcttgagcctgggaggtcaaggctgcaatgatcgtgatcacatcactgcactccagcctgggcaacagagcaagaccctctgtaaataataacagtaataatcagaaagcaacactgtatgtgaataaagtcaccttacctagctgccggtggacagcctttggtgtttcaaggacttagtttttatgcgttcctgctttcgatatttgttgactgtgagctttgggcttatccagggtccatgaagaagaaatggctcttccttatctcaggcttttgttattttggggtgttttaaattcctctcctgtggttactcaatccgaccctacttgcctctctcttccacaaatttctcaaatgtcattcatggtacccttttaactcttacggacttacttgtttttaacatatcttttattcactttgaatggagtttcgactggaaatagagggtagtgttgtgtgtaccacctaccatcttcagctagacactttcaaagagtttgttttgttaattatatcttcttacatggctcattatgcttgttgaaatttgcaagatgctttaaaccaatcctgtccaaaccacagcctgtgggccgcatgtagcccaggatagctttgaatgcagcccaacacaaattcataaactttcttaaaacacgaaattttttttgcaattttttttttccttagctcatcagctatcatagtgttagtgtattttatgtgtggctatggcccaagacaattcttcttccagtgtggcccagggaagccaaaagattacacattgctgaaaactttagatgtatcaggaatcatatagcttttcaaaataaaatatccacacttttgctaagttctatgctatgcaagtgactgaactataccaggacttatcttgtaaacttggaagtgaaatattcttcactcgcaagggtattttgtgattaaattctggaaatatgcatttataagttgataccagctcctggaatgtaactttttcttttttctttttttcttttttagattttttgagatgaagtctcactctgttgcccagggtggagtgcagtggcacaatcttggctcactgcagcctctgggtcccgaggtcaagcaattcgctggcctcagcctctgagtaggtgggactacaggcatctgccaccacagctggctaacttttttttgtatttttagtagagacagggtttcaccttgttggccaggctggtcttgaactcctgacctcaagtgatccacccacctcggcctcccaaagtgctgggattacaggcgtgagccaccgcacccggatgctttttctcatttctccatcgcttaaagatagaggattgagagaggcccgtttgtggacacgatcttaagtacagatctctagtggttaaaacgaaacacaacaattctctctcatcctctagactcttggcttttgcctaaatatgattcataaagctgaagtgttgctaatctttaaataacacccaagggatatgattatatgattacccaacaccctaatacagtttaagaatagagtgatccaaagaaggagaaaatagtgtcttcaaaaatgttgctattagaaatatttcttttctctaagggaggatgcaggctaaagtatttagcatgtgtgtttacttttataaattttctaagtgatgaaggaaggaaggtagaatctttttttttttttttttttttttttttcagatagagtttcactcttgttgcccaggctggagtgagtggtgtgatctcggctcaccgcaatctccgcctcccaggttcaagcgattctctgcttcagcctccctagtagctgggatcacaggtgtgcaccaccacgcccagctaattttttttttttttttttttttttttttttttggtatttttagtagagatggggttgcaccatgttggccaggctggtctcaaactcctgacctcaggtgatccaccctactcggcctcctagagtcctgggattacaggcgtgagccactatgccctgccagaagtagaattcttatcaacatctttctaggttgataatcaggtaatccctaaagttaataccctaaaatgcaattttttagttttgatggaaaattgattctatcccttttttttttttttttttttttttttttttttttttttttttgaggtggagttttgctcttgttgcccaggctggagagcaatggcacgatctcagctcactgcaacctcggcctcccggttcaagcgattctcctgcctcagcctcctgagtagctgggattacaggcatgtgccaccacgcctggctaattttgtatttttagtagagatggggtttctccatgttggtcaggctgttctcaaacccccgacctcagatgatccacccggcttggcctcccaaattgctgggattacaggcgtgagccaccatgcctggccggttctataacttctatgatagagaatttttaaattatcaaaaaagcctgatctttcatgtaacactttgaccagtcttaccctgtgagtgttttcatctgccttctcacgctttgcatccacaagtgaaagtgcttctatttttctatgtattgtacagtaaagattttagagctttctaggccaggcatggtggctcgcacctataaccccagcactttgggaggccgaggtgggcagatcactgaggccaggagtttgagaccagcctggccaacatggtgaaaccctgtgtctactaaaaatacaaaaattagccgggagtgttggcaggtgccgtaatcccagctgctaataaggtggaggttgcggtgagctgagatcgtgccattgcactccagcctgggtgacagagagagactctatctcaaaaataaaaaaaaaaaatttttttagatccttctaataagatgaagcccactgtgtcaaaaaaaaatctaaaggttaggatatgaagtcattctgacagattatgctgtggaagaatatatatccctgttcctttcttctgagccttactttcatgttaatagtttaaactacatactatatgccaagaactttatataccttatcatatttcattttcacaaaattttaggaggttgatattactcacattaattaacaggcccaacatcacaatttctagcaagaggaagaggtatgcttttaatgcaagtctgactctgaattctgtggcctaatctgcagtctatgttgcatccacatgttttaaatgttcgctatgaattctcttgagctattatttctatctctaattatgccataatttaaaaatcagaatacttgggctcgtgtgaagagatggtgtgcctagatgtttcttcctggctcagtgtgagatatgattttgaaagcacatgatgtgcttcattacattttttaaatccatttatcccaggttaatagcttagatggcctttttttttttttttttttgagatggaatcttgctatgtcgcccaggttgcagtgcagtggcgtgatcttggctcactgcaacctccaccttccagcttcaagcgattctcctgcctcagcctcccaagtagctgggactacgggtacacgccaccatgtccagctgatttttatatttttagtagagatggggttttgccatgttggccaggctggtcttgaactgacctcaggtgatccacctgcctcggcctcccaaagtgctgggattacaggtgtgagccactgcacccggccagatggccatttctctaatgtaaaatgtgaagcaggcccaatggagggccccaagcctgtgccagaggtgaccagtctgcagccgtgccccgacatcctaacttccttggtgaaaaatgagaccactattcagtgtgctagctgtttacaaggagcaattggttagaaatgacagtgtactgaaagtcttttttttccctccaattttttacagggaaggttgggtgtggctctccaagaatacattttggtggactcattgaggaagatgatgtgattctccttgctgcagctctgcgaattcaggtttgttcaacatagctgtctgagaatcttgagtttggaagtttgattaatagttgctaacattttgcaagtggtttctgtttaccaggtacagtgttaaacacttcacacacagtgttaggcccatttgataagtgaagaaatggtgattttgaaaaatgaagtgagttgcctatgatcacatggcagtgtggggcagggacccatcctggggactgtgtatgttatcttgtgctgtgtaataaattatcccaaaatttagcaactgaagcaacaaggcatttattatctcacagtttcttcaagtcagagatttggtagtagattagcagattaggtggtatgttagtccattcttgcattgctataaagaaataccagctactcaggaggctaaagcaggaggatcgcttgaacccaggagacagaggttgtggtgagctgagattgcaccactgaactccaacctgggtgacagagggagactgaaaaaaaaaaaaaagaaatacctgagactggttaacttagaaagaaaacagatttaattggctcacggttcttttttttccccttgggacagagtctcactttgtcacccaggctggagtgcagtggtgcgatcttggctcactgcaacctccacctcctgggtttaagagattctcatgcctcagcctcctgagtagccgggactgcaggcacacaccaccacgcctggctaattttttgtatttttagtagagacagggtttcaccatgtcggccaggctggtctcaaactcctggcctcatgtgatccacccgccttggcctcccaaagtgctgggattacaggcatgagccaccgcgcctgacctggctcacagttctgcaggccttacaggaagcataacacaggcatctgcttctggagaggcctcaccaagcttccaagaatggcagaaagtgaagggaaagcaggcatctcacaaggcgggaacaggagcagagagtgagggatggtgctatatacttttaaatgaccagatctcatgagaactcattcactatcacaaggacgctaccgagggagatgatgctaaaccatcatgagaaactagcccctgtgatcccatcaccctccaccaggccccacctctaacactggggattacatttcaagatgggatttgggcagggacacacatccaaactatatcaaattgtttaggctcaggatctctcatgcatttgaagtgaagatgtcagctggggctgcagtcatctgaggcattaactggggctggaggatctgtttccaagatggcatactcacatggctgtgggcatgtgtatttcattcctcactggccatcagcaggatgccttggttcctcatcatgtccacctctctgtagggctgctcacagtgtggcagctaacttcccccagtgtgagcaatccaagggaggcaaccaggaggagtctgcagtgtggatgacctgggctctaacctcatgtgccgccacttccttttatcctgtttgttagaagtagatcactaagtccagttcacattcaagagaaggagaattgtcctcacttcttcaagacaggagtattaaagtatttggaggcattttttcaaaccaccaccacctgtgtgacctaaaggcgaaggtcatcagtgttccaccatataagctgagtgttctcatggtgctggagcctgcagcagtggtggcctctggcagtgacatttagttcatttctttcttatgtacagggtaatacacaattgaaactctttacctcaaaatgggtcattagacatttttgtaaggattataagttacatttccatcaaagccaaattttatttttatttatttttatttcatttacttataatttatatgcatacataacactactcagtagttcaatttgcttgctcttttataccaactatggaaggatggtatttggaagctgggcatccaagctgatcattcacgcagtcctatattttcttcatttttcttttctaaattggatgacgaacctattcagtataagtttatccatgtacatgatgtcttttgtgaacacttaatctatttatttatttatttatttatttgagacggggtctcactgtgtcacccaggctggaatgcagtggcacgatctcagctcactgcagcctccacctcccaggttcaagtgattctcctgcctcagcctcctgggtagctgggattacaggcacatgccaccacacccagataatttttttttttttttttttttttttttttgagacagagtttagctcttgttgcccaggctagagtgtaatgtcgcaaactcggctcactgcaacctccatctcccgggctcaagtgattctcccgcctcagcctcctgagtagttgggattacaggcacatgccaccaccacgcccggctaattttttgtattttttgagatggagttttgctcttgttgcccaggctggggtgcaatggcacgatctcagctcactgcaacctccacctcccgggttcaagtgattctcctgcctcagcctcccgagtagctgggattacaggcgtgtgccaccacacccagctaattttgtatttttagtagagacggggtttctccatgttggtcaggctggtctcgaactcccgacctcagttgatcccgcctacctcagcctcccaaagaggattacaggcgtgagccactgcacctggcctaatttttgtatttttagtagagacagggtttcaccatgttgcccaggctggtcttgaattcctgacctcaagtgatctgcccacctcggcctcccaaagtgctgggattacaggcatgagccacctcacctggcctatttattcatttatttttaaagagacagaatctcagctaggatgaagtacagtggtgtgatcttgactcactgcagcctcaaacttctgggctcaaacaatcctcccacctcagcctcccgagtagctgggattataggtgcgcatcaccacacctggattttttaatagtgtattttctcacattttcctgtttttctttttaaaatttaacaaaaacaatgaacatagtcagaagttctggcctgtgacttgaaataaccctggatgtacatttttaaaaacattctcagattcattgctgtaagtatgaagagctaatagtctgcaagggaactatagaattaagctggatcatcaagttcatgcatgcatatttaagaaacagagcagcttcttttaatactatcaaactcttcagtgcgatattgaatagttgtatatctaactagtggttttcacgttttcctttttaagaaaaacctacaaacctagttacacgtgaataaaaatattcctaatatcctcctggcttattgtgcgactcgataatcttgttttgtaacatccacaaacaatatttccatggtttaagtgtgtgccctgtcagcttttaccattctaacatgttttcccctctatccctgctgaagaacatggtcagtagtggaaggagatggcttcgtgaacagcagcacaggcggtggagacttcactgcttgaaacttcagcctctctcccctgtgccaaggtaacactggtgttttatttacactgatgtcagctcagcacagtgccttagccctagttagtcatgggggagaagcacaactcatggtactgtggttttgatggtagataagtttctctattcattaaattgccaccctattttctctattgtaaattctccaaaattaaatcataatgaatgtattactgtgttctgtcaattctaagaaggcatatttttttatttcaatgatgttttctatattaaatggcagttttttaatgatgttttaaaattaatttatattaatttaatttcaatgatgtttcctatatttaatggcagtgttttccccccccacccttttttttttttttgagatggagtcttgctctgttgcccaggctagagtgcaatggtgcgatctcggctcactgcaacctctacctcccaggttcaagcgattctcctgcctcagcctcccgggtagctgagattacaggtgcacgccaccacacccagctaatttttgtatttttagtagagatgggggtttcaccattttggccagccggtctcaaactcctgacctcaggtgatctgcccaccttggcctcccaaagtgctgggattacaggcgtgagcgaccacgcctggcctggcagtggtttttcttcttagtggtccatgaagtaatggttttaaatttgacaaaatatggtaatgtaatatttggaatatgcttttcaatgtcagaaatgcccaacacgtatatatccgcctggtgttaagggccatataggtttctactctggggataaaggaccgtccaaaccaaacattattccacgtgggaactgagctcagctttcttcagaacgatctgatagaatagtctgtgctcgtcaaggtggatattttcctcagagtgctctctgatgaggtctgagctacatattctatctataaatttggaaatataaactgtaggtcatagtctcagcttgtggtttagaatgattgggtagggatgatgtctgaatcagacagctgcattttccagcctgatgatgagtcatctgtgtctgtcccactccaaggaattggccccacccccattatccaggtgtgcataatactaggtgtgcatccccaggtaatctcatccagcaacgttggaatgcacacagtgccgaggagataaaatccctctagtaactgacactttatttatttatttatttatttatttattttttcttttttttttttttttttttgagacagagtcttgctctggtcttgaactcttgacctcaggtgttccacctgcctcggcctaccaaagtgctgggattacaagcatgagccaccgcaccggggctgactcattttttacctgataaccagttgctttatagaattgaactccatttccttggacagtcagatgaacaccctggttcagttctacccactaggagggtgtgaccctcctggacatgttttcatccctgcaatagacgaaacatctcagttatgctctctgttcattaattatataagttgcaatgaggaatgttattctttgtaatatcatccctgggcttgtgcaatctgtttcataaaatatcttattttagagttatttttgttgttataagaccttagattttaaaagtaaatcaataatttctacttacaaagtgctaaaaaagattaagatagattccaccaaattgtgtaccaaagtttcaaagtaaattcttcttgttaaataattaaatccttttctcccccaagaagaatttactttgaaatcattgatttctagacccactgggcaaagagaagcaggctgagtagtttataaatcaccccaaaaatcggatgatgtctctgtgactagctagtaaagagaaaaccttacaggtgtttgttttgttttgtttttgagacagagccttgctctgttgcccaggctggagtgcagtggcttcatctctgctcattgtaaccttcacttcctgagttcaagcgaggacatctggctaatttttgtatttttagtagagacagggtttcaccatgtttgccaggctggtcttgaactcctgacctcaagtgatctgccctcctgtgctcccaaagtgctgggcttacaggcatgagccaccatgccaggcctgttttgtttgcttgtttgttttttgagacagtcttattctgttgcccaggctggagtgcagtggtgcaatctcagctcacctcaacctccgcctcccaggttcaagtgattgtcctgcctcggcctcccgagtagctgggactacaggtgccaccaccacacctggctaatttgtttgtatttttagtagagacgggattttgctatgttggccaggctggtctcaaactcatggactcaagtgatcctcccgccttggcctcccaaagtgctgggattacaggcgtgagcctctgcagcctgccaaaagcttacacattgttcaagattaagctcttcaatttaggagattgtgggaagagagagacagaaaaaaactatggccaggaaggcaaaacaaagtaggaggctagaaaggaaaggtcggataggtggaggcctggaaaggaatactcagcggtacttgaggggggtaacctgaactcctagtttctctggtgccctttggagaagtctgggtggaggtgtgtttgctgttgcctcttacccccgggtcaggcccctacaggatcctggaggagagtctagggtggtctgaacactgagggtagattacctgcagtagctacagaaacagtcagggccaaggggctgactaaagtccactgagggggttgatctgcccaccgcaaggaggcagaccacaacaaaaataagtgttctggggtgagtgaaggaatagctgtcctctctgatgcaacctttaagggtagtcccccgccgcgtggtctcccggggttagtcttgctgctgggggaacaggtgtgccttccatctctcactctcagacacatgaagggcctgactgcccagcaaagaaatgactgagcacatgagccccagaggaaagagtccagcattacacatgctggtatccagaccactcctgtaagacgagcagtggtggccagtaaaatagaagagttcagttacgtgcccaatgactctctggagttcctacaatttcctgtctgaacttgggctcagggcactaggtccttttaccgacagttatgtaattaataaaacattttgaaatatgattttagactgtaaatagagagggggaagtgtggacacagataaaacgaaatagcatttccacattttttctttttttttgtacttaatctctaatgtgatagtaatgttcacatttttgaatagccaagagaaacatgtggccagcccgatcggagattattatgcaatgaccctctattcatcgctaatgaataccatgatggcccatacagagcattttgctctgtagtcgaatcacacttgcaggagggttttggacacattataatatgctgttcttgtctctatgccataggtgttatacttccacctggacacaattctaggatctttgtgagttttttggagttgcatttctaaaatgatacaccattttctcatacacgttaattattagcagttgtgcttattactgcctgggagaaaggaccccaaagtaattgcattgatttcatcgttggcgtgatgtgtggctgttttcactccagttgtgaccacctaagctgagaagccttttctctctttcgtattgtctttcccctcagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggtaagacaccatctaacatctacttgatcaagcagacatatttacaaaactcttccctatttatctctctcctcgtacccctcaatccatcctattctcacatttgacatttcgtccatttcatttggcatttctttatttggtgtgagataagtttttattttcagtgcagagcaaactagtcgactctacacaagataaagtcaaacaagttgcagtgctttatcttttgtttctcatattatgttgttattacccctgctcctccttgactttttgaatttcatttttcattataaaaatcaaaataggaattgaaagtaaactattttgaactgagcagtttgttttgtgcgttctacttgaaatattttcgtggaaaaggtacagataatcatatgaaacatgttttcctgttaatatccttgatcttacctacatattcacatttcaaaagctcattatttccctttttctgcatttcaaaactaatgttgggccattttcatttgtgttggttattttataaaagacaaattcatagtttttgtgaaaaggagtgtttgcctttttccccttctttttaaaaaaagaagtacattcactagctgaaaagatgatagaaagcaagggatttcaaatatttattcagtgtgacctgagggaacatcatgagaccatataaattcctttgctgccttgaaatttcatttcagtgactattgcttatgatgtatacaaagcttcaggcacaaaacctatttgtcaggcagagacatttcttgtaattggaattgactcctaggtaactttgtttttacgtatttaattattaatgtaagtgcttttttctttatttctttttctggttataaaaagaatgtagtttcattgtagaaatattctaaaaattcagaaaacagaagtgaaaaagtaaaacatcccaaacccaagcactcagaggaaacaactgttgacctgcgaggactgttttgacgctgatagagtctctcagccatgaggtcacactcacatgctattgtgtaagcaacctgattattcaagcatatgtggcatactgagctccatgtgagtgaatattgagctatgtcaccatttttcatgacaacataacattccatcactcacatcccagattctttttttttttttttttttgagacagagtcttgctctgttgccaagactggggtgcagtggtgtgatctcagctcactgcaaactctgcctcccgggttcaagcgattctcctgcctcagcctcccgagtagctgggattacaggcatgcgccaccatgcccagctaatttttgtatttttagtcgagatggggtttcaccatgttggccaggcttttctcgaactcctgacctcaagtgatccacccaccttggcatcccaaagtgctgggattacaggtgtgagccaccgcacctggccacatcccagattcttaaacatgttggggaagcaggggctgggggagtagcaaaatgcccaggatgagggtggagatcccatcttacacatcttctggcacctctagttccatcaataagtgctaccctggtagttctgagtgtttctaattgtccaagtgcactgatgcagaaaaataatttgaacatagaatagggatgttccacaacttacttgaccaattttctattgatgggcaatcaaagtgttcccaatttttgccattttaaactgctagaattaacaaccttgggcatgtggatttgtgcatctgtttaattatctccttaggaaaaatccccggaagtgagttcaattatttataaccacaaataaagcaaaaatattatccaaaacaggccaagcgcggtggctcacacctgtaatcccagctctttgggaggccgaggcaggtggatcacaaggtcaggagatcgagaccatcctggctaacatggtgaaaccccgtctctactaaaaataccaaaaaattagccaggcgtggtggcaggcacctgtagtcccagctactcaggaggctgaggcaggagaatggcgtgaacctgggaggcggagcttgcggtgagccaagatcacgccactgcactccagcctaggtgacagagcaagactgtctcaaaaaaaaaaaaaaaaaaaaaaaatcacctctttaatgatatagtgatttcttcaaatcctttttccctcctcctgtcccactttcctgtcctcctctttctccttctctttgtgtagcttttcttttttttttttgagatgaagtcacccaggctggagtgcactggtgcgattttggctcgctgcaacctctgccccctgggttcaagcaattcttgtgcctcagcttcccaagtagctgggattccaggcatgcacccccacgcctggctaactgtttttgtatttttatagagacggggtttcgccacattagccaggctggccttgaactcctggcctcaagtggtccgcccgcctcctccttccaaagtgctaggattacaggtgtgagccatcatgcccagcttctgtagcttttttgtaagagggacagacagccagggcctctctgaatccctcagcagttggcattgtaaggaattcatcctttgctccacaccttggttgcctgtggcttcacccttctcccgcaggcttccaggctcactgcagttagattcctgagcccctttccaacctagaaccccaaacttaatgtccccataatcgagtgtgggaaagttcctggctgaggggaggggttggctccacctgcaggcaccctctgggcccacaccctgcaaggagctgcctctggttagattggctccggggtctctgagtttagggcacagtttagtcagggttgttttatggcagtatgcttgatgcatatttgtctgcaattaataaacaaactcttggccattaagaccttgaaaaagcatttgatttgtgaaattggttcctttcttccaggcttcagatgatcttggtaggtgggtttgcaggctttctcaccctgttcagataggaacacttaaggaaaacttggtaggatgtgttgtctgtttatgaaggaagaatcctgcagcagattttcttatccagtccttgtgctttactccattttgggcttgtcaataaaatcagaaatccagatatggatggctctgaccttagcttggaacacaaaactgatacttctaaaacaaagctgtgatgatactgttttcaggttccttacttgtaaacaaagctgggcctccagcctcatgctggagaatgctagctagcacgactgcctggggttacagccaatgcagtccatggccagtagaacatttctccacgctggctttttgctagcattaatatgtataatcaagctgaaattggcctgccatgttgtaaatagaaaagaagactaaagatgaattttcaagaacagattaaacaccaagggatcaacaattctttttctgaaattctaagtttctttacctaacaaagacctttgaaggaacaaaaattaaatggcctgtctcttttttaactgtagtggaaaaaaataaccgtgctggtaagattatgatatatgtatgcatttgtggcacagcttgaagatttttaggaaatagccacactggattctataagggaagaatgaacagccccttctccccaacacaacaaatgatatattttttagggctgtaaactgtcatcagtatctaatcccttaatagctgaatattgatatcagtttagatcacaggcaactattttatcgatagcctaaagtgggcctggcatgacgggttgtgcctataacccaattactctggagactgtgggtggatcacttgaggccaggagttcaagaccagcctgagctgcatagcaagaccccatctttaaaaaatacaaacaaacagcaaaaagcagcactggtttaaagcaacatttgtaatctaaagtgaaaagtcaatttgaaataaaaatcatcttcatatttttacatttgaccaggtcaagcgttagggggaaatgactgttatcaaaccattatatgcactgttgcaacttctttaaaaatataaatgacccctccattaaatggagaattatttcctttttctaaaagtcttttctaattctgaaaataatattagcttattgtaaaaaatttaacataaagtaaaaaggagataactaggtctctcataactcaatattttatttatatattcatctttttacacattgagatcatgctataaatatcatttttgtcctgcctttttctctgaacactgtaacataaatctttttccatgctttagaagaattcaaatacccaagtaatttttaaataatactaaataacaatatatttgttattacatattttaatttatatagaaatgtgatttaaatatatcagcaatgggattaaaatataaaacaatgagatttttttaaatcttctattattaataactcaaatgcagaacagattaattcttttaaaaagccattcttcaaactttaggatttcttattcagtcagaatcatctgcatttcatcaactacatatcgcatggtatttacacctacacatcactttatttgctttgcctgacaaaatgaaaagtattgggaattgttcagggaaatatgccaaaagaatcttagggactcatgagttttacatattttcccagttacactaatgaaaaggaattttgtttgagaacttgacttggagtgcagctgcagggcatttgaatctcagtctccatcaggcctgcacccatttctgtgcagaagtttctagaatttccctgaattggttggacagagcagctaaaaaagcagcccaaactgatctgggaatagactgaatttcacattaaagaaaaatttgaatcattcacatcatttcatctttttttttttttttttttttttctgcagagggccaaatacccgattggattttttaaaaatgtttcaaccctttatttcggtacaatgttaaaataatctgacttttctatgatttggcttttctgccttgagtaactatttaaatatctgtgtgattttcttttatttgtgctacttctagaacaaaacagaggtatttagaagaaaccacttcccacagggcctttgaaccgtttacctaagtcaagtgtaatgagaaacataaccaaatgcaccatggggtttattgttagataataaaaggcttaaaaagcccctagaccctaaagatgcctgggatggatgatttatgttcatatgctacttgagcatgtagttttggagtgcatggtgaggcccatggctaatggcagtggtgctattcaacaagattctgggtctttagaatagttcaaagttttaccacttctctctggataagccatctttttgacctttgagtaaattataaacttcttttcagattgtgtccaaatggtcacaggtactttgacagtttttactgtaactgccaataagtaatactcatctttaaaaagacatcattctggcagggcatggtggctcacgcctgtaatgccagccctttgggaggccgaggcgggcggatcatttgaggtcaggagttcgagaccagcctggccaacatggtgaaaccctgtttctattaaaaatacaaaaattagctgggcatggtgatgggtgcctgtaatcccagctactcaagagggtgaggcaagagaattgcttgagcccgggaggtggaggttgcaatgagcagagatcacaccattgcagtccagcctgggcaacagagtgagactccatctcaaaaaaaaaaaaaaaaaaaaaaaagcatcattccattgtcaacccttttttgctgttctgtgccctgaacaggtgatgtgatagcggtgcaaagagggtgagcattgtcctttacctcaacaagtgtgtggcctggtaggcgagacaggcatgtcagaatgcttatcatgaagccatctgaaaaattctagaataatcatataatcaatgctctagatatcagagagggggtacagaaatctgccgggagaagtggaggaatgtaatgaacaaaaatcacagttccatctctatgaactctaagctcccatagaaaaagaaattagagggctgggcgtggtggctcacgcctgtaatcccagcactttgggaggctgaggtgggcggatcacaaggtcaggagtttgagaccagcctggccaacaaggtgaaaccccgtctctactaaaaatacaaaaattagccaggtgtgatgacgtgcctgtagtcccagctactcaggaggccgaggcaggagaattgcttgaacctgggaggcagagattgcagtgagctgagattgtgccactgcactccagcctgggcaacaagagcgaaactccatgtgtctccaaaaaaaaaagagaaaggaagaaagggaggaagagagggagggaggaaggaaggaaggaaggaaggaagggagagagagtaattagattaccttaaggaaagaaggaaggaaggaaggaaggaaaagagagaaagaaagagaaattagattaccttggtgctcattctttcgtatatccccgttgatgatttggaatctgagctaaagatactggggggaaaactaaaccaaattttgataccaaatacaggaaggaggtgaaataagcttttttattgtagctctccttttattgctcacaataaatacttcctactttgtgattttcccgaactgtattagttggcagaaagctgagcagtcctgtgtttctaattaagaattggatggttagctggagttttgaggaggtcatctctgggcgtgtctgcttttggctttcttgggcagctatgctagcatatccttgggaatgaaaatgtaatccttcatgtgacacagtttaggtaaaccacttagtcctttgcaaacaccaaatgctcagtgcggtacttaaatgacaccatatttgatgccacagtttctttacaggctcttctaagattgtaatgcctgtgggcttttaactgcccttattgatgttgtatccaagaaaacagaaagttgactccaagcagaagtattaatatctttgtataactttcagtcttcacgttgaccccactgcagatctgctgtttagacagatgcagaggtgactgataagccggggtcatgtggcttcaggagtcttaggtttctccatgcagcggtgtcaggataggctcaccagctcctggccacagtgggtaccagcgacctccttgttgctgaatccaccgaccactctcggtcctcatcctgcttcctgcctcagtggcgtttgactttcctgttctggaaacagtctcatccttggcctccttctgagacttcctgtcatgttctgccttcttctccagggtcctcttattttttgtgtttttagagacagggtctcactatattgcccaggctggtctcaaactccctagctcaagcagtccttttaccttggcctcccaaagtgctaggattacaagcatgaaccactgcacacagccgggttctcttattttatactacgccttcttagtttccttttggactctcttcttctgacaactcattacaagcaaatgtgcttaactcttctgtccttatcccttttctcactcggtgcactgtccttgggtgatcttacccattccatgctttaaatggctatagttatgatttccatccatggagaacctggttaagtcagatggctggctttgcctcccagctctactgcttactagctgtgtgactgtcggcaagttgcttacactctgtgcctcagtttcctcatctatcaagtgagcgtacaaataattaaccccataaatatgaagcatagcacctctcctattaactgccccaatccactctcagttttatctagttaacatttattaatttgccgggtctcacctaagatgttacttcctacaggaaacattcccagatgttcaaatctagttagatcctttttccatgtaccctcataattcagtctgactgccctatttccctgtcttagtgtttgtcacatttatcgtaattgctgatatattcagatcagctggaagctcgtgaggatagagatgaagtctgactggatcatcattttgtccccagcgtctagctcagtgcctggtacatagcagtacttgacaaatatttgctgaatgaatgactcatggaattgtagggtatgatgacgcctctaaagacattctttctttgtggttacatccttaggttttgtagatcagaaaactctattagattggttgtggttgagtatccttgacaacatggctgacagtaactcatggaagaccaaactgtaaaccctaatgacagcctttaaattttttaacgatgcttgagagctaagctggaaggacgtggggtgcttatccctcgtagaaatgcctgccaatgctttctcatttggacccaaactccagatcgggagcagtcttatagctggatcagctaccaagagaaattctaaagcaagaagagaaaagcatttcaatttgggacatttatttgcacctggaaatggggaatgggctatcagaccagacttctatcctgtccaacctgccttcattcagtccttccacattgttattctgggtttggactgtgctggaaagacaactgtcttatacaggctgcagttcaatgaatttgtaaataccatacctaccaaaggatttaacactgagaaaattaaggtaagcttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcaaggagtccctgtacttatagttgctaacaaacaagacttgaggaactcattgtctctttcagaaattgagaaattgttagcaatgggtgaactgagctcatcagctccttggcatttgtagcctacctgtgcaatcataggagatggcctaaaggaaggacttgagaaactacatgatatgatcattaaaagaaaaattttgcggcaacagaaaaagaaaagatgaatatcaatatctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtttcttctccctaccccacacatcttttggtactaccatttggggaagccaagcaaggatagtaaattgatcagaacacagttgtgggaatttggcctgaagttagtgaaataaaactttaaagagtggaaaaaaaaaatttttaacaatgcttgtgatgtactaaagaacaattttatgaggccttacttggtaatgtaataggctctcttcaatacctaatactgtgatgttatgaacatgggaacatttggttttgcaaagtgttgtcatcaacaataagattctcaagagcagaagtttccgccatagtatgcacagggcctgtggactttttgaatatttgaaggactgtcatatggaaagggatcaggcttagtgtgtaggactccaagagctaggacacaacatgaatgcagatgccttctctctagaacaaagaacttttgaactgtaacagctgtctgtaaatgagtgggccaccccagaggtcatgaccttatcaccatctgtgttcaagcatggcagggagaagccctgggcagggatatctggaaggagaaggacaagtggggactttagggtcccttctaatcctgagagtctggcagtgccctactcacccaaggaccgttgagctaggccctgtccccaaaccataggccctgtgcccacaccctgccccaataaatggctcaggaagaacaactgctatatactcatcagcaagaaatgccccaccatcagctgaattatttaaaccattttgatgagtggttttatggcctttcttgaaactgatgttgttattagcactgcctaataccttttccttttttggtttcttggtaaaggtgtgtctgtatcttgactttagcttatgcctgtcctgtgtgatgtgagtagaccataatagcccgagaaaattaaattatggagtgcattttgaaatgagcaccctcagatttgattctggtgtcttcggctggttttgcataggttgtctgggaaatattataaaattcactttctccccccgaactcaggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggtactgtctttaacaactagtgtacttttcagggcaaagttggggggagagaattgtaaaaagaacattgtcaacagataaagagttaagacttttcaggggacttggtacatttcttcactgcacactcagtacatagtggtcgccccatgttggttcccccgggcatgaaaaagagcagtgggagccgccagggcttcactggatgcctcaggagcctgttcctggggctgcgttgctcaaggctcccgcctcgagtgcggtctcccatttcatcagggccttctttgccaagtgatcttgaaacacggccatccatatcggtgtttgatcatcccagtcccggggaaaggtctttccctctgctttagtctcggctcattggagttgctgtgtggggcccgcagagctctctggagacggactggctgtggacagcgagtcgtgatgaaattcctccttggccgtggtcgggctgatatctggcacttccccattcattactctttcttccctgatttatcatgaaatcattccttagctcactttacagtggtggttattgctgcaattacagtttgtccttggcacttcgtgattttttaagaatattgcatttgtattactgttaaacatattaataacgtatctcataaagtactgataacgcacagagtgtcatgcatcgtgtagtggaatgaacactagggttggagcgagaaagccaaggttttggtcacagctgtgtttcctaccgccatgtgacccttggccacttgagccagtcacaacctctcggagccgcatctctaaaagtccaaaatgctgagagcggcaccaggctcacccagttgttgtgaggatcaaatgagaaagcacgtaaagaacgagggctactgtcaaatgatacacacatgggcggtgttgttctgctttaggaaagagcagtccttttactctaacaaccaacattttgagggatacgcagcatgacaaatctcacatactattatctgaaataaattgaagtttataatttactcatttgaggtggttatgcggtggtttttttgtttttgtttttgtttttgttttgagacagagtctcacttggttgcccaggctggaatgcagtggtgcaatctcggctcactccaatctccgcctcccagtttcaagtgattctcctgcctcagcctcccaagtagctgggattacaggcacccgccaccatgcctagctaatttttatatttttaatagagatagggtttcatcatgttggccaggccggtctcgaactcctgacctcaagtgatccgcctgcctcagcctcccaaagtgctgggtttacaggcatgagccacctcgcccagccacagtgtattttttttaaacaaagtttgctcagatatgaaatcatatacaattgatttagataaagtatagtcacagagatctaataataaattatcaaaatattctcatatcctggtatgttttacagtaatgacatctgctctatttttaccttttttttttaagcaaagaaacagaggtatagttagacaaagtgtcaactttttttgttgttgttctgcttggatataaccattagtgtctctcactgccttttgttacttcatcttgggtgtgacgcctctctgttgggtttggggagctgtgtcccttggcctgtgtccatcgtggcagctgtacttggtgacccgtttgaaatgcctcttgctctgttgtttaggaggagccgcgggtggtggatatgcccaggtcatccccatggaggaggtaagaccttgaagagatgcgggtcagctatcactgtgtttccttcctgacatcttgtctctgctcccatccacacaggcccacagaccctcatccataatcccaaagtcattaaggctctgaaaccccaaaatgtttgcataactcatgcagtgacaaaccctagtatttactgtgatgagctataattatatggattttgtacgtgctacttggcgtgaatattcatatacattgctgtggaaaaattatttttgattaacaggtgctgacctagcccctgcttggggtgttttacaaataaactacatgtaaatcacactgccttcctaaacttcaaaaaattcagaatcttgaaaccctgctggccttgcgggtctggatgagagaatgtgggtctgtgcctcccttgatcatctgctgtactgccaagttcacgaagacttgacgcttcccctctgtcaattcaggctctagtgcgtgcctcggcagcatagatactaaaactggaatgacacagagaggattagcatggtccctgcacgaggatgacacacaaatttgtgaagtgtcccattaaaaataaaagaccccaaaataaaagagttccagaggaaaatgggcaaaaagaactgacgttgttaattctcacttctgtaagaactccacctttgttccacataacctctttgttgcctgtaactaaccagtgaccagctcttttcagtttcactctctgcatcagccttatcattcagggcctggacaatcttccaaaacccaaatctgagcaggtcactttcctgttctgtcatttccgccgttgcctgtcaccctccagcacagcacaggaggtcctcgtgggtggctgctcctgcttccctgtccacaagtccccacctgccttctctctactgcgtcaagctccttgcagactctttttttttttttttttttgagacagagttttgctttgttgctcaggctggagtgcagtggcacagtctcggctcactgcaacctctgcctcccaggttcaagcaattctcatgcctcagcctcctgagtagctgggattacaggcaactgccattgtgcctgactgattttttgtattttagtagagacggggtttcaccatgttggccaggcttgtctggaactcgtgagctcagacaatccactggtctcagcctcccaaagtgttaggattacaggcgtgagccactgtgcccagcccttgcagactcttttcctgttctctcttggttccaggattttcccatgcctggaacattcttccttttctgtcctctttacccagtttagtcaaggttttttgtcaaggttcttctctaccccacagactccctctgtgtttacggctatctggttcagttggctgtggcgagttgcgggcctttcttgaggtctcaggtcccagcattgagcagagtgcccagcacatagtaggaactcactagaaagtacttgttgactttgttaaaggaatagaagtgtttacccatggaggtctgagtgtcagggaagctaaagagaaaatctgtaggaacttcaagtactgggagtgggggtgagaaagagtagtccaaggcactgctgaaaaaaatcgtcccaggcctcaggtcagaatggggatgggtaccattcatgagccagcaagacccagaaccaggaggccaaattagaggtggtgtacaaggggcatacacaggggaatggctcgggtttagccagcaaattggaaggacattggtgtcccgctggtttagggcatcagctgcgtggcttggaggagagagctacttttattttattttattttattttttgagatggagtctcgctctgtcacccaggctggagtgcaatggtgcaatctcggctcgctgcaacctctgcctcccaggttcaagtgattctcctgcctcagcctcccgagaagctgggattacaggcacctgccaccatgcccagctaatttttatattttaatacagatggggtttcaccatgttggtcaggccggtcttgaactcctgacctcaggtgacccacccacctcggtcttcaaaagtgctaggattacaggcgtgagccaccgcgcccagccaagaagactaccttatgagggtagagtgggccagacacactcaggcaatttgttccttgaagttgagtgcctccagtcttttcttcatctgtatcctcccagctctgagcaccgtgcctgacacttggtggatgtttgttgactgtgtgccaggcacagacaatatgtactggacggaacataataaatcaccataggggaaaatgttagaataaattccagatgggctgaggaattgaaagtgaaaacactatgactggaaggatgggaaggagccggccttgtgaagaatgagggagagcattcagccagtgggaactgctggtgggaaagtcctgaggcaggaaagggtgtggcctgttcagggaactggaggacaccagggtggctggagccccgtgggccagcgggagttgggggggttgaggtagagaagtgtgcaggcgccagctctgtcgagcgattgcaatttgtagccaagaacctggattttatttgaagtgccaaggtcagccattgaagggatcttgacagataacacaatgcagattgagttttattaaaatcaccctgtcttctgtgtgatgaaaggaccaggggcctctcagtagacacgatgaatccaggaggaagactatggaagtagcctagggaaagatgtcagtgacttggcccaggatgggggcagtgaggatggaaaagaggaaaaaacagtttaagatttgtttgctgatgtttgcaggattagatgttgggggttagaaaagaggaggattcaaggacgacatccagggtactggcttgagcaactcagtagactcatttgttgaggcagagaacaggggagtgatggtatgaggtttgaactgtgtggtgtggggtgtggtggagggtggtagtcagaaggagggagtcagtttagaggcctatgaaacatgcaggtggacatcaagtagacggctggaaagaaaaacttacattccagttgtgaaatggccaaagagttcaatagaaacatcgaaaaagaaatattaactaaatgcatattcatcttcaccaataatcaagtaaataaatctacattaaaaccactatcaggccgggcacggtggctcatgcctgtaatcccagcactttgggaggctgaggcgagtggatcacctgaggtcaggagtttgagaccagcctggccaacatggggaaaccctgtctctactaaaaatacaaaaagtagctgggcgtggtggcaggcgcctgtaatcccagctccttgggaggcggaggcaggaggatcactcaaacctgggaggcagaggttgcagtgagccgagatcatgccactgcactccagcccaggcaacaagagcgagactccgtctccaaataaataaataaataaaaataaaaccactatcagttaccattttacttgtcaaattgacaaaattggatttttcaaaatagttatgataccaaattttggcaaagaaattgaaatggactcccacacactgctggaaagtgtatgttgataaaaacacttcaggaagaagagtagaaatacatattaagtgttttaccgtgcatatcctttggcccaaataaattcatttttagtgtaccctaaggaaaaaatgaatgtatgggaatatagatcattttaaattaaatataccctcacatagtttataacattaaaaaatggggggataataataggacatcaggttaactgtattttgaagaatctttaatgatgtaaaaatgcttgctatgttgagagtgtaagagctaaagtataaactgttacgatgttatgattccaatatttaaaagtacaaatatatatttataaaatatatatacatatgtaatttttcatgttttctccagttaacattattttatgttataaagtaaaattttaacaagaaaatatttaaccttccaagaaattaaggaaatgcagctttaaaaagaataacactttctcaactattaaattatttcttagtctaaaagttactttatttctgaagtaactgatctactactagtgttttgcagatgacacttcatctctttcaaaaagcaatttggtgatattatcaagatctcaaaggccggatgtggtggctcatgcctgtaatcccagcactttgggagtctgaggtgggcagatcacaaggtcaggagtttgagaccagcctggccaacatggtgaaaccacatctctactaaaaatacaaaaattaaccaggtgtggtggcaggcgcctatagtcccagctacttgggaggcaggagaatcccttgaacctgggaggcggaggttgcattgagctgagatcatgccactgcacaccagcctaggtgaaagagcgaaactccgtctcaaaaaaaaataaataaaataaaaatacttcatccctttcaaaaagcaatttggtgatattatcaagatcccaagggctgggcgtggtggctcatgcctggaatcctagcactttgcggggctgaagcgagaggatcacttgagtccaggaatctgagaccaacctgtgcaacatagtgagactgtgtctctacagaaaaaaaaagaaaaaaaagaaaagaaagagagctcatttaacctagtaactacctcctgaaaatatattactcattagcaattaatttttttaataaaaggaaaagctatttgtgtatattctttataactgtggcctttcttgtaaaagtgaacatttggtagtagcgtatatatccagcctgaaacttttggtacatctaccgtatacagcttctataaactatacaaaagattattatagaaaaagttttgtgaaaaacgaaacttggaagtttgtaggaagatgattctacaaatgataatcgagtgtgctcatgagactggaaggaaaataacagaatgagtagagtcatgagggtaaaatactctatttctccaaagttctgtaatatttcatattattttattgttactgtttattttatgccctgcctcactccaaagtatatttgatatgatactgttttctagataataaaacaatgaataaacgtagtgagtgactataaggagattcattattaaatgcatcagaatgttttgccttaacctgaggatggaagaatttatgatctgagtaattgctcaaaggttctttgttgtcacgtggaaggctttgaccttgattttctgatttaggcattcctatagactcagctcattataaggatatgtaatttgcatgctattttatttattcagtccttaaattccatagttgtttaaaacaaataggaagatgtcttagccgagcacagtggcccaagagctcataaccagcctaggcaacatagcaagacccccatctccacagaaaattcaaaaattagccaggcacaatggtgtgcacctatagtcccagcctactcagtaggcttaggtgagaggattgcttgagcccaagagtttgagaatacagtgagctatgatcatgccactgcactccagcctgggcaacaaagcgagaccctatttctgaaaataaataaatagaaagatatcttatttctctagttcaaccttcacttgactggagacatccacgccatcaccgctgccaataacttgctggctgccgccatcgacacgaggattcttcatgaaaacacgcaaacagataaggtgagaaggatgccttgctagccattttgggtattgtatcctggaattcctggattcttaaggagtttgtggaaagaattctggtgtctgcaaactctgaaatgttattcaattcaattttgtgatttttacatatgtccctgtttcccaaggagaaggagccatcctttgatcagattctcaaatgggtttatgagcactgccaagttattgggagaattgtagtatgttgtaaaagccaaatattctctaagatgagtctttagttttaaagatggtaggtagaccagttctcttcattctggtcataggtccaatctctgatctgttctaaggggattggacagatgtcgttttaagactaatgttatgtggagctattttagatgtgctgaaaagatgtcagagacccttattgggcttcatgtgcttgtaggttaagagttaaaccacacccccaaaggggacagcccaccagaagctaattcctcacagatataggacatagataaaaggggtaccttctggcacattttacaacaagggtcctcactttctttaattaaagtagttccttagtgagtctttgctacataatccagatacatcttcatatggtagttgtagcgatatagatcaagaaatatatttatgcaaactctttgcaatgtgtattatttcagatcttgtcagttttatgaaaatgacagaatttaagtcaacattgtttatattagcccacaaattttaatagggtcttttatctaaatagttcggttataaatgcaatgaatttttgtcatatcctgtgaattgtccaagttcatggacaactaacttttgtgtggtctcatttttgttttgtgtttttaggctctgtataatcggctggttcctttagtgaatggtgtcagagaattttcagaaattcagcttgctcggctaaaagtaagtttccagttagcaattctttaaaaagaaaatatcgtagaaacgcatcagaaagattgtcaaagcctgaaattttcaacttggtttgattttggttttcagatatccttttgggtattaaactctatagagaccgaacactggagcagagagagcacagtgttggaagcctgaaccctggttctacacgaaagagccaggtggacaaattaattaaccttttttggtctcagtttcttcgtctatgaaatgagaggactgttttgctaatttatgagtactctagtcaactgacaagttagctgggcacaggagcacatacatacctgtagtccgagctactcatgatgctgatgtgagaggtttgcttgagccaaggagttcaaggtttatagtgcaccatgatggcccctgtgaatagccactgcatgccagcctgagcaacacagcaagagcccatctcttaaaaaaaaataacaaattagaatttttggtgagtccttctctttctaaagtgaaatatttttatgaaatttgttaaatttctaggaaattataggataacctttgaaaactcatctatctcatttgtggttttctgttttgttttgttttgttttttgagacagagttttactcttgttgcccaggctggagtgcagtggcatgatcttggctcactgcaacctctgccttcctggttcaagtgattctcctgcctcagcctcccaagtagctgtgattacagacacgcaccaccgcacctggctaatttttgtattttcagtacagatgggatttcaccatgttggccaggctggtctcaaacgcctgacctcaagtgatccatccaccttggcctcccaaagtgctgggattacaggtgtgagctactgcgcccagcctcatctacgtttttgttgcagcaaacactacaattatacttgcgtatgccatcttaattcttaaaacctgtcttatcttttttctgatgccatttgctgcctctggtcttctaatcatattgcttgctactagccctgtttcagagactaaaaaataaccctaaatggtataacttaacaaccttactggttggtattaagtggttttaaaaattcacctcctgcctcttactgaaccaagttcagtgtgttgaattagtgagtaattccatcctcggcagctataacaacatgcagtttctgtttcccagatcttttttatgcttcattaaaaatcactattttgccaggcacagtggctcacgcctgtaatcccagcactttgggaggccgaggcaggcagatcctgaggtcaggagattgagaccatcctggctaacacggtgaaaccccatctctactaaaaatacaaaaaattagccgggcgtggtggcaggcgcctgtagtcccagcttctcgggaggctggggcaggagaatggcgtgaacccaggaggcggagcttgcagtgagccgagatcgtgccattgcactccagcctgggcaacagagcaagactccatctcaaaaaagaaaaaaaaaaaagaaaaatcactattttgtgtgtgtgtgacagtcttgctctgttgctcaggctggagtgcaatggcacgatctcggctcgctgcaacctccgcctcctaggttcaagcagttctgcctcggccttctgagtagctgggattacaggtgcccaccaccatgccagcgaattttttgtatttttagtagagaaggggcttcaccatgttggccaggctggtctcgaactcctgacctcaggtgatccacctgcttcagcctcccaaagtgctgggattacaggcatgagccaccacacccagccaaaaatcactttcttaagatgttttatttacacaaaataaataggaagatttcttggcttggtgtggtggctcacccctgtaatctcagcactttgggaggccaagacaagaggattgcttgagcccaggagttcatgaccagcccaggcaacatagcaagacccccgtctctacaaaaaatttaaaaattggctgggcattaaaagttttaatttttttttttctcctccataaattaggaataacttactttgaaacataggaataaacttaacttgaattactggtatttgtatttgaaaaactaaagaactgcggcatcaattatatggacagacagcagtttatgtctcttctgagcagcgtacatggtggccacatagagcagcccaaggagcccctggctaacgcagccagcagcaggcacaagtggtagttagctgtatgctgtccactgcaggacatcttcagatcaatccttttcagagtctattacgaactcacagtatcttactcgtagaagaaatctggccataggtatttgtctgacttggcctaacctataattcactcaaagttcagtttagtttagtttttttttgtttgttttttgttttttgtttttttttgagacggagtttcactcttgttgcccaggctggagtgcaatggcgcaatcttggctcactgcaacttctgcctcccaggttaaagcgattctcctgcctcagcctcccaagtagctgggattacaggcatgtgccaccacgccaggctaattttgtatttttagtagagacagagtttctccatgttggtcaggctggtctcgaactcctgacctcaggtgatctgcccacctccgcctcccaaagcgctgggattacaggcgtgagccaccacgcccagcttagttttgatttttgttttttggtttttttggagacagagtcttgctctgtcactcaggctggagtgcagtggcaggatctcagctcattgcaacctctgcctcccaggttcaagtgattcttctgcctcagcctcccaagtagctgggattacaggtgctctccaccatacctggctaatttttttatgtatttttagtagagacggggattcaccatgttggccagtctggtctcgaactcctgaccttaggtgatccacctgcctccaccttccaaagtgctgggattacgggcatgagccaccgcacctggcccagtttagtgttttttttgttttgttttgtttttgagatggagtttcgctcttgttgcccaggctggagtgcaatggcacgattttggctcaccgcaacctccgcctcccaggttacagcgattctcctgcctcagtttcccaagtagctgggattacaggcatgcgccaccatgcccagctaatttttgcatttttagtagagatggggtttctccatgttggtcaggctggtctcgaactcctgacctcaggtgatctgcccaccttggcttcccaaagtgccagtttagttttttaaaaggctttaccaatcatggagaaaataaaattagagggataattttggtgaccctttgctttctgtttcttctcaaacttctcaccttttttcttcttaatcattagaaactgggaataaataagactgatccgagcacactgacagaagaggaagtgagtaaatttgcccgtctcgacatcgacccatctaccatcacgtggcagagaggtgggtgctggggagatgccagcaggctgatggccaggtggggaggcgtgttcgagccgaagcgcttaaattcagaaacttacagtttgatcctgtccagtgatcttcccagcctgtgcttcatattcccaccatttatttcagttactattatcgtaccaccctcccttatccttgcctccaattaaaacaaaaattctgtccagggtcaatcccatctactcctgtgtcttctaaatttccaaggaaaattacctaattttctcttctgtttctctctcctttggcctcttgtatctatattaagaaaaaaaaaaagaaactttttttaaagaccacgcctccctggctttgtcctgctcctcctccacccaccatcccaccttcttctgttcacttccttaccactggctctcggcagctctctgtgtgtttccagtgctggattttcctccaagtctgatatgtgctttcacccacttaacgaggcatcgctccactgcttcacatgcatccaggtggagtccccgtgagctccccaccacctcgacttccctgcttccctctcagttgtgaagtccccttccttctcccacactgccctcagtctcatcgctcactatgggatgagacagagggaaatgcactaaacaggaagttaggagccctgagtgtgtgtctcccctgccactgactcactgcatgatctcgagcaggtcgcatgcatgttcttggcgttggagatggagatggtcacatacgctgcacagaaacacggcaaccacattttatgaaccctgtgcaactgcagaaatgttcaatggcatggatccctgattcttcctggattattcttctcatacttgtgccctcatttacctctttatgctcacatttggaacatatttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaatacgtaatttccatcaccattttcataagtgctgtatcgtatacattgagtaaagtggatctaaattgtcaatgtggacagcttgttatttgaagctgcataaattaacaaagtcagtgtactggctttgttttgttgcattggtattcactaaaccaaacctaattttcacaaaatgtaaataactgcaattcttgttttgttttgttttgagacagggtcttggctgggtgcagtggctcacgccagttatcccagcactttgggaggccgaggcaggtggatcacatgaggtcaggagttcaagaccagcctggccaaaatggcaaaaccccatctcttctaaaaatacaaaaaattagccaggcatggtggcaggcgcctgtaatcccagctacttgggaggctgagacaggagaatcgcttgatcccaggaggcgaaggttgtagtgagccaagatcacgccactgcactccagcctgcatgacaaaaaaaaaaagagagacaaggtctcacttccatctcccaaatgggagtgcagagacacaatcatggtcattgcagcctcaacccccaagactcaagcaatcctcccacctcatttttgtattctttgtagagacaaggtctcactgtgttgcccaggctgttctcaaattcctaggtgaccctcccgcctcagcctcccaaagtgctgggaggtgtgtgccaccacacccagccaataactgaaattctaataagccagtgaagaaaataaagagaactggtacttgctctattcaccattcacccccgccaccccccacaattctactttatttacttttgctttttaaaattgtggtaaaatatacataacgaaatatttttccccatttgtaagcacacaattcatggcattaaatacattcacaatgattgcactatcatcactatctatacccagaaccttttcattatccccaacaaaaactccttatccattaaataattactcccctcttctgcccctgcctattctaggtgcctgatataagtggactcatatagtacttgcctttctgtgtctggcatatttcactatgcaccatgttttcaacatccattcatgtatcaacatgaccttcttttatagccgtctaatattccattgcctgtctgtgccacattttgtttatccattcacctgttggtcgcttcctccttttgactattttgaatagtgctgctatgaacatgggtgtacagatatctgagtgtctccttttggttctttcgggtaatgccaagaagggaagttgctggttgggtttttttttttttttttttttttagagggggtctcactctgtcgcccaggctggagtgcagtggtgcaatctcagctcactgcaacctccgcctcccaggttcaagtaattctcctgcctcagcctcctgagtagctgggactacaggcacacacaaccatgcctggcaaatttttatatttttagtagagatggggtttcaccatgttggccaggctggtctggaactcctgacctcaaacgatccacccacctcagcctcccaaagtgctgggattacaggcgtgagccactgtgcttggcctctagtggatttttttgtttgtttgttgtttatttgattctttctctatgtctacccactagatggtcagcttgggggagcctgaccttttctctttcaccctctgcaacttcctgagcatcagaacaatgccagacacacaccaggtggctggtccatatttgtcgactgaatgactaatctgttctctttcagtattggatacaaatgaccgatttctacgaaaaataaccatcgggcagggaaacacagagaagggccattaccggcaggtaggtggtgctttcttcccgggtgtggctctgttcttacgttcatttctactggcctgggagctcactctttgcctttcttgtctcatccccaacctgttgtggccagtggttctctcactgttttgggtgctcagcagggctgggagaggatcagaagacatagaggctccagtgtctttttaccatcttttctatgtatgtttatttcattttctttttttcatgtatgtttccaattgtgtttccaggaagagccactcagggtattctttgaatataaattctcacttattttattgggaaccatccaggtaatactacatctgcataactgataaatgaaaatctcagacacattactcaaatttcatatatcaaagaacaaacacctagttattagacttaatagcatgaggattttttaaaggataatggcttattaatacaaaaatggcttattaataaaatacagagaatgcagaagaaaaattatgtctgacttcattgtaatagatattggatgtgcgtcaatggcacttagggaatacaaattaattcctatgatttttcatccaggcacagtgggcttctaaattgtgttgtgtttttttttcttttgaattgattataaactgtacatttaagaacagttttagatttctgtcctttatgttaagtttttattagtgaaaaaagagtcaccttactataataaccaatccttacgccaaatagacttgtgaccttttgaagtgtcttgaattaaaaagtgaatgtaggtattggattaagaagagaaacttaagttcgtggacctcgtctcctcccagtcctgtaacttacacacacacacacaaacagatttcaaatatccatgctagcaaactggaatcattgccatgaagttttagatagttctgaaaaataggaagatggaattagattgatgattaaaaggacagcccaaaatatggtggacttccatccttaacaagcattcttgcttttcatgttcttagcctctcctgctaaagtgggagctttataaaagcagaggttattcccctttttatttgctgctgtgttccctatgttcagaacagaactttgttacatatagtcgtaagtgttcagtaaatatctgttgaacaaatgagtagaataagtaaaagacaatttatggatacagaactaaaatgccaacataaaaagatgttcatgaataatcataaaactgcaaattgaaacaatggagtatcatttacctaggagcttgtcaagtgaaaatagtaggtactaaatgctagtgaggatgcaatgaaatgggggcatttatgcagcgttagtgggagtagaaatcctttttggatgagtttgttattactaaaatttgaaatgacccaacaattacaactttggaactaaaaatattttaatgaaaagaacaagaaaatgtgtaacgtacaggaaaaaattctgtgtattaggatatttgttgtgccattatttgcagcggtgaaaattggaaacaatccaaatgtccaacagtagagatggttgcatatatttggtccgccattttgtcccatgggagagttgaaattaataaatgtgcgtatgggtgtcttgacatgagtagagagctctcatacaccattggaaaggttgtaaaaaccattttaaaactttgaagtaaaatactgatattgtaaacctgtttatgttaagaaaaacccagcgtgtttacttacattataggcacttacaacttatttgtgtatataagtgcctagaatgaaaagtagaaagatgtatgccaactgttggcattagttgcctgtgtaataaaagcgagtattgaaaaggccctttctctgcatagttttttactgtttaggtactggagagatggaagattcacagtggccttgatttcagtgcctactctgtgcattgtattgatagttccattacatatattagcacagttcatttgtaaagctgatttgcaaatgaggaaattgggatgttatgttaaaaaaacttgcccaaggttatatcttgtgttgcttcgtgcatagatatttttaagtaaaaaggggttatagtgtatttaagagctttaactgctttttatttatcataagactgtagtgaagacatctttttatgtcgataaaggtagacctgtatcttcatttttaatgaccacatcatatctcatagaggtaccatagtagattcagccatttccctgttaatgaacatgtagagtgtttgcagtttcaggctatcacaagtaagctgtagtaagtatacacatatatttgtgtgtatacttgatactatccttaggatattattccagatgtgtgattgcagagtccaagaggatacaaatttccaatgttgacatatgttttgacattaacttccaggaaattcataccaattcacatccttgccaatatcccatattggcctttgtttaaatgtgtgctaaatccctcatttgccctatcgtgattattacacattgcatacctgtatcagaatagttcatgcaatccacaaatatatacacctactatatacctaaaaaaatgaaaaggtaaatactaaatcaataaatgtgtgataagctgatgaacaataacgttttcattggcatctttatatgattttgaaatattttatttgcaaaacagaaatgagcagccttccgctatgcacgtcatttagtcattaaagtgaatgacagtgatactttaattgacccagtgtgtttcattttttttatgctcaagatgtgaaattttgtaattgtaacaattacaaatgaagagcttgaatatcgattatatattattcttatttacacagctaatatttcaagaatgtttctagtctcatgttttgtacagaaaatctccatattttttagtcattttctcatatgcactgtttataatagaatggtagtatagagaaccctaaatttcatacaatgaaagaccacttatgtttggaatgagttatattgagaatgtaataattgaatatagttgtatttgactttcaggtaatattttttcactaaatcagtgactaatgcaatctcaaccaggaagtagccagaaagctccttatttccttcctttccttacttgtcagtgatggaaatggataataaaatgtctcataaggtgatcccaccagggcacagccattctctctctgcgtaagcttgaacttgtctggctcacactccccttgggaagaagagaattaagctggggcgtaatgaagtggttctgtccagagaaacattcctagtggctgaattatgaggaggaggaagtacacattcctgtgtcccttttattccatgttggacttcgtacaacgtggagccacagccaagagatgggaataggaagtcctagaactttttgcaaaaagtctgtgctctctagctttcactactgaaagcttcaagatctgatgtggccatatcctcctgggcagctgaaaattgagtctgtgccaccagttgactgggttgccctccctgctgtgttgagatccagctctgggaaagtagcctcacatgcaggaagccagcatctttcactgccccttatctctgtgccagacagacaatgcagccttcttgacagacctattactaacaagggaggtggcccgtaggctagtcattaattcatctgatgcatattgtatgcctactgggtctcatgctccgtgctggggattcagaagtgaacctgcctaatatagtccctgccgtcatggcacttacggtccagtggtagactgataatgaccacactagactgataatgacattagtaatcaattaagtctgagacatgctacaacagcaaaccatgtggtagtgctgtgagcgggtgtaacaggggtcctaactcagcccaccctttgctgagcagagcatggcaaagagcacattccgcctgggaggccaccctagggagcaccaggcacaaaccctgcatggtccagacacgcagaaaactgatgggattgcatgcatggccttttgagggtagactctctgggcctgtggttgcttcatggctgaagtccagctccttgtgggaatggccatcccactggcactgtcgctgaccactacctgtgtttgggctggttcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttggtgagtgtttccaactcggaagcttcagggagtggacggtcctcgttcttcgttaccagaaaaagaaaggttttcttccttttatcagtgagtgtaatgaggatacagaaaaagtttccacacacacatttcttccccgacaagcatgtttgcctaactgcttcctaatgttctcatagtcatatatgacgtgcttatgcctggctgcaacaaaaacatgtgaaatttatttcaggagctttccaccatccttgccaatcctgatctctgcttctgcctgggctggggaggagtcacccccctgcagtcacttggtgacttttaaaaaatgtaccttctatgcctgcctgaaattgagggcaaatcacctttccaaggaacagaaggaagtggctctgcttccatgaacaggaagataaagttaaaattggcacatttctggcaccagcctggcttattatttaatttggggccttagatttgggttttgtattataaaagcaaatctctgcctcaatcagtcttgcttttctagttcccctttgagtagttgtggtgctttctgtaaagcttccatggaacaccatttccttttttagtgctttttctaattggcatgctagtcttcttttcttcttcgtctttctggtataataacaacctttcctgttaacttttttttttttttttttttttctgagacagtctggctctgttgcccaggctggagtgcaatggcacgatctcagctcactgcagcccctgcctcccggattcaagcgattctcctgcctccgcctcctgagtagctgagattacaggcgcacgccaccacgcccagttaatttttgtatttttagtagagatggggtttcaccaggttgtccaggctggtctcgaactcctgacctcaggtgatccacccaacttggcctcccaaaatgctgggattacaggcatgagccaccacacctggccttttccagttaacttaaactccacatattccataggtgttttgtttgcttgcatttttgtatataagtgcatgggtgtggacacaggcctctaagatagccattactccaaatttaagtttactttcccatatactgaatctcctacaataatggaacttaaaatgcacactggtgattggtaagcagttgtgaacagagagaggcaaagtcatattttattaatttcaagggcttagggtataatttgaattctttttcaaagtgtccggattgtttttcagctgcttttgaagaaatgaatctaactcatctcagaagtcttgtcaagtaaattcaatagatcaacgtatgtcgcagcctatggaatacttagtataaaaattgaagagaaaaccctcaggttgctataaaagtgctgctttattaaaattaccaaaatctcactatttctatctaaactgacatactacagtttctgtctaaatacattgctctgtattttattaatttgtatggcaataaatatgtgtcaggaacagttttaaaacttaatcctcaaatactgcttccttaaatctatttatttatttttatttatttattttgtttttgagatggagtttcgctcttgttgcccaggctggagtacaatgccgtgatcttggctcactgcaacctctgcctcccagattcaagtgattctcctgcctcagcctcccaagtagctgggattatgggtgcccactgccacacccggctaatttttgtatttttagtagagatggggtttcaccattttggccaggctggtctcgaactcctcaggtgatctgcccacctcgacctcccaaagtgctgggattgcaggcatgagccaccacacccagcccttaaatgtatttttgtgtgagtgtatgataaaaatcttggatctggaacaaacccaaagattactctttttagttacctttttaaataaactctttatttatctttttaataaactctttttagttatcttttgtgtttcttgtttgcaaaaagtaactaatttattaaattgtgcttcatccagtgggagctattgagagttggccacccatagaaaattgagggaggattttaggaactgctgaaggtttctgccacatgcatgattctgatataccctggaagaatccatctgagccttccccacatggacacagagtgtggaatgctagcagcacacagagggtggcagagcttgccctgcacgtgacagcacaggcgctgagatgtgtcccagaaaaatgagcaggtagaagcctacctgagacatccaacagaaacatccctcttaacttccttcctcctttagtgttttgaatcagtttatttggttgggaagtgtaagcaaggatagtgtacagagaagtaggaaaactactcctcttcttccacctgctctgcattagcacaacaggacaactctcactgagccttcctgtcctgaagatttcttttttcttttcttttctttttttttttttttttttgagatggagtcttgctctattgcccaggctggaatgcaatggtgcaatctaagctcactgcaacctccaactcccaggttcaagtgattctcctgcctcagcctctcgagttgctgggatgacaggcacctgccaccatgcctggctaatttttgtatttttagtagagatggggttttgctatgttggccaggctggtctcgaactcctgaccccaggtgatccacccgccttggcctcccaacgtgttgggattacaggtgtgtgccaccatgcccagcctgtcctgcagctttcaaagtgaaccatcttcgtgtatgtataatgagtgggttgcattcatatcatgtgtgttttatacactgaggtagattccagttacgtaggaatatagttagtaatagtgtattcctgaaaattgctaagagtggttataaagtattctcaccaccaaaatgataactgtgaggtaatgcatatgttaattaactaggtttaatcattccacagcatatacttcaaaacatcatgttatacacaataaatacatacagttttatctgtcaatttgaagttaaggaagaaaatagattggattttcttacaccttttaaatgattaaatattataaaaatagaaaccaatcacatgagagaaacatttactactgttgttgataaaagtacggggagaatgtaacgcactttagagtgaggaagattctctggattctaccactgcatctgttagcgccatggcatactgtggtaaaatggcactgttttccgatgctatgtacagcaagggatagcgccctgttttccccccctagagctaccgttacaagcatttgcttatgttatagccttccaataactaatatgttgaaaacaccaagacaccacttaaggtctttacaaagtgagaaggaattgggaaaaaaagaaacaaaggccgggcacggtggctcacgcctgtaatgctagcactttgagaggccgaggcaggcagatcatgaagtcaggagttcgcgaccagcctggccaatatggtgaaaccccatctctgctaaaaatacaaaaaaaattagccgtgtgtggtggtgcatgcctgtagtcccagctactggggaggctgaggcagaagaatcgcttgaaccctggaggcagaggttgcagtgagcctccagcctgggcaacagagagagattccgttctcaaaaaaagaaagaaaagaatgtgaatattgacatcacattaaaaaataataacaaactttagccttgtggcctttttttggcacatgttttccgctagttctcatgcatcatccctattctctctcttctctgtcttttcttcatccaggaacagagaaagaggacttagaaggaactcaacccagtacttcctaggattggaaggaagctgccttatttcatgtataagtggcaccagcttgactgtaggaagagagatagcgtgaagcctttcacatctaaactagaaagcttttaaacgtggtagtttgttgagttattctctctctgtggaatgaatgatgtagagatggtgagaaatcagagtgggtgattttagacatttccctttaccctacttcattcctgctctgtacagagccttgtttctgttcttcaccttatttctttgagcaagagtaaagcctctgattatgaaaatacactgtgcataaatagccagaaaacacattttcttgcaatgaaagatttgttttatggaaaatctcataaacaccatcaaggaaggttttggaagaaggtcaaatgtccttcaaaatgctattaccccatcaccattcacatcttagtgtgactgacatccgttctcagctctggtggggagaggtggacagagacagcagcactgtcccctgtggcccagggttgcctgtggggacgcccacccaagaagcaggctggagagaagtgccaaggggttaaccattgcctggatgatattttgtcaggaatctaatgtttttctctctcctgtagggggtgacaggtgctttgacagttttgatgaaagatgcaataaaaccaaacctgatgcagaccctggaagtaagtggttttcttcttatagtaattgtttgcattaactggattgccacacaatgtgaacatttttagccaatatgaggcaggcatagagcatgcctggggcagcagtgtgctttgcaatctcaggcagaaagagtgaggatctggttaggaacctgtattagtccattttgacattgctacaaggaactacctgagactgggtaatttatgaagaagcatcagaataacttcttggccaaccaaaaaaaaaaatttttaagtgtattcatagcttctttaatataagtcatgtcttggcttaattgacccgagtagaaacttagaaagtcaatgtctgaggccaggcgcggcggctcatgcctgtaatcccagcactttgtgaggccgaggtgggcggattatgaggtcaggagttcaagaccggcctgaccaatatggtgaaaccccatctctactaaaaatacaaaaaaattagccgggcattgtggcacacacctgtagtcccagctatttgggaggctgaggcaggagaatcgcttgaacccgggaggcagaggttgcagtgagctgagatcgcaccaccgcactccagcctgggcgacagagcgagactccgtctgaaaaaaaaaaaaagagaaagtcaatgtctaacatttcaataggttgtatggccatgtttacaatttattttctgtgttcccttaatctctcataatcattgagttgtggattttttggtttgcttttttattgttgtttgtttgtttccaagcaaaatacaataaatgccaagactttccaggaaagcatttgccaaaggcaagtcaataaacacacagcatgttagttggtggtaaggtctggagaagaaaaatcagaggtcatgaggggcagagtgatgtggggtatgtgtgtctgtgcctgcccgcctgttaaagcagtaccagcacagagctgagtaaaccaagggggtgagccatgcacgtgtcttgaagaacatttggacagagggttacctttagtgcaggggccttgggcagcaaggtgttttgcaatttcagacagcaagagcgaggatctggttaggaacctgtattagtttgttctcgcattgccgtaaggaactacctgagactgggtaatttaagaagaaaattggtttaattggctcacagttctgcaggctgtacaggaagcatggctggggaggcctcaggaaacttatcatggtggaaggcgaaggggaagcagacaagtcttcacatggcagaacaggagagagagggcgaaggaggaagtgctacacacttttaaacaactagatctcatgaggactcactcacaatcatgagaacagcaagggggaaattcactcccagaatccagtcacctctccccaggcccctcctccaacattgaaggttataattcgacatgagatgtgggtggggacacagagccaaaccatatcagaaccaatatgacagaaatggggggattggccaggcacggtggctcaagcctgtaatcccagcactttgggaggccaaggcgggcagatcccttgaggtcaggaacctcgagaccagcctggccaacatagtgaatcccatgtctactaaaaatacaaaataaattagctgggcatggtggcacgtgcctgaaatcccagctccttgggaggctgaggcaggagaatcacttgaacaggaggcgaagattacagtgaactgagattgcaccactgcactccagcctgggcgacagagtgagcctcttatcttttaaaaaaagggaatagaaaaaaatggggggaccatttctgaaggtgcccagtgaggatgcagactgcaggtgtcccctgagctgaggaagggaggactgaacgcctttgaacaggtgtctgcagccccgggggaggggtgcaggatgcacaggtgccaaggccacacccttctgcggcaggttgtccttcccgtctttcctctcccctgatcattctgccagcatgcacgtatcctcagaggtaggccatcttaaaaagcaaacaaaaacatttcaaaaacctcctgcccccacctgcatcctcatctagcttctgcccagctcttgtctgtcactggggtctccatgttaactgacctcgggttccacctctcctgactgcccttgtccaggtcacttttcccttggagacaccaagtctttgttgctgtgccctcctcagagaagctcagcagagtttgacacagctgcccttgtcttccttcaggagcacctggttcctctggcgtctggggtccccccctccccaggcctgctcgctgctcctcctccgctttgctggcttctctgatgacccctcaccttttttgccccgttctcctccagaattagccaggtgatgactcccaaactcttgtttggaatatcatgcacctggaatttcagacttgcaggtatagttaccaggagccacgtgggtggggaaaagccatttcaaactgatacataaaccaggacccacctcctacctacttccttccagctcgctgcttccctgaaaccttcccagtcattcaaggcagaaacccgaggatgatcctagaggcctgttttcccttcccctcttcctgtgtccatccctgcagagttgtccttggttacatgactctgccctgtccacgatgctcaatgcctccctccttcctgctttagctgccagcacgccccacctgcacgagtgcagcagcctcccaaccagtctctctgctgctactcttttcttccaaaatactctctcctcagcagccatagagactgaaacctaatgaagccctgttgccttcctacttagagttcttccatgatttacccatgtttccaccccggtctgaaaagccctagggatctggctctcaccccttcccgctccttgtcccttatcctcatctctcatcctctgggggacctttgcacggctaacaccactacctgggccacttcctgatattctcatgtccagctccttcgcctccctctgttctcatgtcatgtaagcatcagctgctcagagaagccacaggaatgtgcagcccccgtccctctgctgtcattgcagtacatggcacagaatgctgagagcttcctatttccttatctgttttctgtatttctcctcccaccgagatgacagcaagaccttttccatcctgttcaccaccgtatctccagcttctagaaagtgcccgacacctattagaggttcagtaaagacttgttgaataattaagtgaatgtttattatttttactacattctcctaaaaatacacatttattaataaataactgaataagagaaaaaatacgaagtgatgtgatattccttcataacacttctccctcaaagatgaatacttattattagggataatcattttctttattgttgttgtttgttttgttttgttttgttttgtttttttgagacggagtctctccctgtcgcccagcctggagtgcaatggtgggatctcggctcactgcaacctctgcctcccaggttcaagcgattctcttgcctcagcctcccaggtagctgggattataggcgcctgccaccacacccggctaatttttgtattttttttttaagtagagatggggtttcaccacgttggccaggctggtctcaaactcctgacctcaggtgatctgcccgcctgagcccccaaagtgctggaattacaggcgtgagccaccatgccccagccaggataatcattttcttgttttaaataattctttttttttttttttttttgaaacggagttttgctcttgttgcccaggctggagtgcaatggtgtgatcttggctcactgcaacctctgccttccggtttcaagcgattctcctgcctcagcctcctgagcatctgggattacaggcgcccgctaccatgcctggctaatttttgtatttttagtagagacagggttttaccatgttggccaggctggtctcgaactcctgacctcatgatccacccacctcggcctcccaaagtgctgggattacaggcgtgggccaccacgcccagcaaatttttgtatttttagtagaggcagggtttcaccatgttggccaggccagtctcaaactcctgacctcaggtgatccgtctgcctctgcctctcaaagtactgggattataggtgtgagccaccgtgcccggcctgagcactttttaaaacataatctaaacctgttatttctttgctgcctaataaatcagagattcagaacccttaaaaagcaaataaaagtaagggcaataagacctgctgaggctgaggcaggagaatagcttgaaccggggaggtggaggttgcagtgagcagagatcatgccactgcactccagcctgggcgacagattgagacataaaatagactgagaccctgcctcaaaaaaaaaaaaaaagagtcctcaaactgttcatatacaggactgggcttgctagggaaagaagggggaattcttcagactactttacaaggacacaagaactcctcaacctaaacaaagtatgaaggtacatagacaagtttcttgtaagtcggaaaacagagaaatccacagtaactataatacatcccttaaaggataagcatgcatttgtaggaagcaaacaaagctttccatagagaaaccacttccaccagatgattatatggacttgggttttgtttctgcatctgtcacttggcaaatgaagataccatcttcaggatgttccgtgtcatcgatttcatttaaggcataggctgttttaagattactttaaaagatatggacctttttacaaaataaaacactgcattcacttaaaatatttgcagacgtgaactcttgtaccctgatcctatgttgtcactctgggttttatgtatctaatcattgactaggaatctatctcagcagataatccaaaaatctagtttgactagttggtagattatgctttcccgctcacatctgaacacacctggttgttagtctggtaggaggtcatcaagggccacatccttacaggttgccaggagaccagtagttcttaatcctgactgcacttgagaagctcctgggaaggtttaagaatattgattgattgatgccgggctccccatcagacccagtgaacgtaatgtctgaggataaggcttgggtatcatgtattgccagactgaggaagacttaagacaagaaaacagtgagagctgttaacattttcccacaggttagccgtgtgtggtgttgatggaaacttcacatgcgagagcacactgtccaatatggcggccactggacatgtggccatttcaatctaaattacctaaacttcaataaaatttggaattcagttcttcagtcattttagccacatttccatttatgcatttatttgtttatattttactgttcatatttaagtgcttagaactctggtaagctaacaattacttgaaattacttgaaatattaatcttatgaaatgtttgaaagggccattatggagaatattcatagcaagatagttcctgccttattttcctgagtgttctgcatgtaaaataaaacccagaactcaagataaatgtgtgtatgcctttgagttagtcatagaattttttaagcaacatgtttaatttgatgtactgtatcttatagctatatccatgtttgagtgtgcaagtgtgtgtgtacctgtgtttggaagtctaacaatgacattccaatatttttttctcaccaactccatactgggagttttaaaaccagagccctaatcttgacttaattattaatttcctccgtggccctgaagaattcccttagcctctctgggccttaaatttctggataaagaagttggctgcttcgtgctctcaacattatctgattctgtgatttctagctaaagctacatttatacaaaaatataaagtgcttttgcaaagtaaagagtagaatagtggttatcagaggcagtgggggatggagaagttgaccaaataatacaaaattccagttagacaccacctgtgtattcataaacatgtgtccctaggttttatttatttatttttatttattatttttttcatttttgagtcagagtcggtctgtcacccacactggagtgcagtggtgcgatctcagctcactgcaacctccacctcccaggttcaagctgttcttgtgcttcagcctcccgagtagctgagctgggtttacaggagcacaccaccacaccctgctaaattttgtatttttagtagagacgggtttcactgttggccaggccagtcttgaactcctgacctcaggcgatccgcccatcttggcctcccaaagtacggggattacaggcgtgagtcactgtgcccagccaattgtaatgatttttatggttaccttttcttgaatggaatcatttcttaattaaaaaaataaatataccttttataccatcagggtttaatttcattcttttaaaaaaatatagtgcatggcaacataaaataaggtaaataatttatttcatggtcattgaggcaactaacaaaatggtttaacaatattttggaaggaagtgactgtattctcacagttttgtctctcaggttcagcattaaatgtagaataacatttttctagaatccggagggaatttggtcctttgattgagtcagggtgttttgactgtctttgaaatattttatgcattaaatatgcagtattcataaaagctttcctaccccatttgccccaaattgatcttggtttccatgcttctgtttgtcttttgggattttgatttgctttttcacttctctaggggacacctgtgttcgtgcatgcgggcccttttgctaacattgctcacggcaactcttcagtgttggctgataaaattgccctgaaactggttggtgaagaaggatttgtaggtaagttatttcttttaaatttagttgttgtagaatattgaagaaatctaaaagctgatgactggaatggagtgatatccatcctgacatgaaacatattctttcaggcaccctctttcatagagggtctcaataatggaaaagccctaaggtctggtctatactcgtgaaattatgcttgtgcttgaatcatagagtctggtatcaagtacatatgggtttgagtataaactctgactcttgcaaactgagtgacattggacacattttaattactactgagcttcggttttcttgtgtgtaaaatagtgataacaatactgtatcaaaccttttagggttgttatgaaaactgaatgagatattttagtcattcagcaaatgttttttgagaacctaccacttagaaggcatgttagctagggatccagtggtaagcaaaacagataggcgcagtggcacatgcctcgctactcaggaagccgaggcaggaggattgctcgagcccaggagtttgtgtccagcctgggcagcatagaagaccctgcctctgtgaaaaaattaaaattaaaacaaccagccttagcccctgctcctgtggagcgtactgtctaatggtaattgaataagagaaagtgctcattgactgtcagccattactacccttactatgtagtactgataacttgaagtcgtgggtttatttccatgtacagtttctccttgttttttgtgagctaatataggagagattcccaaccagtagacttagaaatgttaattggtagtactgcacaccttttgctgctgtcaagttctttgcagaacctgttcctctttggcttttcttgcatattccagctagaaagaaggggcaactctcatagagtttactaagtcagtgccagccccagtctcacccacaatactaaggcagcaaggaaacaaaagacaaaaccaaaacacaggcattcatggaggagtcccttaatctgacatatgagggactgcattggcagatttcccatgctaacaggtaattcccattaaccacacgtatacctataatcggagacagcaatctcttctttcactcttatcatcagctttggatcaaactcaaaagagttattttattagaagagagtgtgctggacaaaagaacttggcactgcattttatgctcagacatcacaaagttcattcagtgttattgagactcttttaagaattccttgtggactggcagtcaggatcagatgaggcttggtggagctccactcctccatgatctgttttctgcagctctcatgtactttgctccttcggtagcaaatccactgcaagagtggctagacatactgtctaagtggatttgctcaattgatcgctgcctaattgtagagctaatggacgaggaggctgggtcagggcgggcactggaaagttgggtgcttaagtgaagtggtggttctgatgcatcagctctgcaaataaagtagcttctagaaggaagcactctattttatgctgacagagatctctgcccataccagttcttactttgtcaaacacatatttataaaatacatgttatcatggcagaatactttcaaagatataaactgatgatgtatgcaaagcaaacgagccctctgtgtgaccttgaacaagccattagcctctctgggtgtgtcccctgtagacattctcatctgaaaaatgagaagttggaccagatgaggagttggatgtggatgtgtagccgtggactcagagttagacactgtggaattggagccctgactggtagtgtgttttcatttctctagggctcaattttttatttaataaaaagaatacttctgtattttaatgaataggatcaagtgagaaactgctttgtaaaatatgaactatgttcaggtcagcaattatactaattctttctatgatctcatctagtctaagatgccgtaagtgggggggtttttcatgaggatgaaatctgtccgttgccagatggttcaaagggcaagccctaagtcagaggttttacctcaactgctttcaagtcacagataaccttgggcacatgaacccttctcttccttggtttccctacctgtaaaatagggctttggatagggcttccctctcgaaaggacttggtaggtttgaaatgaggcatcaatgagatcatggggttgagtcctggcacctgacacatggtaagactcaatccttcttggccactcctggctgtcattgttacccccactattgatacactactgatgaaggttacattttcttttttctttggatctttttattttttggatgattttatttatagttgttataaaatacacgtaacatgaaagttaccatcttcaccatttttgagtgtacgttcattagtgaagtacaccttcattgttgtgcaaccaagctgcagaaccgaagtcccatgcccattaaatattcctcattctccagcccctggcagtgcccttctactttctgtctcaatgaagttgactcctggataccccatgtgagtggaatcatgtagtatttgtccttctgtgactgacttatttcacttagcataatgtcctcaaggttcatccatgttgcagcaggcgtcagaattctcttccttttttttttttttttttttattttttgtgagatggagtttcgctcttgttgcccaggctggagcgcaatggcacaatctcagctcactgcaacctccgcctcccaggttcaagcgatcctcctacctcagcctcccgagtagctgggattacaaacatgcaccaccacgcccagctaatttttgtattttttagtagagatggggtttctccatgttggtcagtctggtctcaaactcctgacctcaggtgatccacccatatcagcctcccaaagtgctgggattacaggtgtgagccaccacacccggctagaattctcttcctttttaaggcggaataatattccatcgtatggatagaccatactttgtttatccactcatcctacattggacatttgacttgtttccacctttggctcttatgaataatgctgctatgaacatagatgtacaaatatattttaatgtctaaaaatcgtgctctatgatgtctaaatatgtgatggcaatgacttatattcacaaatacgtaccacggaactctagccctgtaatgttgaactctcccgaaggtggtgtgtccatgctgtggctctgttggaatgctggtggcaaagccagtgtattgcacagtgggaacggggtgtggtcaggagacagtgttccttgcccattgcttggtcaagcctgcactgtggggctcgttcattccttgcccttggatgaagtttataatagttccctctcattctcagttaatatctagtccctctaacacatatattttttaattcctctggtcactttcaatcataagaatagcccctaaaattaaaaatgcatatccagttgtatatcaaaaccaaaaactccaaatgtcactcagacttgagctcctctcctcccctgtctgggcctcctctggctgacagtgggaaggggaaggtggctgcttgcttctctgccacccttgtcttgcacttgggctcgccctggcccctcctaggttgaagctttggcatgaaatggtgcccatgtagcctctaccagcagacgtcctcacacttttggcagaagccccctgagcagtacctcatttagactttcctacctctgattccacacctggtctcgggtaccacagacctctgacctctggctggggacacgccctgagccttgccaactggtcttctggtcctcacttgtggcttaagggggaagcggggacgccaaggcgggtggatcacctgaggtcaggtgttcaaaaccagcctggccaacatggtgaaaccccgtctctactaaaaatacaaaaaaatttagcggggcttggtggcgcatgatgtaatatcagctactcaggaggctgaggcaggagaatcgcttgaaccccaggaggcagaggttgcagtgagctgagatcacaccattgcactccagcctaggcaacagagacagactctgtctcaaaaaataaaaataagggggaagcagcttcgcatgctcttcactgggagctgggaggggagctggatgtggcacactgataactttctttgaagaaattctttcccaggttctaacccgtcaacccttttgaagcctcaatgggctaaggcatacaaaatctatttcaaactgctttgcaaaccctcccaggtcagccagcaccatcctttggcatgtgagcaaattgacaccaatttgaggcccgaaacaaaagtgagacaaaaagacgttcatttcaacatccttctacagaagttaaatagagtaggcacatctgaggtgtatctgaagtctgagcaggaattcatgttcttcaaaaagttgtcgtttatagtagactatctttatgacctcataatagggaaggatctcttaaaatatgaaaagctcaaaccatagagaaaaatgtcgataatttggcctgcattaagaagtaaactgtatgtgataaaagatacaaggataaaaaacaagtgacagattggaaagaaacgtttgcaaagatagtagacaatgattagcattgagaatatgtaaaacactaaagactaaagactgataagagaaagacaaataatccaatacaaaaatagagaatttgaaaaggtgattcgcagcaaatgagcaatttggtggaatttctaggtagaactgaaaatgaacaaatgatttagcaatttcacttctatgtatactctggaaaagaagtagtcaaaaatatatttaagtcctttgaaataattgacttcagtacccctttaatgagcatttattaagcttctgctatatgtcaagtactatctgctaggagctgggaatcaaatatgaataagacaggtttcttgccctccagtaattgatgatgtgctgtgagagacaagaacttcaatggtaagtacaatgcacttgattaagtactatattagttaaggttcttaactaagaatttcaagggatgatgggcatctcttagatagaactgtctccatattactggttttgctgatttagtctaatttttgttctaacaaaaagcatacacaaggaaggaattattttgtctattctgaataattagtctaagataatagaatcagtagtccatttagacttaaaacagagtgacatttattttaaaaaagcatgaatttgcaaaacactttatgagaatttttcaaaaactgctgtgatcactgttgtggctgtttcttccgttagtcagcagtcctcatgggagttcacctaacttccatttacatgctgtaaaggcaaacagatatttggcatcgaattctaatcatgtattacatttaaaaaataaagcaaaaggaaagaaagaaaggaaaaagcagtattgagttcctggattttaaaaacattattatctcatctttaaactatttgtaggaatttcaaacttacccattaacttaggattttttaatttgttttctgctctctcagttggttttgattccagttttcagataaagatcttgtctttgcagaggagtgcagaatgcaattgtgtatccttataggcaggtgtcattaactgagggtcaccagccactggtggactcctggatagacttcgatctacaactctgtcccataattaaatataggttcgtgcatatggagacatatatatatacaccttttttttttttttttgagatggagtcccactctgtcttccaggctggagtgcagtggcgtgacctcagctcacggtgacctccacctcccaggttcaagcgattctcctacctcagcctcttgagtagcttggattacaggcgcatgccaccacactcggctaatttttgtattttcagtagagacctggtttcaccatgttagccaggctggtctcgaactgacctcaggtgttccacccgcctcggcctcccaaagtgctaggattacaggtgtgagctgccgcacctggccaccttttttttttaacctggagaaaattacacaattcttggattctcacaggggaccatgacataagagagagaaagaactgttggtgcatatctcaaagcctagctctacttttgacggtagctttcgatgtcccatacacatttggcatttattatccttatccagaggtgcttgtcaagaagctacctaattgattgcaactctgctgcttgctctctgtagagaatcacacagacctggctgtgttccccaggtgcttcctgggtacatgagcataaacactcatgcagcagaggagaaatatgagacaagtgcccaattaaaacacagggtgatctttgcctcagacatttcaggattaggatttagaaatcagaatgaatcgacttagcagttccaagacaaattgaatgggattgggaaacaaagccttgttaatattttcattaaaaacgcccccgtttctgagccattcctgagcattagaccggtgctgagactatcatataccttctcactcaatccttaaaaccgtctgtgggatcagtgttactatcctcatcttacagatgatgtaacagaagcttagcaagatgatgatacatgtccacgatcaatcagagagtaagtgacagaggacgtgacctgagggctcctcctcgccaaagcttgtgggtgatcaggcggctattgtgctcagtgtttttctcaatgctctttacctggttgccaccctctcccattaaaaaataattttagctgggcgcagtggctcactcctgtaatcctagcactttgggaggccgaggtgggtggatcacttgaggtcaggagttcgagactagcctgaccaacatggtgaaaccctgtctctgctgaaaatacaaaattagccgagcgtggttgtgggccctgtaatcccagctacttgggagggtgaggcaggagaatcgcttgaacctgggaggcagaggctgcagtgagctgagattgtgccatcgcactccagcctgggcaacaagagcaaaactctgtctcaaaaaaataagaagaattttgggtgagctgtctacagcagatggtcacagttacaggaagtaccaatataactatattgtaccaatatatcgtaatgtgcgccaacagtggtggtcctttttggtcctttttttcttttctgtgttctactttaacatttcttcctcccaagtaggttactgattgaagatgaccttatcgagtcccactgtttccttgctctacctctcaacctgtatttttgggggacagttttttaatttttttattttccttttttgagacggagtctcactctgtctcctaggcttgagttcagtggcacgatcttggctcactgcaacctccgcctcccgggttcaagcgattctactgccttagcctcccaagtagctgggattacaggcacgcaccaccatgcccggctagttttgtatttttagtagagatggagtttctccatgttagccaggctagtctcaaattcctgacctcaggcgatccactcacccctgcctcccaaagtgtagagattatagctgtgcaccactgcacccagcctaggggacagttttataatcagtcttcttggccttcagaggactctgctggtggctatacccagctagtggcttgttctctctttccacttttattgccctgaaattctaaatattccatcattttggtagaagaaaaccagaccaaactaaacattctcatgatttcatccacctttaaaaaaaaaaaaaaatctgacgtcaagtgatcctgcagctctaagctgtaattctcccagaccttgccctgtttacattatttaaaaacactgatctcagcctgggctccacttttgttattatgatgcttccaggttttttgtctttagtaaatttattcataattaaatcaaggttgagaagtgctggcttattagagactctggctgaaggtcatgtgcgaactcaggaaactgctaatcacaggtcgtgtttttcagcccctgtcttcaggaaggcttaactctaagggagggttgttttgtgtcatctccagagctctcatttctcctgtgtggcttggtgccgaagctcattcgtcccctcgctgtctgttcggcccttgtcctacctcccctttctctttccacgcttttgtgtaaagtagccctctttcaagctgctcctctgtcctttgaaaacaaatgaaaaagcaaaatgttcttcatatacactaaacaggaaagtatgcaaagtaatgttacaaacacccatgttcccaccactctgtttcatcaaaatcttaacatgtcgctgtgtgtcctttagtttttttgtttttttaaagagatacgtttagctgggcatggtggcgcatgcctatagtcctagctacttgggagtctgaggcaggaggatcaattatgcccagcagtttaattctcctgggcaacagagtgagaccctgtctctaaaaaaaaaaaaaaaagaaagaaagaaaagaaaagagagaagagaagaaatcagatattagagacacagttgaagttcccgtggaccctcctgatcccgttcttttttctgcttctctcctgatttgagtgattatcgtttccgggtgtgtgtttctactttgaccacacacatatatgtacactagagatctgtagcggaggttctcagactttctctgctcgtgaccattaatggcccagcaatttttttcatggtaccgcccgggcaagagaaatacctaacatgtccatttattaaataggtccaaacaacttaatgagtatttatgtccttacaactaagtggccacctgaaaaaaaaatacatatgaattcgaaggaaaaaataacatcatttcatttttaaattaccaccatatgttatgaatgagatgtgtgtccttgtcaggcaccagacaacttctgaccctttgtaaccagttgacacccgcacctcatttcctgttccacgttgattttcacacgatttttgcattttgctgcggtacctgccaaaaactttgctttgcaaatatatgatgtcatggaaagggatgtagagcactattgttgaagcagtgaaaaacctcacatgagtagtatttgcagtgtccaacggatgtcctgtattaccgcgtttccgtcaaaaatttaaaataccccacggtgcctctgagtttgctgcaatgcctcacggcacctcattgcacattagaatcacagatgtgcggcttttcttggtattttttatgtgttttcaaattttatatattaatagatattaactgactgcattgttctctaatgaggtcactgcactttttctgtaaatggcaagatcataaatagtttgggtcacagagtctctgtcccaagtactcaatttagaaagcagccataggtaaagcatgaattcataaactagtccatgtttaggaatgagtctggctgtgttccaacagatgttattattggttcctaacatttgaatttcatataattttcacgtgtaataatactcttctgatattgttggcaacattttaaaaggtggccaggcacagtggctcatgcctgtaattccactgcttttggaggccaaggtgggaggattgcttgagcccaggggttcaagaccagactgggcaacatagcaagatcccatctctataaaaaaaatttttaattagccaggtttggtggcacatgcctgtagttccagctactcgggaggctgaggtgggaagatcacttgagtccaaaagtttaaggctgcagcaagctatgatcacacctagctacttggtaagctactatggacaacatggtgaaaccctgtcttgaaagaaagagagagagagagggagagggggagagagagagataatactttttaaaagagaaagaaagaaaagaaagaaagagaacactttttaaaaggataaataatttttaaaaacttaataatttaacatgtaaaaaaaaaaagatgtagaccatatacaaaacccagaggcacctggatttgtcctgctagccatactggccaacccctgctctataacttgatatttttgtgcaacataacagttttgcatttctctatgtcactgtgatccaaaaagcctcattttgcctgcagtttagccttctgtgcgtgcatgtagcacgtgcatttgtgcattatttgtcaaggggctttcagattgcttccagtgttctgctgttacaaataatgctacgggggacattcttgtccatgtctctgagatttagtctaaaaggtcttctagggactatatacaggagtgagatttggggggttaaaagtacgcttagcaacaacttaatagataaagccaaattgttctgcaacgtaataccaatttatatcactaccaattgtgtgtgtgagatttctgacctctccacgtttgtcctgacacttcttttttttttttttcttgagacagagtctctctctgttgcccaggctggcgtgcagtggcatgatctcagctcattgcaacctccacctcccaggttcaagcaattctcctgcctcagcctcccaagtagctgggcttacaggtgcacaccatcacacgtggctaagttttgtatttttagtagagatggggtttcgccaagttgaccaggttggtttcaaactcctgacctcaggtgatccacccaccttggcctcccaaagtactgggattacaggcatgagccactatgaccggctgaacgcttctattgttagatttttttagctcttgctaatctgatggtagttcattatagttgtgagatttagcatctttatggctgtttctgggcatttgtgaattgtctattttgtattgtgctatttacctttttcttactaattaatggaaatcctttatagattccgaatacgaatactttgccattatgagttacaaatatcttctcccctgtatggcttatcttttaaatatgcttgttgtaccttttcttgtccacccttttctttatgatttctgcttttggaggttataaagataatcatttgtattgccttataactgttgtctcttgcattgaggcctttaatcatcttagaatttgtttgtgtaatggtgtcttttttccttaactcttacagtttgtgagacttttctgccctggtgatatgtgcatcagtggttgttagcccagccctatgaaaagggccagctggcctccatagatctaaggcagccgagagtgctgtcccctttgtcccaggctctgcagcatccaaggcgagtgcagatggggccagctgttcttccaaaaccatcatctcttctttacctgctccttctgagcttcacctgacatggctgtgcagtccccaggaaaaagaaagtctctcttgtcttcctacttcctaagtcaatcctaggaactgttacgttcaattccaagcagttgtcataaaagaagtttccttggaactttgaaaacaaaagaaagggtttaattttcttcttttcgttttgttttgttttgtttttaattttttgagacagagtctcgttctatcccccaggctaacagctcactgcaacctctacctcctgggctcgagcgatcctcccacctctgcctcctgagtagctgagactgcaggcacaatccactacacccagccaattgttcaatttttttctggagatgaggtctcactacgttgcccaggctggtcttaaactcctgagctcaagtgatcgcctgcctcagcctcccaaaatgctgggattacaggcatgaaccactgcgcccatccaaaaggatttaattttatggtcaaattctacattgtctattgactttaatatttttataaaattctttaaataaaatgtctttacctggaataccttcaatgtacttactggattagaggcaggtaggtcctgtttgtatggctagtatgttcattaaatatgaaagtaatggaaagatgtttatgacataaggagagaggaaccttcgcctgtcaggataatagaaattgaaagatttttatgacctggctcagcagaaaaaggagtatatgatgttagcaattttttagaattgatttttcagaagaaacatgcaaaacaaatgagaattaagtagctagaaagcctttttcccccctttattcagataaagtaactgaagacttttaatgagaagcctggtttctgtctttctacacggtgcactgggaatagtaagctgttagaagtcagtgcttagaagtacctaccatcctaaacacaggaaccaaaaacaagggaaaaaaaaaaaaaaaggaagataaataaagtaaaagtaaaaaagtacctaccgtcccaaattttgtatatgatgatgttcacgtttttgaacttacacatattcttctgtataagtaaaatatttcataaaattaaaaatgttttataaaattaggaacagaatttcttaaagatcaacatggtactaatacatcttacaatctgtctttcaaagtttcaatagacttaacttagagtcattttttaaattgcattttgatgccaatataattcatgtgtcattttccgctataatacaatgaaaatccagataatggagatggattttcttctgagtagccacgcatattaggtttcaggctccaattgcctggttttgaattgctctttgccatgtgctgtctgtgaccttgggtgggtcacttcacctcccccaaatctaggtttctccaatacctacctccaggcttgttctaggcatgaagtgcagtgatgatggagaaggcatggactgtggcacaaatagaagagtcaggggttggcagctcctattcccactgtacgatgccaaggatctttacctataggataagccttcagaaacataatttggtctttcaagtgctgaatacctctgtgagtatacttttttccatcttttttcttttggtaaatgaaactcactgagaaatttgacttctgataatgggaaacagtgctgcttatgtgttctccttgtacaaaggtgtctgggaccattatacttagaggtgatctgagaaatcggaggggctctgattgttttgaaaactctcctttgaggtcgggcacagtggctcatgcctgtaatcccagcactttgggaggccgaggcgggtggatcacttgagaccagcttggccaacatgatgaaacctgtctctactaaaaatacaaaaattagccgggcttggtagcatgcatttgtaatcccagctacttggggggctgaggaaagagaattgcttgaacctggaaggtggaggttgcggtgagccaagatcacaccattgcactccagcctgggtgacagagtgagactctgtctcaaaaaaaaaaaaaaaaaaaaagaaagaaagaaaaagaaaactctcctttgaattaaggtaatccttcttgaaaggcttgtttaaaatgtttccttgttacctgggagagagcaggaagcactgggaaatagcacgtcactggtgcctcgtgccatttccgtgcctttccctgtcttgcctcagccttgcactgtggaatgcaaaagagtagaagaaactccaacgtgaaaattgtcgacaaacaatgcagagaatcttcggtggcattaaacattaaaattaaagacacatggtcttaaattcagctgatatacttgacacctcagatatactcttggtgccaaaagggatgttaagcaaaatttgagggatttgactccttatttgggaaagaccatgactaccaaggggagagaaaccagaggcaaaccttattgaaaaatggagtagctaagtcattttgtatatgttacttttacccagccaagtacagtctgtagttttacacagtgaatttgatctttactctaaattcttttcctttaatgaaagtgctagtcagtaatgcagaacttgggcaagttttataaatatgtttgctttacaaccagtcttattaagtcagggtatcatctaagggcccaatcaaggacttttcatttaaaaaagaaaaactctaaattgcattgtgatataacccttaaattccaactgtcatggggaatcccaagacctacatctgtatgtatgtgctgtgttctaaacactgctccccaacctttttggcaccagggaccggtgtcttggaagacaacatttccgtggttttgggattaaacggttccacctcagatcataaggcgtgggtcctagatcccttacatgcgcagttcacagtagcattcacactcctatgagaatctaatgccactgctgatctgacaggaggtggagctcaggcagtaatgctcacttgcccgctgctcacctcctgctgtgcgacccagttccttacaggggctgcagaccagggggttaggggtctctgtttttgtttttttggagatcaagtctcactctgtcgcccaggctgaagtgcagtggcacaatatcggctcaccacactcttcacctcccaggttcaagtgattctcctgtttcagcctcccaagtagctgggactacaggcatctaccatgcccagttaatttttgtcattttagtagagactgagtttcaccatgttggccaggctggtctcgaactcctgacctcaagtgatctgcccccctcagcctctcaaagtgctgggattacagacgtgagccaccgcgcctggctggggacctctgttctaatatgcttaccatgccaaatgcattatgaagaaaaacagaaacaaggcttttaatgttaaagtcttattttctcgctactgaaataggcaaaatgtttcaattttgcaaaaataatatagtattgtgtataggatcttccctaacctgctttttacatttaattaggcttctacgagtcattcgggtagttgcatctagcaggctatttatccattctttatagaccctttagaggtttgagacccctttatagaggtttgagagccctttcttgccccagttctcttgtctgtaaagctgtaggaaataatatgacctaacatacaaggcagtgtgaggacagcagaagtgacttctgtaatgcatatggtgctgttccaggcatggataaatctttgctaacagtcgtaagagtttacctcctgtgaggacctggctacgtgctgagcaccctgcttggtgctttgtacattgtgactcattcagttgctcaaacaacaccatgagtagtttaccagaattacccccatcttgcaggtgagaaaactgagcatccgagtgagttagtagtttgctcaaaggcaggcagctagcgcaagggggagcaggaatttgaacctgagtgtcggccccacagcctttgcttttaccaccgtgctttgccacctctgaatgttcactttcattccatagcagcatcatacagccctgtgcataacaggaagtgcacgtttgttaaatgagaaactagtaacacttctggtagctgaatgacttaactactggtaaacctgtctgcatggccactaggctttttatggtgaacacaggcatattttccatgtgctgtgttgaagcagcaattaaataaatcaggtaaaagagtaattaaatttaaaaggtaaaacgttttggaaggagttttgaggtttagggctgtctaacctgaccttgactgtttctctatgtgctgtaagatgcagattgattttcaatgagatattcagcccatccctgcttatgatttatatatattctaagtaatatgcttagaatgtagttctgcttaccatcataaaatgtggagttaaaataagatccttgtcaaaacattgtcatgcagagattagtgctatgaaagttaacattaaatgattttaaaatgtgatccagaggttaaactgaagttttgaaattcataaaatgcataagctttttgagaatttttaaaaatatccgttacataataactttaaaattacgttatatgattgctatcttaccccatcttagccaagagcattcagcctgaggatactcaaaaagagtcaaattaccccttccttgtataagctatagtttaggatattgcaattatatgaggtcgttttaaagtttttagcaacgtttggtataattacaatattgtgctgttcttacacaaagaaaacataacagaattttgagctaggaatattgggaaaccagccattgctaaaggaagatgcatttagtgtatctttctatgtacctcttaacatcttttgtggggtgtagaaaaacagattattagggctttctttttttgtggggggggcgggagcggggatggagtttcactcttgttgcccaggctggagtgcaatgatgtaatctcggctcaccacaacctcctcctcccaggtttaagtgattcttctgcctcagcctcccaagtagctgggattacaggcatgtgccaccacacccggctaattttgtatttttagtagaggtggggtttctccatgttggtcaggctggtctcgaactcctgacctcaggtgatctgcccaccttggcctcccaaagcgctgggattacaggcatgtgccaccatacccagctaattttgtatttttagtagagatggggtttctccatgttggtcaggctggtgtcgaactcctgacctcaggtgatctgcccacctcagcttcccaaagtgctgggattacaggcgtgagccaccacgcctggcctattagggatctctaaaagccgcaagcctcttgctagccatagctgtgaatgttgtcttaaccattaatgcttcagtataaataatatcaatttaaaagctgcctaagatttaaaagtactatgcaaattacaaactgcttgggtatctagatcaaaataaagcagagcaaagaagtaactttaggaatgaaagggtatctaagtggaatgataaaggaagacttcatgcaacagaagaatttaagtaaaactgaaaaactgaaactaatgtgatcatggcattaaatagtgtaaccctgaagacgcatccagtatataaggaacaccacagcagtgcctatactcaccgttattattcatcattattctgaagcatgaataagaacaatttcaaaaattataaatattggaaaggaagagacacattttattatttatgtacagaataattatataactagaaaattcaagagaggcaactgacaacttattttaagtaataaaagttttagtttgctagtggatgcaatgtaaatatgtaaatgtcaatagttttctttttttgttagccataaatacatactgtaatagagaaaatgtcctacttatacatgtcccccaaaggatagaatacttaggaaataagtttagcaagaaatgagcacatagaataaaactataaaactttattgaaagacaaacaacaagacctgaataaatggtaagacacatgacatactcttagatgggaataactggtattaatcatccttcctctgtcaaactaacacctaaattactataaaattactatactatatcatgccacactatactatactgtatttactgtaaaaactgcagaggaaaatgaacttcgtggttaaattaatcacagcatttgtctagattctgcaagaatgaattcatgaggatggatttaaaagctttttcaaggccgggcgcagtggctcacgcctgtaatctcagcactttgggaggccaaggtgggcagatcacttgaggtcaggagttcgagaccagcttggccaacatggtgaaaccctgtctctactaaaaatacaaaaattagccaggtgaggtggtgcgtgcctgtagtcccagctacttgggaggctgaggcaggagaatcgcttgaaccagggaggcagaggttgcagtgagcctagattgtaccactgcactccagcccggcgacggagtgagattctgtctcaaaaaaaaaaaaggctttttcaagaaccatgatggatgattaaactaattgtaagtatcagaacaagataaccctatagcaaaacagttaatagcagaggaataccctggagtgtcctgagatagatttcttccagtagtaatttgataagatgacattttatttttatttttatttttttcttttcttttatttttttgagacagagtttcactcttcttgcccaggctggagtgcaatggcgtgatcttagctcactgcaacctccacctcccaggttcaagtgattctcctgcctcagcctcccgagtagccgggattacaggcatgcgccaccatgcccagctatttttttgtattttttagtagagacagggcttcaccaggttggccagcctggtcttgaactcccaacctcaggtgatccatctgccttggccttccaacgtgctgggattacaggcatgagccactgcacctggccagatgacattttaaattagtggtgaatggatgggatactgattaaatgatgttggaacatttgactaataattttaaaacataaaccatagagtttgttgttgttgttgtttgaaatgtagtctcgctctgtcacccaggctggagcgcagtggtgcgatctcagctcactgcaacctccgcctcctgcgttcaagtgattttcctgcctcagcctccctgagtagctgggattacaggcacatgccaccatgcctggctaatttttgtatttttagtagagacggagtttcgccatgttgtccaggctgctcttgaactcgtgacctcaggtgatccatctgcctctgcttcccaaagtgctgggattacaggcatgagctgccatgccctgccaaaatataaaccatagagctttgtatcacaatatattcaaaataaagatagagtgactttttactttttagtgtgcaaattaaacataaagcttccaggaaaaagcaaaaaaaaaaaattattgttggtatcctatcaaggctagtaaaaagaatagataaatgtatacatggaacatgggaaaacattcacaaaatataaagttaaaaaaatcaggttgtaaaataatatatctccaatttgtatgagatttatatctatatatggaatgaagagatatagaagtatatcaaatgattatttttgtttgcctggaggtaatggaatcatggtgattttcacttcacactttgtgatttggcattctcaaatttttacaattactgtgtattacttttgtagtagttttttttataaaaggaaaaaatgacttgaaaaatcaagtaatttgacatgtagacacagggaaattacattcgaggcagagagcaaacgacaggcatgtgactgtagctgacaagtgtcagcagattgtgggcatagtttagagtctaagacatctgggggagatgagtttcatcattagatgaagtcatattctggaggggaataaatgctaatctgaaatactatgctttcaattgccagtgaggagaaattgacagttttgaaatagtggtttcaggaaggctctcctgagaagatggcactgaggcgagccttgaagaaggtgagaggggagaaagattggcctgtgttcaaggaatcaaaatagttcgctagttcagagacagggtaaagcaaatagactggagtctcattcaatgtctttaaaagtcatggagaagagttagtatagtttctaatccatgaggacttcctgaatgattttgccaggactgtactttaagatactgtttctttccaaccccccatcagataagtcataccacttttctgaagtcgaataagtgaagggaaagagtggacaaattgttatctaacagggctccctccccaggaaaggactccttcgtcagtaagagatgtgcacgtggtataaccaacaatgctacttctgggtatgtccacactgctggagctcagaaatgcacaatgaaaaaacaaaacgggttgtggaagtgtgtatacaatctgttacatttttgaaaaacacataacacaatgctatattctgtttatgcatgtgtgcttatgtagaaaaagtctgaaaacctgatctgcataagctctgagttcataggagttatgaccatgggaagaagtagaggggtgggatgagcgcatgggatactgaactcagctatgctgctttacttctctgaaagaggaacaatcttaagtaatcatggtaaaatgttaatgtttgtccatttcagggtggggaaggaaatttaggtctgtaatttaggagagaggttgaggccagagccaagattggcagttgtgatgagtatgtggttacatcttcactttttttagaactaaatctggatgtcaatggccatgtttagtgggccaggggccttacattactttcttgcagcactgatggcttttgtttgaggctgcacaaattcctgcatttcccttgggttgaatggtagggatgcgggcagttggtgactgggtgaaccacctgacttgagcagggctacgactctctctgcaaacgaaacccagagacatgaacagtgctgagatttctcagtggtttcccatgtaggctgctttccaagggcagcaagcatggcttcatcactcacccagtgcttctgattcagcactgtgatgctcggttaagttttaatgaggttttaaattttttcgtatgtttgagtgtttatgcaaacaaagatgctgaattgtaaacaccagcaatctgagtaccttcttttgatttctctctccatattgtttagtccctttttctttgtttgttttatgaaattgcatagatgttttggttgagagtagattgtttttacttttcagggacaggcaacaatttcatgatataacttctaaaaatattttaaacaagtatgaaaatagttttttcttccaaaaaaccatttcttcatttggcacatacacaaacaaatgagcagaatttagagtaatttagagacagaatttagataatttgggtgggtttttttttggacagtcttgccctgttgtccaggctggagtgcagtgatgtgatctcggcgcaccacagcctcctcctcccaggctcaagcgattcttgtgccttagcctctcaagctacaggcacacaccaccacgtccagctaatttttgtatttttattagagacgagtttttgccatgttgcccaggctggtcttgaactcctggccttaagtgatcctcctgcctcggcctccttaagggctgggattacaggcatgagccaccacagccggcctagtgtgaaagcagtttttaaggacagttgaacaggaaagctcctggattcctgcacatagatcttgtgcccctccaaagtgccgtaagtaccgatttctgctgtcttgatttaactcagtgtctggagcttacgatccttcctctctgtttccttcagtggcgtagcttgggggtgtcaattaaagagttattgcaagatctcagcctctgaaagtttagcttattcatcagcaaaactttaagcaagtctcacctcttctaaattagaattgtaaccttgactttagtctcagagttaacattgtgcagaaaaagaaaacactgcgcagtgttgaagcagtttgcaaactgaaatgatacaaatgaaaaatgctatgatgtttctcagtagtctctgtatttgcaaatgagtcagttaggattagttttacccacaaataacaacaacagtaaaaaaaaaaaaaaaagaaagaaagaaagaaagtgacccagcactataatacaagtttatttctctctcacatcaaggaagttcagggtagccagtctgggctggtttagcaactccttgatcatcatgggttctgtgctacctggtagtccaggatggttgcacaagctccagccattgcatctgtatcccaatcagcaagaaaaaggaagaaaggcatacccccttttcaggaggcttcctggaaatcacatacaacatacctggttacatctcatcagtgaccttagtcacacagccatacttagctgcaagacaagcgaagacattcagattctacctcttcttcttgaaatagaaaggtgagttgccaatccactgtcagcgtgacgacagttcaagaggttttcctagacacagagttgagttaatcccgtcatctgtgtcatcgtctctattttgacagcatctgtcaggtggtcaaccagagtttaggcaagaagacctatgacttctctacacagacatgattaggattatcttctaaatcaaccaaactgaccagcccaccctttcattcttctgtgcatcacagatcatttttgaaaaagagtttaggacacatccaatagtaagagtgtagttttataaatcaggactcagtcttacagtggaagattatatggtagttagtgtcatggagaaaagcttcatattagattagttgaatcgattgggatacagaaccgtctttagagcatggcatcgttacattgcagataaagcatgtaggtagagaatgatatctttgttggggagagccccaaactgctcttcaggaacctttctccgagatttgcaagccaattaggcataatgaaaccttgtttttaatgcatatcttttgccagtataataaacataataattaaatgtttatatatctttcgtattttcctgtataatacaactaatcatatttttgtcaggctgaggacatctcaagaggagggaaaggtggcaaattgagggtctgttcttcttttataccagatggcaattataacaaattacttctggacttagggatgggggaggggtggggagatgggaacatgagaattattcctgatttttgttactttttgtcctgtaaaatatgcttaccaggccgggcacggtggctcacgcctgtatcccagcactttgggaggccgaggcaggcagatcgcctgaggtcgggagttcgagaccagcctgaccaacatggagaaacactgtctctactaaaaatacaaaattagccaggcgtggtggcacatgcctgtaatcccagctactaggaagggtgaggcaggagaatcacttgaacctgggaggcggaggtggcggtgagctgagatcacgccattgcattccagcctgggcaacaagagcgaaactccgtctcaaaaaaaaaaaaaaaaatgcttaccgggacatctcaaggacatcattcctttgtcaacggtacaaagataacctgagacataaagtgaaaatgatttatggttttttgttttcttccttacattaaattttccaataacatatcgctaataacatatttcttttgttttgagacggagttttgctcttgttgcccaggctggagtgcagtggtgcaatctcgactcaccgcaacctccgcctcccaggttcaagtgatttctcctgcctcagcctcccaagtagctgggattacctgccaccacatcaggctaattttttgtatttttagtagagacggggtttcaccatgttggccaggctggttttgaactcctgactttgtgatccacctgccttggcctcccaaagtgctgggattacaggcgtgagccacggtgcctggccaacatatttctaataatatattaatttgataaacagaagttattttggaaataagccaaaacaacaaaaaatgctcatccctgcttttcaaggctattatctgtagtttgaggttttatcaaatgtagatatgaactgcgggcctcttcaggatgtcctcattgcttctgttaatgcttttaccatccagtaccactgaacaggcagcagggtgccttcttgggcacaccggaaggacccaggaaaaggaagatagtgtggcctgttcttgtctccatgccccaaaatggaccactacaccagtggggtaggaaatagcaggtgtgttatgggttgagtttggagaccttgacttgatcaaccatctgctcacccaggtcatctttcctttttttgcagaggtgaggtctcactatcttgcccaggctggtctcctgggctcaagtgatcttaccgcctttacctcccaaagtgctggtattacaggtgtgagccaccatgcctggttcttgtcaccattcttaacatcagcagcagcagaaaaaccccctgtttagccttcaatgttaatttcctccttgatctatgtgttctacacaaaccactcccttgttgtcccccatatattacatttgtggactcttctcaaactctgcagctcagccctggttcctgctgagcctacagccccaggcctgagcagccggctgggccaagttaccctcagtctcaagatgacttcctcacaaggcaaaacatttctccagctgggttggagacctaagctggggaactgggctctcacattccaagatagaggtttgcctatggacccctgaaagtaggcgtgtagaagcaggttcctctgatggcagaggccctctgtttatctctgaaagatcctgaatgctatgcttctttcatcccctctgccttgaattcgcctgctttctaggtgcggtggagaaagctgggaaaagagccacctctgctcccaggggccactgagagggtagaacactgaccgaatcccagactcactacctcaggggctgagatgggtccaaaggggcccttaacctctcacttgatcacctgactcttaccgctgtcattgatctgacatgttctcctgggcgctgtcccagctctgtcccagcttctcagcactgtgtcctggtcagccctgagggctcatttcctttatccatactgaggaccaagacctgtctttcctgtagggcagtgagggccacgggctagtgcctgagccgatgagtgcactgctggtactgtgctgagccctggacaagggtgtaggttgctctaaaaaacaacttcccaatattctacaaaataacgttcaaactgaacagagcttgactgaagattcttcttacttcatttgttttcatgctacatttttgctgtccggctccaagtctgtgacaatgggtcacgggatcagtgcgagtaacagtgaagatgtttttcttcatctttgggctatgattgtgctttgtgatcctaagtataaatacattgaggctgggcacggtgtctcacacctgtaatcccagcactttgggaggccaaggcaggtggatgcctcgagcccaggagttcgagaccagcctgggcaacatgtcaaaaccccatctctacaaaaaaaatacaaaaattagccaggtgtggtggtgtgcacctgtggtcccagctgctcaggaggctgaggtgggaggatcacctgagccctggagatcaaggctgaagtgagttatgatcgtaccactgcactccagcctgtctcaaaaaacaaaacaaaaaaaatacatacactgactaataacaccagcaatattgtttcatgggagctgcctctgctgtttgtaccaaaactgagcagattctttaggccaggcccgagtaatcattaaatcgatctgcttgtgagaaaccggtaggtctaggcatgagcacaaagtggcaggtccgtctcttcccttcttaaataaggaatcaccagaggtagactctgtgcctgtgactcttgaatgtttaactgaaatccagagcagcaattgcattttatatgacaccatgtgtgtgcaaaaactgaatcaaaatcttgtgaaacagtgctactttcacttactatatatgatgtagtctaataattttctatcctattttatttcctttttttaaatgctggttgaaattctgtaaatttatataatgacaaactactgggactctatcttggttcaaaagtccatgatcagcctgcttgtattgagttactacattgtacgatcttataattgtaaagtttaagatattttccttctgtctgtcttaatttattctgtaatctaagttgtcctgccaggaatgctggcatatttactttgtttttgaattcaataatcatagtttctcttgctaagttacattaatggtaccaaaaaaaagttactgcatggtttttgaaactgttctttcctaggaagttttaaagtaaaatgtttttaccttttattgtttacacaggttaagcatccctaattcaaaaatccaaaatccaaagaagtgctcaaaaatccaaagttttttgagtgacaacatgatgccaccagtggaaaattccacacctgatctcgtgtggcgggttgcagtcagcatgcagttaaatctttcatatatgcacaaaattattaaaactattgtccagggccaggcacagtggctcacacctgtaatcccagcattttgggaggccagggcaggcagatcacttgagctcaggagttcgagaccagcctaggcaaggtgatgaaaccctgtctcctctaaaaatacaaaaaaaaaaaaaaaacattagctgggcacggtggcacacacctgtagtcccagctatttgggaggctgaggtgggagaatcacttgaactgggtggcagaggttgcagtgagccaagatcatgtcactgcactccagcctgggcaaacagagggagaccctgtcttaaaaaaatatatatacatatatatatatagtttaggctatgtctataaggagtatatgaaatataaatgaatttcatgtttagacaggggtcccaaccccaagatatctcgttatgtatatgcaaatattacaaaatctgaaaaaatttaaaagccaaaaatcacttcagtctggtgccaaccatttttgcataattgcattttccatgttgcattttgcaaccattttgcataattctgtacttctttcccttttgggtttgttttcataactgctcagtaaaaagtgttctgtgtcatctttccattattttgggctaaatcatgttaatggccaagcctgtcagaattcatttgttttgagttaacttcctggtgtccagttctcaggagttgcaagaatagagctcttccctcatgcaatcatccaaaatcccaggcctctaaccaggattggggaacaccactgttggccaagagcagaaggcttaaagctctggtcatagtcatggcactgtacaaactgttcttgttccctacaagaacatgggaactatttggataatggatttatgaatttaattctgatggatttttataaaggagctaaaaataagcctatataatttattacatgtataatcatataattttaaatgtgtataatttataatattcatcgaaacatttctttttggaaattaaatttcactttggtcaaaatcatcttacaaaacaagatgactcatgatggttctaaataatgtaaaccggtgtctgtaactaattaatgctctggaggaaggaaattctgagttctgacacaaaagcacgtctaagtggtattggtattttcaaagcttttactacaaccaaaaatatgttcacgtgtacctgtctcctctttacactgcttactttctctatcgcttttcccaaatacgtccccagtaacttcctcatgttctgtgcaccacctccaatcttcccctaatgtgtatgaacttggtcatcaccaaagaggtggaaaggaagaagggcatgtgctaatattaatattgaggtttgggctgggtgtggtggctcatgcctgtaatcccagaattttgggaagccgaggcaggtggatcacgaggtcaagacattgagaccatcctggccacatggtgaaaccccgtctctactaaaaatacaaaaattagctgagtgtgatggtgcacaactgtagtcccagctactcgggaggctgaggcaggagaattgcttgaaccagggaggtggaggttgcagtgagccgagatcgtgccactgcactccagcctggcaacagggagagactctgtctcaaaaaaaaaaaaaaaaagaaaaaaattgaggtttgtgccagtttctttttcctttaggtctcctgatatgtgtctagttagttctatatacttcctggaaattcgactccaagatatttaataaaactaaacagggttatatgttgaatagacaaatcctaaagagcagaaaggatttagtggttagtgaaatttcattgacttaagatgagttggatcctcaaaattaatatattctaaacaaagttctatttttaagctgcagtaataatgccgaatttctcttatagttaattgaatgatttatcctggtgttgtctcctggtagtcactgaaaaagtcattacaatcctcactttctcccctttaattcaagttcagaattcatgtgttgctgtgactttttttgagtttatctgcagacagctgccattgaataaacatgtttatatagggcagaaaaaggcagcctgaagattctactttctatttcttttagcactgtttggcagttaacaccaacagcgcttcagaatgaggtactgtccagcatacaccttgcttgttcctctacaaagcttctatttttgtttttgatttgttgtgaggaagcaaagtgtagcctttacttgaatgaaagctacagttttatttttctttcttatttacaagaaattcttttgatgattaagttagccagatacgccccgtgcgctcatatttcttaacctattttgagctgagctagttgcaaggactagttcttctgtgaaacctctggcagtccataaattcaagttcgtgtccagacgtaatggtgaactcaatatgttgtatatttgatatatgtttgttgcacacatggagagaaaagttgctaccattgtgaagtagccatgaaatccgacagttctaatttctttatcttctgagtacccatggaataaaggacctcttagtgccatagcaaggcagaagtttaatttgcaattctggtggcaacatccaggtatttcaagtagaaattaagaaaactttacggaaaaactatctcagcacttcagtttaactatttttcaaagtccaaggagggttttccccagtgtaaaagcagaaatgagaatttcagatctaaagcggttcttgccttttcttttccctccatgcacatgtgctgacaacagaaagtaaaatttgaaaagaaaacccaggctagagcattggggtcactcatttcccatccagcgaagggagagctggtgcctggctgggggaggttaggaaggcaagtcttgggatctgatcactcggctgggagtgggtaaaatacctggacctcaggaggccggattgcagcgccagtgttctctacctgtgtggcctgttcctgcctggggttgggtaccaagtccaggtggaagtggtccctggagcatcctctctctgaagtgtttctttgtcaaacagaatactccctgctgctgccccagaactcatcactgttgacacatggaccaagaactagcagaggaggtgatttataatctctaaatgaattgctctaaaagagacaacaagcactctgacttaagtaaaggaagggagggtgggtggaaaggaaggaggatcataaagaacattctagattgcatactttggtaatcacagcagggccttattgcagttagaacaaaagcctggacacacttacctctcagttcaggaaaataatttagagctacttgttaaatgctggagtattattgaagtaccaagtgttaagattttcactgaaagcaaaactgaccaagcagctcagctagggaaatgctatgtgatcagttgattgtttgatgaggagtatggagcagggactttggcagaggttgctagcagacaggccttggttttagtccaagctctatcgcttaatagctgtgtgaccttggggaaaattataaaattttccagtccttagtatcataaactgtaaatggaggagaaagatgcctcacagatgttgaaggtgaagtgagacaggacacctagtacattgcctggctacatagaaaatgtttcacaaatgttaacttgaggccctctccccatgcctcggtctcttagaatggtttttccccatcgtgtgcacattgagcggtaaggcggacagctgccgccgcccatgctgccccatgttgagagcatttctgttgaccttcccttcttccctgtgaagctggttcagcagtcacctcatcactgtttttcttctccagagagtgctgggttgtagcgaccatactgttgacgcaacacatcccaaccacgctggacggaatttttactgcgataattcatattccaggatcttacagtgcacagggttacaacgattagcataatgatcttgcacaatctttctgcctagcatgtagtgcattcgtaatattctcagaggaggcgtctagaaagcgccaggctccttcctcctgcgtgagccactgcaagctgtcggcgcctcagtgctatggagaccttgggtggattattccttgttggcggggggagggtcccagctgtcctgtgcattataggatatttagcagcatccttgctagatgccatttacaacaatcaaaaatgtctccaggcattgctaagtgtccaggtggggagcggaataggcagaaccgcctccagtcgagaagggctgaactgtacttaggatttgtgattctgcagaaatgggttctgtgaatgcactaaagcatgagaacatccaaaaatcagtgtggcacagaactgaattcaaatttacctggatccaggtaaataagcacaattttgaaagtaccaaacagaattcaagaaaaacaacaacaacaacaaaaaacacattaaaaacagaaaagttggccgggcgccgtggctcacgcctgtaatcccaacactttgggaggccgaggtgggcggatcacctgaggtcagaagttcgagaccagcccgaccaacatggtgaaaccctgactctacaaaaaatacaaaaattagccgagcgtggtggtgggtgcctgtagtcccacctactcgggaggctgaggcaggagaatcgctcgaacctggagggcggaggttgcagtaagccgagatcgcaccattgcattccagcctgggcaaaaagagtgaaactccatatccaaaaaaaaaggggggaaaggtcagaaagacgttctttttcactaggtgatgaattaatctttcccatctttgtcatgttaaaaatgtgcctgtggctgtttctccactaaatgaagacactggcacacagatgattgtgtgtaaacactaggcaagacactaggcacaatcgtaggggttcagtaattattgaatgagaagaaagaaaggttgttcttgaattctgtgatgtgagtgtttaatgatgtttttgaggagaatgccatatgtagcagacagaaccctgggctgggcatcagagggaccgggggcaccacactgggctttgtgtcattatctccagaaagtaactggcctggtgcacaggagaaagttagagtacattgtccatacagttcccacatagctgtagggttttatgaacccatattttaaagggccttctaatgaagtgaggatgttaatgcttttttttaaaaaaaaaaaaaaaaaaagagagagagagattggtgattactttaaaatctgagtcctggccaggactcacgcctgtaatcccagcactttgggaggctgagacgggcagatcatttgaggtcaggagttcgagaccagcctggccaacatggtgaaatcctgtctctactaaatacaaaaatcacgctcctgtaatcccagttacttgggaggctgaggcagaagaatcacttgaacgtgggaggcggaggttgcagtgagccaagatcacaccactgcactccagcctgggcaacagaatgagactccatctcaaaacaaacaaaaaaatccaagtcctaattatcgctgcagctttctttaatgtgtgcagtaaggtggggacatacagaataacttaagatgtagaaatcgtctctccctccctgaagaatatcatggatactacatttgcctgccaggaatgttgtgttgttctggtgttctcgtttctgccgttatcattgtttctgcttaatttttacaacacaactctggccgcacccgtggatgatcatggaaaggcagctgcctggctttccagaattgttttgactctccatctgaacccagagctctgtttcctgtacaggttgctagcagtatttacccaaattgtcccttcccaactcagacccactgacccttcctttctcagctgattacgggtttaagtttgaatcaaaccatgctatagaatcactatctagcagcttctgtgcttgcacaataagagtattagtcagcgtttcctgttttcattcatattgtaagttgaatagctgtaacaaaagggaaagagattgccaagacaaataattcttatggcttgtgcaaacaatttattacaagccttattaaatatgcagctttcagaagtctacgtgatatgcctttcagcaaagctaaatcctactatgtggacttgcttcatgacttaagaacaagtctatattgaatttaacattaaataattatttggcctgtatctcttttaagctttgttaagaactgcaaatatgataagggaataaattgctcatttcaagtcactaagaaaacctaacctataggttatatatgttggcagttcccaagaagtacctaggaaatggaaccttcctataagagtggtttgtccccttctcacgagatgggtcttcatatcaaggccccctaaggcacagatacacagcactccacagtgtccaagttcgtagtaattggtggcaccttattaaagtagtttttactttcataattactgattacacatcagcataccttttccatgttctgtttccttggcagcctgatatttgaatacaaacgacataaaagtgattacatgcagcatttcaggacagttttcaaactgagagaatttggcactttcttttattttcttcccattcttcgtctatttcctttgcatttggaagccaaactcctcgaacctttacttctgcatgttgttttcgtcccctagctagagttctctttattactacttttttgtttccaattggtctctttttaaaaataaaacatggtgaaaccccatcaatacaaaaattagccgggcatgatggcgggtgcctgtgatcccagctactcgggagactgaggtgggagaatcaattgaacccaggagacggaggttgcagtgagctgtgatcgtgccattgcactccagcctgggcgacaagagtgaaactccgtttcaaaaataaatgaataagtaaattaaaatatgaaattaagcttagctagcctgtgtagatgttttagatggtcatatctttatcggatatgacatttatgcctttcagtaaaaccattgtagtattgtaagaaaaaaagggaagtatgatagggaggactaagaacatatttgtacttctatgtaatgctattttatgtgtctatttccattgaagtgtggccttgacatcactggctcccaagtcccatcctgttttttcattgacctgcttgtgccaggtactgcgttaggaagtggagctaccagatgaataaggcgtggtcccgccctccatgtgggagacggcacgtcagtgtacttaggatgctgcatgtggtgacagatgagggccctgcaagggagcacaccacagggccgggagggtgggatgggcgggaggagtagccaactttgcccgaaagcatcaggacaagcttccaggaaatggcacatccaagctgagtcttggacagcgggttaaagaggcagagaggggagagaggaatgttccacatgggaaaagaggtctggaggtgacaacaagtaacatagagtatgtgggctgtgccggaagcttgatattacagaggcacgaagtctgaggcagggagtgtgaaggaagatgaaggtaggggaaggaagtttacacaagggtggccttgacttttatattaaggcactttagggaagcaggaaccactgaagacaggagaacatggtgactacacgggcgcattgaaggggggaggagctaggtttttgaagggaatttgagcttgcaatttttcaagggcattcaatggttataaatgaaacttttcattaatatatttgtgtccaagtgtttttagatgtgcttttctgctactctctttttatttggtttggagatagatggtgactttccttcagtgccttctatgtgtcttgacatgttaatgtctcaaacacatggtccgtatcatcatggagcttgcaatctaacagggtagtttaacacataaatatgcatccagttggaaagaacttagagatcacttgatcagcccccgttatgtaaaatgtatgcaacaatctacctccaactatagggcgacattaaacagtttttcaaaataccatggcattgaaaaaaatgcgtaacatttgggttacttcagtcccactccccggtactaatcaggccagtgaaccagtcttgctggtgaaataatgacttctccagtcatgatggatgatttcccttcatcatgaccatttcttccctggctctgcctttacctatgaatctcttctttcctccctctccttcctcctcttggtctctgcctgccatacccaactccacatttctctgcttggaaaaatcctacttgattctcagagcctgactccatcaccccctctctccaaccctcccaggcaaactccgtccctcccagtgtgccgccctccagctctctctagttgaatagcagatgttctctctcccacttccctgcagggcttcagggtagtgaccctaagagtgagcttctaccagtgagaaaaacgcctggatggagcaggaattcccacaaatgcttaggaattcaatatgatttttagcaagtgggagaattatccttttggttacaaagatgtgaactatttttgtgagttctcagtatgcaccaagaaaaaccccagtgactcagtaatgtacctgtgccgtctcacttaacccttccaacaaggaacttgccaaggtgcacagctgggagggatccggggtcccgtccgtgtgctaacctgcaggacagcgccgcataatccagtactggggccttattgtccagccttccacctccaggagcccactcagtgatgacttttgacaaaagtcacccggattatccctcttttggggtccatgatgccaccaacggctaaagttaacaaatgcattaccaggaggtaccactgaggtaaggattgttactgtaagtgattttctctgattttgaccactacaagtaaaatcacaagatttgtcccaaatactatataaagaggaatgtcttttatttctcgaaattgttctgccactttgtttgttcaaataacacataataaaggataaatggcttgtagctatatttatccaaattgaacatttttgatgtaatttttttaatttgtcaaaagcatatcaatggtcataaaaattttttatgtcctctggccctattaccttacccttgggaatttattccaagaacgtaatttgaaagagattaaagcacataggcacaaatattttcagtgcagtattgtttatattggaaacaacccaaatgttcagtaacagggggaacaattttgtaaatcttgctacagcaacttaacaaaattataagctgccacttataattgtaaattttgaaagtttgtagcacagcaaggaaactgatcatgttaaatgtttctgatatcttagttaatttttctcccgccagttccgatcggtgtcctggtcataccgtcagcatataagtatgtatttcataaacatttactttgtattaactcagtagtattcccttcctagagtggtttgcttcccagattgtaatggacaatcatctcacctggggatcttgtaacaatgtgattctgattctgtaaactttgtggggagcccaagattccacatgtcttagaggctctcagatactgctgatgctgttgatcacgaatcacgcattgagcagcaaggtcctagagctctttgtgtatgaagaagatactactgacccagtgcctcgctatcttgaaaggcagctgtgacctttctagcaactgagggggtggggactagaaacgagtgttttctggtgtttctctaataaagctgctgtcttgtatccagattgaccatcagtatccttatgcccttcaactaacttgaaatttgtcagttaacagaaattactgggtggcactaaaataaattattcttaatataaagggtaagaaagggtcgggtgtggtggctcatgcctgtaatcccagcactttgggaggccaaggtgggcagatcacctgagatcaggactttgagaccagcctggccaacatggcaaaaacccgtctctactaacaataaaaaaaaaaaattagccgggtgtggtggtgggttcctgtaatcccagctacttgggaagctgaggcaggagaatcgcttgaacccgggaggcggaggttgcagtgagctgagattgtgccattgcactccagcctgggggacaagagcgaaactccatctcaaaaaaaaaaaaaaaaaaaagagtaagaaaggatcttccattgtaatcatactatcattgccttttgaaacaatttggaacctgattacaaagttgaaaatccccatctgtatgaagaaaagcttcactggctggtcaccttggctcaacgcctgtaatcccagcactttgtgaggctgaggcgggtggatcacaaggtcaggagtttgagaccagtctggccaacatggtgaaaccccatctctactaaaaatacaaaaataaaaaattagccaggtgtggtggcaaacacctgtagctactcaggaggctgagtcaggagaatcgcttgtgcccgggaggcagaggttgcagtgagccgagatcatgccgctgtactccagcctgtgcgacagggcaagacaccatctccaaaaaaaaaagcttcactgtgagttatgatatgggaagaaaagtcttggcctggccaccacaaggaatccctcaggcctggcggtgggaagcagaggagggcgcagtctctttagggcagaaagtgaagaacatttctatgacaatggggaaatcagttcacctttgtgttggtaaacaaaaggaatgtaagctgtcctttgagctcgaatcatagtggtgattgccaaaacctacctttgtttttagaagataatagcacatattccacttgcttccccacagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaagtgcccacaccgccttcctaataccaaagaaatttcattatgttaaaacagaattgagcatttgaaaaattcctgcccatttaatgactatagttttctagagtatttttcttaaaactttttttttcctgtagacctccctcgtggacatctaaaacgttttttgttttgtgttgttttttgttttttcccaacaccaccatagggcactttgagtttagtaagttcgagtaaacagtaacacccacagttctttctaaacaatattttggaaaggagcataatgcaaccactttttagtctcaagcttcacatctgatactcaggccaagattgtataaccatatggtaatgggaggttagaggctcttgtccctgaacgaagaacaagaggattagagtgagttctttgatgacagagatttttcattgtttgtacagatagtttttcggttcactgatgctgcaactcatcagatttcatctaaaactattttccttctctttctgtttattatgatttctcctcacaactctgttataatactggattgtttctaagagctttgcttggaaaacacaaattcgattttaacttctttaaagactttttatatttacctatcctaatatatatagaaattacagacattataaaggaaatatattcctttccacagaaaacctgtgcatagatttttgggggtttttttgttgttgtttgcttgtttgttgtttttttgtttcatttttaggaatttccaagtggagaataagacattttatactgattaatcattttgaaataaaataaaatttctctatcataatattcacatatgagacgaactgccaaatctgatttcttaattggtatactgtactgtgtatgtgacaaaagtcatatattcaatgattattgcatagtcaaaacaagtagcaggtttgccatcatgaaacgctgtaaagcaattctttctcctgggagaggtggacatgatttttataccattttacagataaggaagctgagttttgataggcttagggaatatggacaatgtcagcaggccagcagagagccgagaacttcagatctaaatctcctactatgtccaccatgcagagctggatgttaatgaagggcagaagttttctaaatccaaatccactcctaatacccgacacttaagcacttcatttttgcctaaagcttcatcatcatttcaaatgcaagaatgatataatacagattaaaagtagtaaatcataaagaattctgacttcactcaaaacaccccttgttgctacagtccttcctggattttagacattgaatctgtataacaacttctatttttaaaaactacttccgcccatgtaggatgcatttggaattctccctccctgccctgccaccctgaaaattatagaaagggcttagagattgtctgatctcattcagtctttataaagagaaaatctctgaggcacagggagacgcagtgacttgagtggtgtcacacatctatttcagggactgatcagatctacagtcctggtctcttgacatcagtcccatagttttccagactctggtctctgtcctgtaaaaattctctacatggtttacaatcctatttcattcatcttaacatatgtgctctgttattcagtggttgcactttcgtgccacattaatcctttgtgtctcttccactgctgcttaatgtcatggttctcagccagtgatcatggtaacatggaacagggttagtaggcacagatatgggtggaggataagaaaaggtggggaccagccaggcgtggtggctcatgcctgtaatcccagcactttggaggctgaggcaggtggatcacctgaggagttcaagaccagtggtggcgggcgcctgtaattcccactactcaggaggctgaggcaagagaatcgcttgaacttgggaggcagaggttgcagtgatctgagattgcaccattgcactccagcctgggtgacaagaacaaaagtccatctcaacaacaacaacaacaacaaaaaaaaaaaaaaaaaaaaaaaaaaaaaaaaccagcagggaccaggaagccctgtgaagctaggcatccctctcctgggctccagtagtaccttctgcctcacattgtttcatgaatgccttgttctgtgtctccctatgtaattctcaattccttgagtttagggactgtgtcttattaattggtatggtccaagtgtctggcatggtctatatgcagggagtgttttcaataatggcaagataaatgaactttcatcctcttaatcctctattccatagtgctcatctcggtgtccttccttcatattgaatagctctgtatttttgaaccatgattattcatttctacttctgttttcttttttcttttttgctacaaatactgcgctgggatcgacttccttttgatcattacacaaataaccatggctgcctcttatgtttattcagcttgttttttttccataatttgtacagtggaaaatcttgtggcccttgaatttgcccattttaaatttgccctcagtcattttaaactcacatcctgtcccccagagtgctcggccattcccagtgcaatccaataactaatattgtgctatgctttgggatccacagattctttcacaattagatctttaaactaaccattgtatgaatcagcattcttcacacatagaaccaataaggatgtgtgtatatatagagaaagatatttattgtaaggaattgggtcacatgattacagaagctggcaagtccaaaatctgcactgtgggctggcaagctgaagacccaggagaggcagtggtgctaatgcagtctgaaggcagcagtctgctggagaattctcctgctctcaggggaggccagtctttttgttgtactcaaaaaggcctttgactggtcagttgagacccacccacattatgtaggacaacttgcctactcagaggctgctgatttccatatcaatttcatcatagacaccctcacagaaacacgcaaaataatgtttgaacaaatactggacaccctatggccccagcaaagttgacacataagattaaccacaaggccaggcacagtgtttcaccctgtaatgccagcactttgagaggccgaggtgggaggactgcttgagcccaagagttcgagaccagcctggggaagatagcaagacctcgtctctacaaaataataaaaaattatctgggtgtggtggtacacacctgtattcctagctactggggaggctgaggcaggaggatcacttgagcccaggagtttgagaccgcagtgagctgtgattgtgccactgccctccagcctggacaacagaactttatggcaattaccgtaaaatgatttcgaatggtgatgtactctgtataaatcaagtattaaacatattattagttttatgttctaatttgaaccaatgtttgagaagtttcatactgttccattggctcaaattagaatcatccagggagattttaaacattactgatcccaggttcccctcccagaacttctgctttcattggtctgggtggagcccagggatcagtgttttctaaaagcttcccgcaggagtttaggtttagccagtgctgccagctactgttttaaaagcacaaaacatagaggtacatttctaaaaattgaatgtgattatgttgttctttctttcagatcggttgtgtaagcatttttataggattattcttcatgttttctctccttatttcaggtaacggctggtgttcctcttaagaaagaatatacagaggaggtaagaggagctgtttagatgcttatgtgaagaatctcttaaatccagtgactcgttggctttcagtgaatgagccctccttcagtggcctcttagaaaagtgctgttctgtccgggcgcagtgactcacacctgtaatttcagcactttgggaggccaaggcgaccggatcacatgaggccaggagttcaagaccagccaggcaaaacccatggccaacatggcaaaacctcatctctactaaaaatacaaaaattagctgggcatggtggctcacgcctgtagtcccagcatgagaatcgcttgaacctgggaggcagaggttgcagtgagctgcgatcgcaccactgtactccagcctggacgacagagtgagactctgtctcaaaaaaaagaaaagaaaagtgccgttctaagaatccgagaggaaatggatgggatgaaaggataaaattcattcagttaactcttaaatatcaagaaaagatggatataggctttgtctactattgtgtactcccagggtagccatcagagcaggaactcaaggtctccaggtcagaaacaaatatgaagcttacacttctgtattcttttgtcatggaaggtctatatacagttggctttatgatttacaggagtggcttactcttttctgtaaatagactttgatttgctggcagcagtacctcttagctcctacaggtggcgccagggatctgagccaggaatacctggtcagagctcctcacccacctggggccttgtgcctgtcaggcctcaacctgcagagcatgggcgcattgcatagaccctgcagcctgtcctcagcagggtgagctgccaggcttcagacccacccatatgccattggatccagaatcattttagaaattattttgaagacgaacctctttattcttgcagccatctttcttggaggaaaaagtgaaaaaagatgtagcaaatcctgccagagaggtgctggcagtttagcttggcaggtttggtgggagacaatacacaggggtctgggttttgcttttttcttttttacagaacatccagctggtggcagacggctgctgtaacctccagaagcaaattcagatcactcagctctttggggttcccgttgtggtggctctgaatgtcttcaagtaagtccagcctcctcctttaaatgtgggcattatcactaggccaccctgtgaacgatatttgtgtcttggggtatttggtctttctgtgcttcatctaaaagtatacagaaatacccagttctttctgtttgtttatttggtttggtttcattttagcaaatgtgttctcacaatgttattaaggaagtgaaatttatatatagtgagttactatctccttggcttttttttttttttttttttttaattctacccagcatttttgtctgaaacaaactgtgaatgatcaaagggatatgttatggaattttcttgataacacccttaacgacttgaaatatttgagtcactttagagaggactttttttttccatgctttaagtctgatttatttaaacacgatgtgaccacttttgatgtttaaaatgtattcagtgttagggagcgaagttctgtataaatggtgagtctttctttgaaaacatagctaaatggatacagatgcaaaaccacaaacattttcttcactaggaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggtaagatctagtaaaaacaatggctcacatttcttacaccttagcatgggttgtcccattctgttgtcaccacaaccctacagataagaaaactaaagatagaagagtttaggcccggtgcagtggctcacgcctgtaatcccaacactttgggaggctagggcgggcagatcacttgaggtcaggagttcgagaccagcctggccaacatagagaaaccccatctctactaaaaatacaaaaattaggtgggcatggtggcgtgcacctatagtcccagctactcgggaggctgaggtgggagaattgcttgaacccaggaggtggaggctgcagtgagccaagatcgagatcacaccactgcactccagcctgggcgacagagtgagaccctgtctcaaacaaacaaacaaaaaggtagaagagtttaagccatatgacaaagtcacatttccaagtacagaccctagctccttgtcccaaagcctgtgcttttgaagactcccaaatcgcagtcctaagtgaggaggtactttagcgaacaggatttgacagctgacgctttcaggagttgcacaggaacaagagcaatttcgtgaggattgggaaaccatgggaggtattttccttgttcatttctcttttttttttttgagacagtctctgttgctcaggctggagtacagtggtgcaatctcggcttactgcaacctctgcctcccaggttcaagcacttctctgcctcagcctcctgactagctgggattacaggcacctgccaacacgtctggctaagtttttgtatttttagtagagacggggtttcaccatcttgggcaggctggtctcaaactcctgatctcatggttcacccacctcggcctcccaaagtgctgggattataggcatgagccaccacacctggcctctgcttgttcatttctgttatggttcttttctcttgtggttttattgaactatgtctagtgtatgtgtgtgtatatatacatacataatatatttatttattttcattgtggtaaatatatatataacaaaatttactatcttagccttttttttttttttttttttttgagacagagccttgctctgttgcccaggctggagtgcaatggcgtgatctcggctcactgcaacctccacctcccgggttcaagcaattcttctgcctcagcctcccaagtagctgggactacaggcgcaagcaagcgtgcctggctaatttcttttttattttagtagagtcggggtttcaccgtgttgcccgggctggtctcgaactcctgagctccggcagtccacccgcctcggcctcccagagtgctagggttgcaggcgtgagccaccacacctggcccatcttaaccatttttaagtgcacgtcagtagtgttaagtacattcacattgtcatgcagccaatctccagaacgcttttcatcttgcaaaactgaaactgtacccactgaacaactccccatgcccctccctacagtccctgccagctaccattctccttcatttccatgaatgtaacaactccagggacctcatgtaagtagcatcatactgtggctggcttatttcacttagcataatgtgcgtgcatgttgtagagtgtcagaatttcccttcttttttttttttgagatggagtttcgcttttgttgcccgggctggagtgcagaggcaccatctcagctcaccgcaaccttctgctctcgggttcaagcaattctcctgcctcaggctcccgagtagctgggattacaggcgtgcaccaccacgcccagctaatttttgtatttttagcagagacagggtttcaccatgttcgtcaggctggtctcaaactcctgaccttgtgatccacccacctcggcttcccaaagtgctgggattacaggtgtgagccaccgcgcccggccagaatttcctttatttttcgggctgaatacgctcccattctttggatatcccacattttgtttctttgtccatctgtggatggacacttgagctccccctcacagctattgtaagtaatgctgtatgagcatgcgtgtttatggcatatggcatatgtacaagtatcccttcaagaccgtgttttcttttttttttttttttttttttgagacggagtcttgctctgtcgcccaggctggagtgcagtggcgcaatctcggctcactgcaagctccgcctcccgggttcatgccatgttttcaattcttttggaaatgtattcccagaagtgggattgctgggtcctctaggatatttttaagcacatgtcgatggttcagtcagaagacctgagcttcccagggctcactctcctcctcagatcgtctgtctttgcacccgtctgacatctccattctgaattttgtggttccgattctggctgatggatttgtcttcaggggtagtgcatgattgtggagtgcccaggcttcaagctgattgctgcttctcctgttccttcatccctcacatattctattgttgagtcactcagatgtcacagacactcttctttcctgttcagtggcataaatcaatagcataagtgaagaagaaatccgtgaagcaagagcttagcagcgttgttgataagcctggagtcacagtggtgagagaacggggctgatgtattaatatttaatattaccacagctctcgcttttaaggagttgtttgtgagctgggtatatgggcgctttgcacatgttcacctctttggtcctaacatccctcttaggtggaaactggtgatatcttcccattttacagacaagaaaactaaagcacgaagagactaagtcaactgctcagtgtcccatagctaggaagaggcagagctgggagaaagaatatccagatggttgaggtcatcaccctgctctgttcttcagagctaagtactgtgctcaaaagtgtgtgtgtattggaggtctggggggagacatagttaaaggggacagtgactgagtgacccccctgaagagaaagggtgacagtgatgggcataggcacagattccatgccacacaggggacatcatcgctggcacgcagtcagtgtttacggaaggaaggacacagggaattaattggaggctagctcataaaaggtttttcatttttatgaggccattttgtgaatgaggaactagaatattctggactacagaggcggtagagatcaattgagggagaagattttggatgagtgaaaagaaaaatgttccagttggaagctttgagttctcagacctagaggtgttcagcgcaaaatagatgtagccctgctgtgggcaagtcagaggcattgaagccaactcagatggcaggtggccaaggagaccctgggttcctgttctttggtcctgggtaaggcttgccagggtacctacaacccttggcacatgccagagcctttctacataaaccactgtagggagagtcacccccagatcctgctgtgagtgtgcctctgatcatgccatctgatcatgccatcttgccgtctgatcatgaaccaccccactctgcatagcaaaggcagttattttcatgaatgatttcacaaagtgcggctcttttcaaggaaaacatcccaggtgaaaaagaggtcagtaatcagaagaaatgcttctgagttatgctgtctcagacatgcactaaccctaacatgaacccttttcctttccactgatatttcaatttttttttctgaattcccattcttcatgcagataatgctgctaaaatgtcagctctcttctgaaaggaggaaaatgtttaataataatgtggtctaaagtcctctattgataggcgacctcaaggccaggatccctgcctcctttgccaacacacttctcgcttttcttgtaacagaaattcgatttgagctgcataattgtttgttagataatcagcctcccagcctactgcagcatgacagttcatgaaaagagctgctgctgctgctggctctctttgtactgtctgcctgttagctgtgttcctcacaccagcaagatttagatcatctaagaccatttacagtcttgtcttgtcaccatgtaaaaatctgaattcattggtgcagtcagtaatagagctcaagccttctttgccccggatttcttgcattgattggtgctggtaaaactttagtaacttaagtaatggttttctggaagccctttttacctcccctacaaccccacaccctcacaaccaacccttgggtgctgggcagtgagaaagatatggcattgctctataggagaaagaagttataaatgctttgcatatgacactctcccacctttgcttctcaaagcaaactgggtttctgtgtgccccttggtgtctccccagactttatatccccaagaatgtattcagtacaagactaatggcatcttgtgtgctattctttctccaccccagtcttgtggaaggaaaacaccggagatgatttagggtaatgggaaatagtgctagagcccagggcatgactgcatttgaatgtgaagtagaaattgtctcggaaccccactggagagtgattcagctggagagagtggggcacctggctctcagaggcactgtgcggccagacagcagtgtgctggacttcctaatggcgagctcacaggttaagtgagaaacaggctgcacttctgacttgggagtctctgctgaactttatagaaaactgacttcagcagcaactgctgtctagagaacaatttggcatctctttttgccagagtaacttctaactcaagagtaggcaacttttaattatggtaccggatggaggcagcaatgaataatttagaataaagattgaaaaatatggaataaggtgtagtagactaattgctcagaagaagttttattgtgtgaaaatgaatgtgtttaaacttgaaatacagaggatcatttcctctctacccttgagggtgattgcagtcccttttaagaagctgttaaaagtccccctcaagatcatcttctctttgaattttcctttctaatgtgacttttgacaattatatctttatcgttcactaagagaatatctccatgtctgcagggatgcagggaaatatgatggctgaaagaaacgctaatctacatgcgcactttattagctaagaaatccctcctccatacgttcttccaggcatgcctccgcacatcccatctgctatgtgggctcaactctgcattatagatgggaaggtgatggacttgtccataagaaatggacgcttgataggagaaggaacatattacatagagctaacaggctaaagctttgggatcatgcaaattaagtttaaaccttgagtaggcctcctactgtggacacaatttggggaagctgactaatctctcgagcctcagcatcctcatttgtacaatggtgtctgacagtgacaccaacttcaccaagttgctgtgagacccaaatgaaatgccccagagtaaaatgctggaacatagaaagcaggcaatgaaggccaggagtggtggctctcgcctgtaatcccagcaccttgggaggctgaggcaggtggatcacctgaggccaggagttcgagaccagcctgggaaacatggtgaaaccccatctctactaaaaatacaaaaactagacaggtgtggtgtcacgcacctgtagtcccagctactcgggaggctgaggcaggagaatcgcttgaacctgggaggtagaggttgcagtgagctgagatcacaccactgcactccagcctgggcaacagagttagactctgtctcaaaaagaaaaaaatggaggaaagtagtcaatcaatgctggttcttcctcctgtcatgttcacttggaaagagagtgggcctcctgaattcaccttcaagaattctcctgtaactcaaggtaactttgtcaaactccaagattggtttattttgctctgggttaaaaccaggaattagaagtcaagtctcctaaagcactactgaactaaaccaagacactgacgtttttccttctccgtgagaattgggagcccttagtgatatcataaaacatcagtcatttttgcaaagaaggaggtatgacccggagaagtcagcttgacattcagtcggaatattgtttgttaaatgaggagttaaggttgaaaatcatctctgtatccttcctctagccttgcaaacattttaaggtgtagccttgacagcaagacaggatagtgtttgtttttattaaaaggtctttcctgttccttgcgtgaagccattctcttgatcccagtgggggctggatgaaggaagagcaaaacaaaccacgaagacagcctggagccgcagccagctctgctgacttctgaacttcacgctctcactgcccagatggccaggggtgtttcctcctctgctggtcttttttaaggcaggatgtttgttgttattgttgttgtttttctggttggttcttaagaaattattttctacatcttgaaaatgccagctggaacctacaccagttgttggtggggtgtgagaactatcctttacatggacttggagcatttgcaactagagcctccacattgaaataaacatttaaaaatgcatatctatggatatacagtgggggatcttccattgtggtaaaaatatgtataacatacaatttcccctttaatcgcttttacatgtatagtctgtggcattaagtacattcacattgtacatacagggtttaattaataggatcttaaaacttaaaagggtattgatgcacatctctgttgccttttacatttcacagtaattagaagggaaaaaacacactctaggttgaaaggctgtcctttcttttggttgtccttgtccctggaaaagctgtcttccccctcagggcctttgacctcccccggctctccctcccatcttcagacacgcccagggccagcctgagtcagtagccctttcttcagcgctccctcttctcctgttgtgcattagaatgtttggagtgttctgtggaaagctggtccttacattttccagtcagttatgcatctcactcataaacctgtttcttcccccatgctctttaatattctgctttcttaattatggttgagctgcctttaaacagtcttagattgttcaatgtgagtggcttcaacaagcctcccataagcctcttatcccctggccccctttccatgatccaaccccaaatctccagataccccctgctttttttatgtttttttgtttgttggttggttggttggtttttgggttttttttttttttttgaggcagagtctcgctctgtcacccaggctggagtgcattggcacgatctcggctcactgcaacctccacctcccggtttcaagcaattcttctgcctcagcctcctgagtagctgggattacaggtgtgggccactatgcccagcaaatttttgtatttttagtaaaggcagagtttcaccatgttggctgggctggtctcgaactcctgacctcaagtgatctgtcctcctcagcctcccaaagtgccgggattacaggcatgagccactgcaccaagccccggatacctcctgcttgaccagaccttctgcaaacacaccttagatccctctcaaatctagatgcttctccaacactggcttctaggttctttatgaaacctctgctggccggcagtatataacccaccacccagcctgccaggcacgtcattcagctgtgttagacagtttcgagggatctgcacctgtcatgagcactggcccaaccttctcaaagcatcccactcatccctgtgattctggcaaagcttgccccagctttctttcctcgatggttgaaatagcacccaatgagaaaaaaacagtggcctgtatttattatacttacacatgtcacaagaatccctgtagtgtcattgaaagctttcttctagcatgcaaaatgattgtcactatgatgtaagtttctagaaatgccttatttcatctaaaattatgagagaaggtaaaatgatgaactatcaaagtcacactacatgttggccggctgccttctaccactcactccatccctccccaggctttctgacttaaatttagatcacatgagaccattgcagtggagagagtgtccactttctcaatctaaaagcaagctcgtgaagaccattaaatatgatcacaggaacaaacattaaaggtaccacacgtaatggaccacttaagacagaaaactacgatcttagggtttaggggaaaaaaacactcaaacagcacaggcttccagtctccccagtctctgagaggttgggatttttttttttaataaagtacaagggctccttgaacatgaacacggaacgagcgttgcacctgtattcattcatttcgctcttgtaacacattgatgttcctaagtcagatttgtagaagaggaacgagcagatgcatcatgagaacactgtgcttggccaggcgcggcggctcatgcctgtaatcctagcacttagggaggccaaggtaggaggatcgctagaatcgaggagttcaagactaacctgggtgacatggcagatcctgtctctactaaaaatattttaaaaattagccaggcatagtggcacatgcactgtagtctcagctactcaggaggctgaggtgggaggattgcttgagcttgggaggcagaggttgcagtgagccaagatcaccccactgcattccagcctaagcaacagagccaagctcaaaaaaaaaaggccaggcacgatggctccctcctataatctcaaccctttgggagactgaggcgggcagatcacttgaagtcaggagttggagaccagcctggccaacatggcaaaaccccatctgtactaaaaatacaaaaatgagccgggcatcgtggtgcgtgcctgtaattccagctactctggaggctaaggcccaagaatcacttgaacctgggaagtggaggttgcggtgagccaagaacatgccactacacaccatcatgcccggcctgttttttttgtgtgtgtttgttttgggttttttttgagcctgggcaacagaacaagactctgtctcaaagaaaacaaaacagaacactgtacatgagtgttcctgggcccagcagagtgctcgaaccagtcagcactttgccctcttttgggtgagatgagatctttaaaatcacttattcccatatattccgttttttggcattgctacactattctatttgagagtaataaaagattacccatgtggatttcttactatttcatgtggagaaatgcagcttttctagcggcgagcctttcttccatttcccagagtccggttaccctcaccgcaccccaggtttgccgtagaaggatgagattccctacatgtaggcgtcttcagagtgaacctgttgctcagggcccgcgagcccacagggctccatgcccactgagcaggctcgtggacgtcggcacgtagctcagatgtgctgatttccagccaaggacatgctttgtgtcaacgatacaggggcctgttgttctcagtaacaagggcagagccgctcccgggactccagttggtattggtaatgcaagcccttgcacctagtgtggtgtggtcagtataaattaatatcgacagcttcatgttgtactttaatttgaagtacaggaaaggctgcttgccaaactgtatttgtagatcatttaaaatttatgcttcatttaaaatgcaaaatacgaatggaaataattactgtgtatccggaaatgtctattcaacttacaagtttattaattgatccttctctttacatgttttacgggacttggaatacactttgctaatatcacagcataggaagatttaacccatatgaattcaactctgtagccttggtgaaagaaaagaaccatgtatttgtcattcactgtggcccccgatgtatgccaacgacttcatttggtgcagggctgaagaaatggcagtgtgttccaatacttcacaacagtggggcctcattaagagatgctagggtattgagagtggagtgttacatagtgtttttcataggtcttctaaaagatttttcagagttgctgacttaagaatttggcctctgagtaagatgagacgcccctactacgttataaagccttcatggatctttatttctaacagttcatttttaaacttttgttccatttcattttattttgtccattttttgtcatcaaaaaattattttaaaatgtaacagctcttctagaatgtacagatcaattttattccactaaaaaacaggacttcaataatttaattgaagaattctagtgagcatttccagagcctttccaagaaagctatactgtttaactttgagtgactcagcttctaggaccctggtccaccacacctacaaaatgaatttaataaagcatgaaggtcaccaaatcctctactatttcttcgtggagtcattcagctagtgtttatgttgtgcctgctctgtgcgagagactgtgccaccaatataaccactggtcacagttattttctagagccatactgcctgatatcccatgtggctaagattgacagttcagtttctggattgttccagtcccatttccagtgcttttaatagccacatgaggccagtgaacacacgatacatcttccattgtgatagaaagtggcagtggacagctttgttctagagtatttccgtttctgaaatacatgtttaagaagtttggaaaggaattagtgtagagtatgagaagggttacatttttggtgaatatgaagatttaacataatgttagttcaaaaatgaccaaagacacaagtgtagacaccaggcttttgaagtagctaatatgttaagcagctgtgcattatatagacagaatattcactatgtcccactcagccctgtgtttgacaccatttcaccttggcttctgcctttctttcccttctttgcctattgagatttttcctgtcctttctatcctttttttttttttttttttttttttttgaggcagagtcttgctgtgtcaccaggctggagtccagtggcacgatctcagctcactgcagtctccacctcccgggttcaagtgattctcctgcctcaccctcccaagtagctttgactacaggaatgcgccaccactcccagctaatttttgtattatttaaatagagatggggtttcaccatgttggccaggatggtctcgatctcttaacctcatgatccgcccaccttggcctcccaaagtgctgggattacaggtgtgagccaccgcaccaggcctcctgtcctttctttaatgcactattccagctttttttttaatatcttgccagcttttgctgattttcatgcctccctctgcaacctgtgatctcttgactttaatagtaatgtttatacagagtcttgactgcacactctcttctgtcatcgttgtttgttgtgtctcattgtccccaatccatcagaagttcttggtacacaaagtccctgaagctgtatgaacaatgccctgacgtcttgaaaggacttgccataggtggttatttgatcacttagcagatgcctttgggatcctactttgtgcaggccactctccaaggcacaatgtggcaagtaaatatattagtcaatatttacagaaccaagagaaagccagcaatgattaatgcataaacagtcataaattggccattttatttgtttataaaagctatcatttactacagagaagtacaagtgaatatcaagctcagatcaagacctttggactgagcttggctttttttttttttttctttaaagattacacttctcccccaaatcaagcagattaaccataggaagttccttgcctgctaacagaatataaatagattgcatgcaaggggaaggaccttatcagggcagattttagtatttacactaaacccaaaagattatttccttaattgtacttgtgagtgaaaaacaaaaattgtagcaggagtcccaagagcactctggccatgggcttttgagctgtgagttgaagcactttattcagcatgtggctgcagggttgtagctcaggttgtagacagtgcattctcttcaggtcccaggaaacagtgtcatacctgtggaagccaccagaatgcaccttcatcttctccagtggtggcgaggttgaggccaagcatcagaagtgctgagtgctgggaaactgtggggctggatagatggcagtgcctgctgggaagcacacagccctgggttgaggcagggaagcagggccgcccagttgggattcattcgtactactggcccctcacagtaccgtcatgtgtgggtggtcgcgcttgtcctacaggaagtaaaccacaactactcatctcacacagtcagcccggcacctccttggaattcccaaaacactttccaataaacattggaaaggaagaaagtttagttggtaacaaaaaaatgtatgttgccttacgcccaaaagcattgaaagcagggactcaagcaggtactcatgcagccctgttgatagcagcattgttcccagtagctgaaaggtgggaacccccttgtctgtcagcggggatcagctaaatatggcacacacatactatggaacattattcagccttgggaaggacacctcctatcacacggatgaaccttgagaacattatgctaaatgaaatacaccagacacggaaggacagatactgcttgattccacttgtaggggcctgtagagccgtcacattcatagacaggaagtagaatggtggttgtcaggggccaaggggaggggcatggaaagttgctgcttaatgggtacagtttcagttttgctaaatacagagagttctggaggttggttgcccgacaccataaatggacttaacgctactgaactgtacacttagaaatggttaaaatggtaaattaggccaggcatggtagcttgcggctgtaatcccagcactttggaagtctgaggcaggcagatcacttgagcccaggagttcaagaccagcctggacaacatagcaagacccccatctctacaacaattttagaaattagctggtggcttacacctgtagtcatagctacacagtatgctgaggtaagaggatcacttgagcccaggaagttgaggctgcagtgagccgtgatcacatcaccgaactccagaatgagaccctgggtcacaaaaaaagaaaagaagatggtaaattatatgttatgtgtacgttaccaaaattaaagttcttaaaaatatatattttaggccagacacagtggctcacacctgaaatcccagcactttgggaggccgaggcaggcagatcacctgaggtcaggagttcaagaccagcctggccaacatagtgaaaccccatctctactaaaaatacaaaaattagccaggcgtggtggcgggagcctgtaatcccagctgttcgggaggctgaggcagaaagaattgcttgacccagaaggcagaggttaccgtgagccaagatcgcgccactacactaccagcctgggtaacagagtgagactctgtctcaaataaataaataaataatatatatatacatattatatagatagatagatagatttcttacaaaacattttcgtgtttaaaaataacaaatcaggccaggcacagtggctcacgcctgtaatcccagcactttgggaggccgaggcaagcggatcacctgaggtcaggagtttgagaccagcctgaccaacatggtgaaaccctgtctctactaaaaatacaaaattagccgggcgtggtggcacatgcctgtaatcccagctacttgggaggctgaggcaggagaatcacttgaacccaggaggcagaggttgcagtcagccaagatctcgccattccactccaccctgggtgacagagtgagtctctgtataaaaaaaatttttttaaataacaactcagccatccactcgcatcaatttattcactagtcattcgattgctattactttgctcccatgtgagttttttaaattattaacagaaaaatcacactctttatttttgaattatgatcttgagttcagtaaagaatgcattctgttgattaaatgtgttatgagtaacagtatcttgttttgctgtacttccaagcaaaatgtaattctttcagtcctccctaccgttctcactccataataatatgacttaaggtttgtatagcatgacgtttacaacgtgcttgcgttttacactgactcaacgtgtgcagtacagtgatgtatagtgaagtattcacatcctcatcttagaaatgaggaaataaattcagggaggttacatgatttaaccacacataaggaggggctgcattctctctgagcccttctacctcacacagccaccaagctcctttgtgcagagcccatggagggttggagtggccacactggggtaggtgcaggccagagactggatgcaacaggaacattgcctgcttcccaaaaccactgttctactgcccggagaacacacccttctgggagctgacttctaacaaagcaaggtccttggacttgccctgcggcttctttcctgcaagaagtatcttccagcatcctaccaacttttatttcttaaaaaaggttgttccttgccaggcattggttgatcagcagaggagctcgcattagtttcagtgcagtgttgggagcaagcacttgagtgcccagcaacataggctgctcatgatctaagattcatggaaaaagtcttctgcgctgttgcctgcagcacatcaacacctgaattttcttatcatcttgtgtggctattgaaccacagggaacccaagcttagtcaataggaaatatagaaatattcattggttcaactgtatagggagggccttgtatatattccaggggctgtatcctatcttgcctctaggtaaataagagatggtcccgaggctcaaagagtttatcaaccattctttattcttcagctaatatgaacattgaatcttttacattagaagttgcccatgcagggcacgcctgtaatcccagcaacctgggaggccaatgcaggaaaatcacttgaggccgggagtttgagaccagcctgggcaacatggtgagacctcatctctaccaaaaataaattttaaaaaaagttacccttaaatttctttctctaacccagcctcaactttgtactcaggcagtaactctttgtacaacattcctggcaccatattcagcttatacagaaccctccaggcaaggacaggtcactgctaagtgagagagctctggttattatagttcttccttaaacactgcactcaaaacgacttccttctaacgtttgtcccttggttcacattctgccctcctttcgattttttgtatggcatggccctccaagagatttcagtgtcagtgtggtgctgccaagtctgtgtgactgttcacacactcgggctccattcacacaccccaagattgcatgagcttttgctgcagccactcacagtcaggccccagtgaatccctgtcctctgaagctgcaggtaggagcgccccaagggcatctagatgtcaaagaagaggatgctcacatgtgcctaaggttcatccatgaaggcttcgtggaggaggtggcttttgggatagatcttagaaagctcagagagttttaacaaagattggtccttgaagattactaatcttttgactttataaatacttgcatatatcttcttccagtctgtctcttattttttgaccttatttataatgtcttcttaaaacaagttttaaattttgctgtagtgaaatctatatatcatttcctttatgggttattctattgttacctcatttaagaaatccttctctacttcagaataatagagttcccactgttttcttccaatatgtagagttataattttcaagtttatgcctttgttccatattgggtttatttggaggcctggtatgtggtaggaatataattttatttctctccagccaaaagtcagatggtagtcagcctttctctgttgatttgtgtcacctctgttatatactatcctgcacatgctgagtgtctttgtgggttctttcttcttttccgttgattaatttgtctatacttgtgccagtacccatggaatttattagcatagttttgtggtatgattgatagctagtagaaaagtcctctttctttgttcttttggttttgttttatttttaaagttatctgactatttatgccattaccctgtgttagttcactctcgagttgctataaaggcatccctgagactggttaatggataaagaaaagtagtttattttggctcatggttctgaaggctgtgcaagcatggcaccaacatctgctgggcttctggtgagggcctcaggaagcttccactcagggcagaaggtgaaggcggggggagccagtgcatcacatggcaagagcgggagcaagagatggggtgggaggtgccaacaagcagacctcctgagaactcagagtgagaactcactcattatcgtgaggacagtaccaagccattcatgagggatccgcccccgtgatccaaacacctcccacctggccccacctccaacattgaggattacatttcaccatgagatttggaggggaccaccatccaaaccacatcaaccctttattgtaagtttcagaactaattggccaagtaaccaaaaatgagcttgggatttttattggacttgcattgaactgagtaagtttcagagaagtgacgtctgtacagtgttaagtctcctcatccatgagcaaactattttcctccattgactcagactctttttatgtccctcagtgaaaggttataaggcttgcaccttcatttctttttatttgttagaatattcaatatttatgttccagaccacagaacacctctacagtaataaaaactgtagtaatgaaaaacacgttttaaagcagttttgggttctatcagggttgggaggggaagagtgctagcttttatttattttctcttgggtaactcttgtatcaatagtatttcatacaaatgtgacactagctgttgccaagcaaagtccttgaggcacatcacgggagacttgtgccccttggttgacatctgttccatcagcatttggttcagcagttgttcaccaaacagtaaatccactaattgcatcatgcatatgctttctttttttttttttttgagacagagtcttgctctgtcacccaggcttgaagtgcagtggcgcgatcttggctcactgcaacctctgcctcccagggtcaagcgattctcctgcctcagcctcctgagtagctgggattacagaagtgcgctgccacacccagctgatttttgtacttttagcagagacggggtttcaccatgttggccacgctgatcttgaacacctgacctcaagtgatccacccacctcagcctcccaaagtgctgggattacaggtgtgagccactgcacctggccacatatgcatctttacccacaggaggattgtagataattttgccaaatgtgtttcttaaatttagaattactttatctgtggaatattattttcctaatgaatcattcttgtttctgaagatcccttgccgtatgctatcaatagtctgtgtcctggttttcaatctaacattatggaaatcttctcctccaacacacttatttgcctgtatctagtcttctcacatttcttccatgccacatgacttctcataatttgcttaagtgacagtaggttcaacctctgattttccaatatagtgtttgatcacatcagcatttatgttaaaatctcaatccattactgctcatgaaaaaatacttgtttttaatactatgaacccgtattcagacccacttaaaaaccagcactcacaatttcgttgggagactcctgtcctgacatatatgattatttgaaaattatagtaaacaggccaggcgtgatggctcatgcctgtaatcccagtactttgggaggccgaggtggacagtttgcttgagcccaggagttcaagaccaacctgggcaacgtggtgaaacccagtctctacaaaaaatgcagaaaaaaaattagcttggagtcatggtgcacccctgtagtcgcagctactcaggaggctgagatgggaggatcacttgagcctgggaggttgaggctgcagtgggctgagattgtgccactgcacgacagagtgatactgtcttaaaaaaaaaaaagaaattatagtaaactatatttttttaatgctacaatggataaaaatggttacaactagataagaagcctctaaattgcctgaacacctaagacttatttgctagttgacatctgatctatttctgacactgaaaatttcagtgctttagggtgctaaaaggaaaaaagagggtttgctaggaatcctgcagttgctgagggggtactctgataagggaattttaagcaattacagaacatctcactaaagtttttaaaaaatctttaaccagattaaacttatacaattttgttataatttgtgtttctccaggttccaattgtggacaagataaggaccattgctcaggctgtctatggagccaaagatattgaactctctcctgaggcacaagccaaaatagatcgttacactcaacaggtaaaagttctacttttaggggaaaagaaaaaattcaccttaggctctcagaatactcagcttgacttgaggatttgtacatatcgcaccagctaacctttgcttaatctattgtatggttaacaaagatgaaggtaatatcctcgggtagagtgtagactatatttagaactttatggtgaggcatatatcctctgatccatgcatcatttacttctgtgactataaatgtgtctgatatgggtggtatccctgtttttaggtgatgtgtgatctttcatccctcccactcagccctgaatgttgaagctatcctttggagtagagctgcggagtcagatttagatgaattgcaatgcttcctcttccttacaggcctcttacttactaccttaaaaatgctagcgtggtgccagggtaggcagataggagtgcagcctataaagatgggaatgtttgctgttcttcttatgcaagcggttcactggctttttactgagcttgtccgctgagattgaaggctccatcatcttctacctctagccactgacaaaggcaagtaggcaaacagctgggaaggtggctgtgatctgacagcatgcatcaccatctagtccagtgacagtcatgatcaatcaactccactacaggaggctcagccaccttcaccaaaaggaccgtatgcctcgagtgtccctcctactttggtgtagtcggatagatagcagtcagaacactttaagagcctgctggctaaagaacttcatgatgggtagcgttgaccttttctttaaaaaaaatctccaactccttattcttttttgtaaacccatttgaaattttgttaaatgctgccgttgccagccagggtatttgttctcctaggtttggtaaaatagtcagcaactcaggaagttctaaattcttagaattttccctgtatgttcttggcttatcctttacaaaaaggattcccaagcactgctctgtgcacaggcattgtggtgaaattttcattcatgtgcaatgaaccaagtaaaataaggtcattctcataaggttggtttgtttttttttccgtgagtttttaataatgatatttaagactatcatttattctaatattaagtcttttctcctttcagtgttaaaatggtatttcttttatgaagtaatctggtgagagtatatggcatattggttggtttttttctttttaatatgcctactgacaaaatttttacattagcaaacctgtattagttcatagaaattacttcaatatttaaccatgtctgaaatttaaaattctggcaccatttctgaaagacagttgtgattgtcactcagcaaaattcttatcggtatagaagagtggagatttcaaaaagaaaatggccccaagtccaagtcctccctgagttgataagactctaagatcttccaaatagttttaggctaagtcttatgaaaatttaactaaagatttcattccctttatctctatcaaggaaatattccttaaaagtgatgtcaaccgggcacggtgctcacacctgtaatcccagcactttgtggggtcaaggcagaggatcagttgaagccaggagtttgagaccactctgggcaacatagcaaaacctccatctctatttttattttttttttaaagttagtgtcaagtatgtggttgcaatgaattagcaaagcctctaaaggaacactgtgtgccatttaatcagaaccaggctttgaggacactgtgctttttgtgagacaccacatgtgacttcctgctctttcacctttggaactctgggtcagacatagactttggtccttaaaaacaagaagcttaaatagtgacctcatcttagttcttataatgtaattgcagatcaaatagccatgattcataaaccaacacaaaggaaccctttgcttcctgactgactccagaatgagtgaacaacatgagtaagagcctcgtcgcagagcctttctccagactaccttgctgggtcccggatattaatagtcttggaaagtggtttctacagctgctgctttgcctgaaaatagccatgctttccccaaacatgcacataacactgccttctcttaaagagagcctccaaaataaacaatagtcacccttgacctgctaaacagtcatcacatggagatgagtttttatcctcaccttcttgcttcttcagtgaacaagtagtaacaagcagctcctgcgtgtgcctcgatctgagccggcataccattgctgccgagactgtataaagtgcaaattgaaaagcacaggagactaacatctgtatcagtgaacacattttctttcctttctcacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacggtgagtgagtcacattttccaaaaaccctccccattctgcattgctgtggtgcctcaaatcgttatgctccgcccgctctttaaaaatcatggattagggaaaattgggagtaattaatagtacagtattcgctatttttctaaacactgtgtctcacctacttttgccattgtggtttggatttttctttttttagatcatgtgttcagggtccttagagtcataatactaatttccttcctaaggtgagtaagaacataacttgggagaattcagtctgttatttaaatggtagaatggcttaagacagtggttgtcaacctttatcacacatagcacccaaaatgatgtcatcacggtggggttgactgctcacaccagacaggatctgcccagtcaccccaagggctggggaaagcagtcctcaccctctctcacttccccagcacgtcaggtgggaagctctggcttaggaaattactgaatcataggagttctcatttttgatgttgttgtgatgggatcatgttgctattggatgattattctgttattttgtgttatctatgggggtaaaggagatgggcagataaataaaagcttatcaaagtgcttaaaatccatgaagatgggcttcatttggtacagctacacagtgatagccttccgttggtaccgtcagtggcctaaatttgacttcttgtctttgggagtgctcctaaatttggtttagaacaaaaaagaattcttacaacctagcagatcccatggcaagcaaagaaaaaaatattctaacccatcattatcgtcatcattagtgcaaagtgatctgagcttaaacagcatacattatcataattttttataataaaccatgttgctttattgtgcaaacaagcaatagatagataaaaagtgcagattcttgccttgatatttacatacttcatctaatattggacacaatgttttttcaatcagcattttttgaattcttcctgcatgtgaggcacagagattttaggatgagcaggtgtgagacgcatgggtttgaatagcacagaggtatctggagagcactgtgttggtattctgaatgccctcagagcccagggggataacagctcattatgcctggggtagaacttacccaggatgtggaagaagaggggattcttcaaaaagagctcagcctctgaactggcaaaacagtgagttttgactcaaaggcaccaaagtactaatacatgacatcctctcctggggtgatccgatgtggctggagttggatgagggggggtggctggggatgggaatgggaatgggattgggatagcaggacagggtcacatggccaaggatcttgaagaccatctcatggaacttgaatctgatctctacacactggggagccacggtagggtgggttttttgtttgtttgtttcttggttttttgtttttttggttttaaataaggaggagaagaatgtggtctgatgtgtattttagaaaaatagctctggcagcaatatggagaatgtttagtgaaaagagaaccaggcccagagaggtgggttaattcagctcgggccagaggcaatcaaggtccgcactttggccacagaagtagatacagagagtgggggtgaattgcagacatactctaaaagtatcctcctaccgtgggggccgggggaagggaccgttctagcttggtgactctggctagtgatgccatcggtcatggaaaggacacgggagaaggcagattggcagagccagaaatgagcctggcttgaacagagagagctcagagggttaataggatctaaggaatagtctgtgtctccactggaaatacagacacagtgcttcaaagaaagaggcaggaaggtcaccctggtgggtttaaggatatgggtgaaggcagtcgttaaacaagagacacagggatagctggaaatcagtgagaagacagtgaaggaagacacccctgaaacacccacgttaatgcagccgactcctagcaggggtgccttccaggaggcgggaaggaaggagcagcggcatggcagagaacgtccagaaaaatcccacagacaccgctcgtagcagtgttggcacagggagaagggcctggatgaaatgggttctgaatgacattttcaggtctacagttcagatcagtggttgccaggagttgggggaggggaagcgtttgactgcagaggggcaggagggaactttttgggataatgcaaataccctatgttttgacgtggtagtgattccatggctatatacattcttccagactcatagacctattcacgtgtgttgcccaggctggactcaaactcctgggctcaagcaatcctcccacctcagcttcccaagtagctgtgactacaggctcatgccactgtgccaggcctgtgtataatttaattatacctcagttaacaaaaatgggtgctgaagagcttgctttatattcgttagaatggcctcagtcagccgggtgcggtggctcacgcctgtaatcccagcactttgggaggccgaggcgggcggatcacaaggtcaggagttcgagacctgcctggccaaaatggtgaaaccccatcactactaaaaatacaaaaatttgccgggcggggtggtgggcacctataatcccagctgctcaggaggctgaggcaggagaatcgcttgaacccgggaggcagaagttgcagtaagccaagattgcgccattgcacttcagcctgggtgacagagcaagacttcatctctaaatacatacatacatacatacatacatacatgcatacatgcatacatgcatacatagaatggcctcagtgatggccactttactcctgagctttagctggtgaaagccttggcttagggataagagggcggctggacagtgcaggcccagagagactggaccatcaggggaggtgaggggtgacggaggtgcccaaacagagcatgaaatggtagagtagctgagaaggttagcctcagtcacgatctgtcctgtcctaccctctgaggactctaaaccccgcagtagttcacccaacaaattcattcactcggccaatgctgcataaggcactcagctcggggctacagggagccccaactttaagaagctttctctgcttcaggtagtttacaggtggtagacgcagatagaagtgaattagtaaagagaatagtttggtgtaaaaattgtgcatttaactgaaaccttaattcactactgagcatttaatagccattaaataaaaaccagggcccgcacagtggctcacacttacaatccgagcacttttggaagccaaggtagaaggattgcttcaggccaggagtttgagacgcctgggcaacatagccagactttgtctctacttaaacaaaaattagccaggagtcatggcacgcacctggagtcccagctactcaggaggctgaaatgggaggattacttgagcccaggagtttgaggctacagtgagctatgatcatatcattgcactccagcctgggagatagagtgagatctctgtctctaaaaaaatgaaataaaataataaaaaacacaatataatttaaaatctttggagtcactaaacaaatatacaatgtgaatctcctctcactccagctaacgccaccatatccaacactaggtaaagaccaaagccgttctggaaaatcagaatctgttgccatggctcatgcctggacaccaggctgtccgctcctgacgtcactctttcacttacgacttgttagaaaatgaatgtgtggaatggccctggatagctgctgcagctccctggtttcctgaagtgagccctctgtgtcattatctggtcttctcagccctcagccgagttcctcctgtggccacacacggggtcgcagtgagcgtcagtgcacagtgatgaaatctcctggaacagtcgggtgtggggcatgaggaagggagtggtgcctgactacagaagttcctggaggtcaggaaactctcactggaggcggtggccctagagggctgctttctatgacagagcaggaagctgcatgtgtagtgggacacacgcaccagaggggccaggatctcctaataaggactggtatttatttttacttgaccccattctgggccttgccacagtctgctgaaatgccttgaacattcatcacccgtgtgggagacaggatagtaatttcctgctgagatgactgaggggacggggaatggggacaccagggggactggctcctgcaggtgggaaaattctagcaaaatgaatcactcttctgcttagtcacccaatgtgcacttattagggtgctgctgaaatacatattcatctatccactccagaaagatagtccaaactgagacctcaggatcagaaagcctcccattctcctgcagggttcattcatttactcagtgaattattaaatgcctacagcacgcagggccatcagccccacagctatgagaaagattcagtccttccctcacaggccttatgatagactccagtaaataaaaccatacaggcacagaatgcggcgggctttataacaaaggcagaaagcccctcttgttgtgtcctcaagggaggcagagaagctcccctctggctctagttggagaatcccaacccaagcaagtccatccttaaacaataaacatctccagcattgctggctttggaagaccccatggtgagatgctggagcttttttccgctccagatttcgcttctaaatatttacttttactttccatgttcacttataggccagggtttttttttcctaccattgaattatttcgtcatgttctatttaattattgctttaattggcattggtgaccacaaataataataaatactattaactggtgtaacagcttcactagtctatttcactgccccatgctgttgtaactgaagcccccagcacaagcattcccagctcgtggtcatctaagacctttgaggtcattcttacatgcattgctagtgttttccatattccttgatggtagccaatttttccttcttaaaataactttcttcattcctagtaagcttcatatgtattttatgtattcttccctcttttttatgacatgatacatattattgaaagctaggaaataatgcaagattcttgaacgacataataccacttagtacatctttttgtaagagatagtttttctaatacaaatctttgatatgggaagaaacaagcaagttgttttttaaggttttccaaccctatattctactacaaattaccctgttatggtatgcttccaaaattctttcaaggattatggtttatagagttcaataaacctaatagtttataaaacttctcaaaaaataatctcatgccaaaaataatttagtagtaggtggtctttgtcttgtggtcacatggttttgatattgtctttaagtttctataatttacaagggctgtttaatcagttggcataaatttcatgacaaaaatactaatatgtaagcaaagtatatgaaacaatattattgagaagtaaattacattccatgtagaaaaagactagaaagacaacaccaaaaccttaaattagacagtgttattatgagtagctttttttcttctctttttccatatagatcaaattactacattgggcgtatatcacttttataacatgaaaatacagtaaatagggcgatgataaactgcaagtgcttggggagaatgcttaactcaggccagttgcaagagagtgagaacacacacgcagcctgtgggagcgggctccatgccatcacctggccggtcctggctgtgttgctgtgttttcgcacctcaaaagttgggacagcaaagaaaggccataagagctagaacgtttccataagaagtgtattcagtatgatttgtctagctctgactaatgtgtgcaaaccccacattccactaagcaaatgcaagattgtttttccctgttcatttgttcctgggcccttcttgcttactgtgttgggagttggagaggggataattgacttctttcttctcacagtgttttctcttttttttttttttttttttttttgagacagagtattgctctgtcgcccaggctggagtgcagtagcatgatctcggctcactgcaacctccgccttccaggttcaagtgatactcctgcctcagcctcccaagtagctgggactacaggtatatgccaccacatctggctcattttttgtatttttcaaagagactggggtctcaccatgttggccaggctggtctcaaactcctgacctcaagtaagccactgcgcccggccatctctcacagtgttttttaaaacaacaatgcattttcataacagttggcctggagaggtgtccgaccaagttggaattcatagtagaatccattggaagttaatttttgatgtatttgactgttttccattgacttcgcattgaggcagtgagagagacttgaagaacttagaatacgcacccttttgtcactggcaaacatgggacatagaggcgtgtcttgacagcaatttgtggcaacactctgggctggaatctaggggttagacagcctggccggttttgtaaattagatagccaggccaccctcagagtcagtttgagggttgagtgggaagcctgaataaaaagagaagttaaacttttaagaaaagggtcaagctttaaaactggaattgggttttcaaatttaatgaggaaaaagaaaccccaaaactggaattgtaattgtggagaaatacaactgataatatttggaatatcatctacaaggaatgaaactatccagaagcatttagatggtagtcagtgccatgtagggcacctctgggggcagggtggctcctggcactgtggagaaagacgactggtgcttccttctcccaatcggaggaaagggatacactgtggaggtcccagcagcttagggcctgccccccatgtggttatctctgtgccgtttccttccctctgtcttcctgtaactccttcactttggcccctctgccctttctgggcagagggtgacaggaggcaccgcatgggtacattctttttttttttttttcttttttttgagacagagtctcactctgtcacctgggctggagtgcagtggcgcaatctcgactcactgcaacctccatctccgggtttcaagcgattctcctgcctcagcctcccgagtagctgggattacaggtggccgccactacgccccgctagttttttgtatttttaatagagatggcatttcactatgttgttcaggctggtctcaaactcctgacctcgtgattcacctgcctcagcctcccaaagtgctgggattacaggagtgagccactgcgcccggccaactacatgcttttttcctcctgtcgggattggcctgggctgtacctatctcatggtggaaacctgcccagggaccaggccctagaagaccagcagtttatttaactgggttggcctttgtccccactccctgtgacccggccctgccacatctttacccaggtgcaccactgacatcatcgcttggctggactctggaaagcaggaaactgctggagcgtgtttggggcatcagtgatgtcacccgctacaaatgctgggtggggttactggactgagggccatgaaaaaagaaagctgcggccccggcccgtggactcactgccattctgctctttctcacgtttcagttcagctcggtttgttttccgtccccctccctctactgtaaaagtatgtactcagtgtttcgtttcctgctggatctgattcaggtcagtgatgaagttatttgtgaactcagtggggaggtgtttcctcccctttgtaccggccctacttagggatgcacggttggttatacgcttgcttcactcggttaggcatggaggagaattcattcagccctcataggtttaaatcaaatgcatgacccttcacattttccagagatttacggccagttacaatgagacaattaaacattcacccccccgccaagctgcacttggagatgtgtaagcagtaatgtagtcatgcgctccccatgatgtgagagcgtgcagaacgccactccccccagcaggtccgccaggacctccgcagggagcatcttgcctgcaaaatcacacatccctttttccccctctctccactttccctactacttttccactcccacacccacaaataaacaaagaaaccttgagcttattttacaaaagtctttgaaatggccctcgtctctccaatgctcctgggtcctggtttggccccatctgtgcaatctctctgatgagtgtgaaataagccaggtttggctcatgctctgccggtgagcttgccctccccatgagcctgtcctctccatctggcctcactttgtttgtgtccctgtgtcctttgtctcccatcctgggatcctggtggtttcctcctcccctcccagcatgagtccttttccccagggttcttccctatctctacatcagaatttcctgctttctcccaaatatgcatttccctggcccaggcatccactgcttcctctcatcgtgaggtccctgccgcaggctgctgatggtattgtggccgtgccttcctccacaacccagggaaagctacgtgtgtgtctgtcccatagggaaggagtcatccctgtctcctcagtgtggtgtgttcaggaggaaggaaagtaaccagcgtcgttctcaatttccagaaactgtttatcatattgacaagaagaagaaagctttgtgactcatgagaatgatgttttcctctctggtacataaggttatctaggtccaatccatttgtgtagaggatcttctctcccctagtgtgatatgcacttatttttagcacaagtataaaactactttaaatgaaatcagcctcagccagggaaatatgctgagtaataatgttgccaggtactataccactgagttgagtttgtaattcactgctattaatccctgtgtattagttctgattttttactctttgcatacatagaaaaatggtgtttctcttcagagtcaaggagggaaaaaaagaaaagataaaagatgcttataacacttttgtgtccacccctaaaatcagcatattgatctattattttttctaggtattgatgagatgttgactcatatactttcatacaactggtaatatatatatatatataatatgtgtgtgtgtatatatatatatatatatatatatatatatatatatatatatagactcatttttcttccactttcatctacagcctacttgttttcttccccccatttttcgtatggattcatagcataaattgacaacaaagatacatctcaatttagagcttccaaaaggcacccataaaagtatctggtgctcatggaattgctctttcttctatgtctcttagttacacttttctcttattacacttttctatcccagccatggctaagaggcgtataatcagaagcagctaagcaatatatgcaagggaaataaaatgaatgcaaaccaagataccggttttgtaaattagatagccaggccaccctcagagtcagtttgagggtatagtgggaagcctgaataaaaagagaagttaaacttttaagaaaagggtcaagctttaaaactggaattgggttttcaaatctaatgagtaaaaagaaaccccaaaactggaattgtaattgtggagaaatataacggataatatctggaactcgcggcagtttacaggcttaactatgtatgtgttccttaaattatccacccgcagatatcagattacaataagtcctcacttaatgtcattgataggttcttggaaactaccactttaagcaaaaagacatgatgcatatgaaaccagttttcccatagtctaattgataggaaaaagagttaagttatgcagccacacagtacctcgtttggcttaaagtcactgtttccaagaacctatccacaatgttaagtaaggacttaccgtatatgaaaatatttgcagtaaattgcttttgagagaattggttatcacactcttctctgggtatcattgaaaattcagaatgtttaattacatcaggctatactcactggtataaaatcagggagcaagtataaagtaggtgtagggaaataatttatgttggattaaatgatccaatgaagggattttattaagcccctagaagtcccagaatgaaaatgtataactgcatgactaacccctaagaatttgctggggtttctgcattaagtacgcttcccaggccatttgtaatgaaggtaccgtgatctgttaaggaagagacctacagctgggaacaaaaagagccaattccatcctagacatcagtctcctgtttgactcattccaaccccaagaatatgttgtagagtgtaggacccatgaaagttacttactgtgcttccctgtaccttccgtcatccagttcccagacatatctgtgtttcttctctgaatgcctagttacttgggatcccatgctgtattggtctgttctcacactgctgtaaagaactacctgagactggatagtttataaagaaaagaggtttaattgactcagttttacaggctatacgggaagcatggctggggaggcctcaggaaacttacaatcatggtggaaggcaaaggggaagcaagcacatcttcacatggcggcaggaaagagagagagtgaaggggcagtgccacacacttttaaacaaccagatctcatgagaactcactatcacgagaacaacaagggggaaattcacccccatgatccagtcacctcccaccaggcccctcctccaacactgaagatcataattcatcatgagatttggctggggatacagcgccaaaccatagcacatgcctttcccaggactggtgatggaggaacggtgcccttgtcacacctaccagaatatactcacccacctccagacactccatttctctttcaagcacacctcttcacttgtgccgccagctaaggtttactgcagttacttcctttgtgtgtcctcttaccttaccaagtcgcctcacccaccatctactgttaattaaattaccacctcccccacttcccacctccagagtagagactgtgtcttcagttctcttggccttcccacaatgggaagtccagtgtagaacataccctaggagccaactaaatgtgctagtggcctgccaaccctgcagagggctagggaatcttcaaggagtctgctgccagtgaaactcaccagtactagaatcccaggctccaaagaagtctagaaaagtacatcttttaaggaggtaataagaggctcaagtgcccacaaatcctatctgctcttggcctagttcttttgggatcaatgtgctagtctctcttgtcgaaccagttactgaccagcaagactaaaaaaccaggcccaaacacattctattcatgtgcttagatatggacctacggatcaaatatcccactgtaaagcaaaacagcaaactgtttttcccttgtactttcacactcaacaatagcacgcttctgtggctggctgtgtgggggcttttccttacacaccaaatatttctcacaaacaccaaccaggtgtcctcttattcaattcaatcctgacactgtctacctggagatggtgtcggatcccacagattgacggctcagtcccatgagaccagccccacttcaggcactaattgcaaatccaggccatgcatacttctctgactgcctggctaaaaaccgcattcacagccgggcacggtggctcatgcctgtaatgccaacactttgggagaccaaggtaggtggatcacttgaggtcggaggttcgagaccagcctggccaacatggtgaaaccccatctctattaaaaatacaaagattaggccgggcacagtggctgacgccagtaatcccggcactttgggaggccgaggcaggcagatcacgaggtcaggagattgagaccatcctggctaacacagtgaaaccctgtctctactaaaaatacaaaaaaattagccaggtgtggtggcagacgcctgtagtcccagctactcaggaggctgaggcaggagaatggcgtgaacccgggaggcggagcttgcagtgagcggagatcgcgccactgcactccagcctgggcaagacagcgagactccgtctcaaaaaaaaaaaaaaaaaaaaattagctgggtgtggtggcgggctcctgtaagccaagctactagggaggctgaggcaggagaatcgcttgaacccaggaggcggaagttgcagtgagttgagatcctgccactgcactccagcctgggagacagagtgagactccatctcaaaaaaaaaaaaaaaaaatgggttcgcatgagccccctccttgggttcaattaagttcctaggatggctcacagaactgagagaaacacttatttacagaggtgttatgatatatattgattttcgtccatggttcctggttcctgaatcccataaaccttcttacagccttttgttataatgttgggggtgtcacgcctcaggggcaggcctctgaccttccctgccctccttgcactgtaatgtttcccccatttctgattgtgagtcttaagaccctcccatgagagggtcccaccctacaccttgtgggaaggaatgtggatgtcatgaagtgtccataaaaacccaagaggacagggttcaaggggattccagatagccagacatgtggagcttcctggaaggcagggcacccaggtcgggcatggaagttctgcacctcttcccccatacctcgccctacacacctcttcatatgtgtcctttgcaatatctttttgttgttgttgtttgtttgagacagagtctcgctctgctgcccaggctggaatacaatggcatgatcttggctccctgctacctccgcctcctgggttcaagcgactctcccacctcagcctcctgagtagctgggattacaggcatccaccatcatgcctggctagtttttgtatttttgtagagacggggtttcaccatgttggccaggctggtcttgaactcctgaccttaggtgacccgcccgccttggcctcccaaagtgctgggattacaggcgtgagccaccgtgcctggcctgtagtatcctttataataaactggaaatgttaagcatgtgtttcctttagttctgttagctgctccagcaaattaatcaaacccaaagaggggagtcctaggaactccaatttgaaaccagttggtcagaagttccagaggcccagacttgcgactggtatggtggggggcactcggccctgtgggatctgacactatctctgggtagacagggtcggaactgaactggaagccaccccacctggtgtctgctgcttggtgtatggggaaaccccatacacatttggtcacagaagtcttctatgttgatgactgttgtggtgcgacagcagaggaaaacacggtttgaggagagcttttcccaacacgcttatgtgtgccagtttattatagaagacacagatgaacaccagatgaagagatgcatagggcatggtctgtggagttggggttcacctccctcctggcacaaggatgccttcaccaacccagaaactcatcaagtcttgttcaaggatttttgtagagcttaatctccactccccgccctccacccttcctggaggttgatgggtggggctgaaagttccagccctccaatcttctacttacttggtctttccatcctgaggctagctggaggcccaccccgtcactccattaccttaagctcaggtgttattgaaggagctccttatgaatagagcaaaatcacccctatcagaaatttcaagagttttaggaaacctgtgactggaaccaaggacaaagatgaaatatattttgtatgatagcacacccaccagattggatcgtggggccatatggcctttagtgtggaagctgcttgaccacattttccgcccatgcactgccattctcatttcaggctgcgtcatcatcatcatcaccatcacctgttcttagcaaaggtcgcacaccttccaaatgctttgtatagattagctcatcactccccatactcaccctgggagcatagtcagggataagaggtagagttctagcgctctgtggctactatggtttatgggatctttgcgcaggaataactggactttaaacatcttggcttttcttttcagtaggtcagtcggcatgtactcacagggccgtgcatgctgagcattgagacacatcacaagggagtgaaaacctgctgccatacccccccagaggcagcaggatgtttggataaataaggcataaacacctggagaattaaagcaagtacaattagtgcagcctttgccaagagaaaggtgtaagtgctaaatgcagtagatgttcaaatacggcagagaccacagtgggcagggtaggccaagaatgctgcctaaggagtggggcttggggtgaaactggggcatttgagacactgcaggcccatcaccctggctgcgccctcctgagggaggcagggactgaggcgggaggcctggagaggtctgtgcgtgagcctgggggctcattgataaggagcttccagtgggggcaataacattggaagtggagaggatggcatgtgtgccgggagacgcagtggagtggaagtcgccggaactgacaagggatgggatgtgagcaaggagtccaggtgagtcctggggacctgaaaggatggacccagagagataaacgacttcaaaccggcacggcagtgaagtgactgacccgcgagtgccctgcaccgaggctgacatttgacttcctgccaagttggccatcagacagttagaaatcaattttggagttcaggagagaggccagagctgaaaattggggagttgtttacattgggagtgatatacagtctctacatttccatccagttcaaaacattcttgcgtgtctgctatgcactgtgcactgaggttaccaagactggaaagacccaatccctgtcctggaagcttagtgttggcaggaggcagacaagctgatacatgcaaacaaagggctcacaggtgccaggatgccaagggatacagaagaaggatggttgcttctctacccaggagtgccctgaggtgtcttaaaaagaggagcatttatgactcaggcagggtggcacattccagacggcagtgggcaggagcctgactccagagcgccttagaggctgccgctgggagttgagctggaccctgaaggcagtagggtaagccataaattagggttaaggaaccaagggaataaggggatcagaccattgcatagctccagcagcaccattactagcagcctgtgtgaatgatggtcccctcttacatgcccaccatgcaagggctctaggccattcttcactctttaatgcagaaaagcaaaacttccagctgttttcccctacccaaaatgtgtgagcctgagcccagccccaggatggatcttgtcctaggtaaccaagaaggccttaagtgtcagaagaggtagctccaggctgaataaagggacaaatgaagcattactgcactgagatcgcccgtcgtggggtgggtctatacccatctagtcattaagcctcaataatttggtttctaaatggactattatttgctacagatcaaaagttgttggaaactatattacacagataaatagaattgtcctgcaaataaaggaagtaatctcttctctgtttgagataccatgcagtatttgtccaacttgtacaaatagttctgatccatgagaatcctccactttcaacttacttgctgctatatcccaactattataaggccatggagaccagtagcctggtttccattatctttgctctgtttttttttatggcatggttgacactacctccagtagcaaagagttaacttgtcatcagagctataaaatcacaatgataagtgaaaagttctcttttgtactttagcatccaagagaagtgtaattcccaactacaatgctcaaaataatagagagtttttactttgggcctgaaaatacttataggtcaggtctcctagttgggtccatgctgttgttggtgttccctcccaagtaaatacatactgaatttagcaaattattcatttgtgatcctctgtgccatctaaaaatatatatagtttaaaacgctggccaggcgcagtggctcatgcctataatctcagcactttgggaggctgaggcaggtggatcacctgaggtcgggaattgaagaccaaactggccaacatggtgaaaccccctctctactaaaaatacaaaaattagctgggcatggtgttggactcctataatcccagctactagggaggctgaggcaggagaatctcttgaacccgggaggtggaggttgcagtgagccgagattgtggcactgtactccagcctgggtgacagagtgagactccatctcaaaaaaaaaaaaaaaaatgcttatcattgcacagatagctgtacagttttttattatttatgataacggtaactgactttttgttaaagctggtttggaatctggaggttattttaattttgataactttatgattttaacttttaattttaactttatgatgtttgtcataaaagagtggaatgtgctcctattttgagatggaaacatttcggcagggagagagaagagagacaccaaaccacctaacagccaggttccaaggggagattcattcagcgtctttgaagcattgttagttttcatttgaggcataaattggaaacttatatctttctttggagtaggaagtatttcagacagaaaaaaaatgattgctacaacaacatcacgaaaaagaacagaaggtttcatgaagagtaataaagttaagtttatgaattagagcttcagatgggaaatcttatttggacagtaaatggttaatggtacagggacaccatgatgggggatctttgcagcattgaaaaaacacgcgtccataaatccttctctagcacttctttgtgatcacagagtcaagctgaggacaatgatggagtgctccagttcatccgaagtgcacgagtcccctttgcagcagactctgacattcccggcccctctccggagtgttatcaacatgcagtcagtgctctctacgtcattactttaaaaacaaaaactcggccagcagcagttcagtacatcttcaaagatcttgacttgtaattttttcccctgcatcttctctattgagcacatgaactgacatctttctacccccaaataatcagttctttccccctaaataaaatgggtaatccaaaaaagacccatcaaaaggaagctaaagatagtaatgcctaggtagtttcgggaccagaatgattgtctctaaatatgtacatgtacagtgattacgtgtttaaaatgtttaatgacttggagaaatagtgtgttgagtggagaaaaatgagatttagtagagcataacgtcaacagtgtaaaaatacatagaaaagcaagcaggaataaaggaatgtttaaataaattacaaagataaaaattaaaaccgtaattcagccgagcctggtgggtcatgcctgtaatcccagcactttgagaggctgaggcaggcagatcacttgaggtcaggattttgagaccagcctggccaacgtggtgaaacctcatttctactaaaaatacaaaaattagccgggcatggtgttgggtgcctgtaatcccagctactcagaaggctgaggcagaagaatcgcttaaacccaggagatggagtttgcagtgagcctagttcgcgccactggactagactaggtgacagagggagactccgtctcaaggaaaaaaaaaaaacttaactagaacatttattgagcacttactaggtgccagctagtgctctgagtgctttgtgtgtattaactcattaatgcccccagcacctcttgaggtagattaaaatctccatctcggttttacatgcaaggaaaccagagcaggaagagcttcaggaacttgccctcctagtaaagatagaaagtagcaaacccaggattcaaccccagaaatattatatactatgtttgtgctgaatcttttttttttttttttgtttttggagatggagttttgctcttgttgcccaggctggagtgcagtggcgcgatctcggctcaccgcaacctccgcctcccaggttcaagtgattctcctgcctcagcctcccaagtagctgggattgcaggtgctcactaccacgccggctaattttgtatttttagtagagacagagtttctccatgttggtcaggctgttctcaagctcccgacctcgggtgatctgcctgcctcggcctcccaaagtgttgggattacaggcgagagccaccgcacctggcctttgtgctgattctatagtcttattttcacatcctatcagttactgtaagtaactcttgattccaagaactgtataataggaaagggtagcttccaattatctactcttgcttgataatgcattaattccacatagcctttaaaagtttagtaaattttaggataaattttcgaactgttatttcctattggctgttagaaaattgtgttgctcaaaggggaacatgtctattgtgccttgtggagattttcctacagcttttctggctgacccgtcacttgcactctggaactctcctaaaccagatacggcccaccacgtggcatggtgtggatcctggactttctgtcatccgttaggttcatattcttgaagcaagtctagaactattttctgagagattccctggctgttgttctgtgtttgggtgggttagtcacctttttaggtgagagacttgatttgggtacacagtttcacaaaagtattgtcaaccctgctggccaagtgactgacgtgctgggcatgggagcacactccatcggcatggcagagtggattcactccatgccattgccagagaataggactttgaaccacagccacccggctttttctgaaaggcctgcttgggcaatgatgcctggagaattatctgaagaatgcagtctgtccattcctctggagatggtctagtttttatccccagaccaagctgaacctcttagagctgtgcatttatattgtgtggaattgccttcagcgacgtgttctataacgtcgtgttcttgtcaccttttgagggacactggtgctgtggggaagatcctcaccaatacgcaacagcagggccctgttctctcacctgccatcccctctggaaagctcacagagagggtttcctgggttgctccttttccaagcaggacttctactgtagacttacagctccagttacaagcctgtgtgcttgtctgtttccccacaaggtgttctgacctgggagggaagggacggaatcctattcatctctgaatcctaaatgccaggcctagcacttggcacacagtgggttccagttgtggaatgaatttttttcagtcctgacaataaatgttggggttctttagtttgtttgttgttattgtctgttttatttgtattttggggttttttgctttttcccccagggaatgaaaatgccttctccatatgaaccagacatatcctggggctggggctgagtgtcctttgttgtttgctctaattataactaatgaacagttcagctctggtaattgtaggcttgctggacccagtgcctgccttctaactgaatcttgactctgctccattatgtattttccatgatcctgatttctgtcaatctaatttttaaatttcattctaaggcaaacctgctcatgttcttcgctgaaatcaacctcccctttctggaatggacatatggaaaattggaggcaaaatataataatggtggtgactcagactgctttaaggcctgagagaccggccaggtactgtggctcacgtctgtaatcccaacattttgggaggctgaggtgggtggattgcttgagcccaggagtttgagaccagcctgggcaacataatgaaaactcatctctacaaaaagttactgggctcagtggtgtgcacctgtagtcccagctactcaggaggctggggtgggaccatcgcttgggcccaggaggtaaaggctgaagtgagctgtgattgcgccactgcactccagcctgggcaacagagtgagaccctgtcttaaaaaaacaaaaagacccatgagacctagactccccctgtcaaaaatactcacacacacacatatacgataagatagtatttctaccttttctttctcaaaacattccacagaacagtcttaccttcgaggagagccgtatgcatgaccttttgtttgtttgtttgagacggagtctggctctgtggcccaggctggagtgcagtggtgccatctcggctcactgcaacctccgcctcccaggctcaagtgattttcctgcctcagcctcccaagtagctgggattacaggcgcgtgccaccatgcccagctaatttttgtatttttagaagagacagtttcaccatattggccagactggtctcaaactcctgaccgcacattatctgcctgccaccacctcccaaagtgctaggatttcaggcataagccaccatgcccagctggaggccttatttttactgctattcagagaacctgtggcttatccatggagggcttaagctttgccttttctcttgctcatttccatacctagcaagagcttaagctggtttattgcactgacattctaatgaaatataaatagcttctcaacagagagataagaaagaggagtatctagtacagcaagaccctctgggtgggtcagggccagctggggccgtgccggggctctgagtggaggaggtggcgtgggagcactgatgctcgggctctgtcacatccgtttttggcatttgtcctggcaaaggctgcatttctgatctttcagaaagctgtgggtacactgtacagaaatgtgttttgcttgctttgaaggatgacctactggctgacagccagccagaattaattccatatacatttgcagattttcagtatgagagacggcaattagcctacagaaacccatttaacccccgaggtggagctgtatggtgaagactgttatttatgggagtctgtgtaatttgcctctgtgacaagggacagccatggctcaggagggcccacgccaccctccttttcaaggactcctgcccctgcctgagtggcttggcctggcctggccatgtgagtcttgtggacacgtgcacatcagtcagggacccctgtggtatggaccaaagggttgttttttactgttttaacttatttaatagcatctcatcagtattacaggcatgtgccgccacgccaggctaattttttttgtatttttaatagagacggggtttcaccatattggccaggctggtcttgaactcctgacctcaggtgatcaccccgtgtcagcttccaaagtgctgggagtacaggcgtgagccaccgcacctggcccacagagcttctaaaggaaatgtgttggttttttaatcaaagttgaggcagtgcctcagtgaggggcaggctggagcagtggtaagcgcgctgaaggagtcgggctctctgggcccaaagtcctgccctggccacagagtggctcccttccccctgaggtgggatgatgttctccagggccttttagctccaggctgctacagttctaaactggtggtggtggtggtggtggtggtggttgtggtggttgttttagatgcagtctcactcttttccccaggctgggatgcagtggcatgatctcggctcactgcaaccttcgcctcctgggttcaagcgattttcctgcctgcgccaccacgcacagctaatttttgtattagtagagttggggttttgccatgttggccaggctgctctcgaactcctgacctcaggtgatccgctcacctcagcctcccaaagtgctgggattacagatacgagccaccgcacctggccatgattgttgtttttataaaatcagaatataaaatttgaaaatgttcttttttggtgagaaatgagaactaccaaaggagtaaaatgctctaaaagccatcaggtccttcccacagtattgaggctctgctcttaccattttgttaaataagttttgttcctaacactctttgtgatatgaagtattcttgctaatcaagctgcccggagactggcgtttcccagagcagtttcgaaagtggaaatgatgctgcatttcctacccacagtctggagggtggctgtgctctctgcacggtgggtctgtgctgctcagttacgggatggtaagggaaggctctaactcggtgtcttacaccatgcactagggagtcgcccgctttatttacgagcgagttgatgctttcagtgggttttggctttgcctggttccagactcaagcccttcctctaatgtagggcgggtacaagagagacttgagcaaggatattgggatttaagggaagggcagtgcaggccaaggtcagcaagaggacatctctaagatgaacagcactgcatttgtgggaagcaaccctgccataaacaactcagttaacgtttacatagtaaataattgcattgccttgggctggaatagggacgccagaaggtataggaccatgtggaattcagaaaagggagccctgaagaatgagattttattgttcttaccaggagagtccaggtgctagagttctctccttgtaagtgactaaccttctcccttttggtacacaatcctcagatgaacggagatgattcattaggccattctagcttaatggatgcatcactgtgcaaccacgcaaatgcctcatttctgattcactcatttaatatttattgaggagtgctgggtactaggccattagaagaacaaacaacaacaacataggcctggaccttgcacttgcagagttcacaggctagagaggcacacaagttaaatatagagacagctgaaagagctgacgtctgggacagagggagccccctgctccaggagccagggagcagatgccatggggggctggcagggatagggaagtcaggccaggaatggggttacctaagccggatcatgaaggacgagaacagactcaccaggggtcgagggacaaggaggcagcaagtccgcagcatgaaggcaggagagaacattgctgtaagcctttaccatggccactgcatggggaggaaacaggagatttggaatgagctgtgacactgggcaggaaagcaagacccaggtcttgtgaggccttgagcgtcaagcttaggagtcaggacctggggattttaagtacagcaatatcataattacattcatgtttcagagagatcactcaggcagcagtctggaaggtggagtggaaaacggagaaattagtcatgaagacctatttagaaagtagtaggcaagaaatacccagggcctaacctgaggtgtaggcaggggatgggaatgagagcaattaccgaactagaatgaactaaactcaatgaacaggagcggggaagagggaatgcagaaatggctctcagatttctgacttgttcgcttaatgactggggttgtcatttgtttagataagcaataaagaacctagaaacaattttaggcggaagatagttgtgttgggagcccctaagaccatgatttattacagcacaaggatacaaagcaaaattagcaaaaggaaacagcacgtggggtcaagtccaggggagctcaggcgcaagcttccagagtactctccccatagagtcacacaagatacacttagttcctccagcattgaactatgacgacacctgaaatattgtctgcagaagaggctcattagagactcagtccccaaggtttttattgggtaatggtcacgtaccaaatttcagtctctcagaacaaaagcaaatgttcagcatagaccattttgtttgtgaaatttaggcacagtgagcccctcttgtcagttagaggatagttgaaaccctcccacaatccaagttctcagactcaggcctgctacattatttctttcctacacagtagtggatttggttactaacatgttggatctgaagcatttgttgtaatttacagtgaagatgtccactgcacagttccgtattgagtctgaggttcactggagacatctgtgctatcaatgaaagtttctggagtcattagcccctcaaagggtcattaaaaccaggtcttctagagagaaagtctaaccctgtattcctttaaaccaccatagagaccatctagttcttcacattataaaaatgagaaaactgagtccccagcgatgtggcttggttgcacatttttctatttcaagtctgttactccttccatcataccagactgcctcacaaaatgacaaagtcaggcattgttcataaaagaacaaaatggcatttaggttataaatcaggcccttgtaagtttggttaatacaacttatttcccaaagatcctggtcctcagaccctcaaaaggagagctgatcacatcaaggcctctacctggaaggaatttctaagcagcctctaagtcaactgttcatgttcagtccaccttgatttacaaagaacagtgaatcattaagacctttctctccaaggccgggtgcggtggctcacgcctgtaatcccagcactttggaaggccgaggcgagcggatcacgaggtcaggagatcgagaccattctagctaatacgatgaaaccccgtctctactaaaaatacaaaaaaaattagccaggcttggtggcgtgcacctgtagtcccagctactcgggaggctgaggtaggagaatggcgtgaatccggggggcagagcttgcagtgagccaagatcgcgccactgcactccagcctggagaacagagactccatctcaaaaaaaaagaccttttgctcctctttgctcttgtgtctgtttaacagatttttatgttaacaggcactctgtttgccactaggaataaaaagataaatgggacaaagtctttgccctcaagttacttatattctagagccaagaaagagatagatgaagaacacatcttatatattaggactgtgttgggggcaggagtaggcagagtaaccctttggatatgggaaatgaaaataaatcaaactcaaaacaagtttattatttgcttgaagctctggtaaaagataaagtgaaacctgcaaactgtaaaatgaagttgctgctacacatttctccagttttggatttcattcttggatggcctttaacttggatagaaggatacaagacagccatatatatatatatatacagctgttgctctttaagatatccacttcaccctgttgtggggtgggaggaggggggagggatagcattaggagatatacctaatgtaaatgtcgagttaatgggtgcagcacaccaacatggcacatgtatacatatgtaacaaacctgcaccttgtgcgcatgtaccctagaacttaaagtacaataaaaaaaaaaattaaagaaaagagatccacttcgctcagcacatgtgatttggctttggtctttggtgttaatttggatgcctaaagaactgactttccttgatgctcactccagcctttttaggactagattggatacatttacatgtttgctggctgttttttctacagtcacacatcctacccataataatattgcaatattctaagttgtcttggaggatatcatcaagtaggtgtcaagtaaaacttaatggtagactgtaaattttaaaacaagttacaggtcatttgtgtagtctctctctctatatatattaaaagaaacaaaacttttccctcttgaatctttattcctatctcagcttcatttattgcctcgtttgtcatctaaatggtctttgttctttcagctttcaaacatgattaattgacattgtgcagcatagcacagggaaaaggctgaatattttgtatgatgagtaatctagttaaacgcccatctttcttttcaactttaccaacaaatgtgtcttatgcagatgtaagggcggtttgcttatttccctgttcaaaattttatgctattagcctagcatagcatgtttcttttccattgagctagccaaaaataatattgacaaattcatgaagccttccatctgatactgttgcaaacttatgcaaatgtattttagactgttaagggaatgtaagaattaaataattaaacatccaaatgtcaagaatgggataggaagaagtaactggcctcatgttggaagttaatgaaatatttgaaaatatacctttaaaatcaaagacatgaatttgtgttttgggtttttttttttcagatttgaataaagcagagtataatattatagttgctgcaggaagttatgagcatttctggaagtgcttattttcagcacatgctacttagaattttaaaggacattcagtgtatctttgtcatgaatctttctactgggaccaggccactcctggatgaactcacagattgagagcttctcaaaatgtaaaatcaaattgtcttttaaaatatgctattttaaagttctggagaatcaatgaactttaaatgaaaatcggccaatacttggcaaaaagtcaatttgaagagttgtctctttataatctctgatttcacttatagagcttgcttccaaaaaaagtactacgtatgtcataaatctgaaatgttttgcttttatgccatttttaagtcctgataaatattcttgaagtgttaaattattattattattattatttgagatggagtcactctgtcgcccaggctggagtacagtggtgtgatcttggctcattgcaacctccgcccccccggattcgagtgattctcctgcctcagcctcccgagtatctgggattacaggtgcctgccactgcatccggctaatgttttgtatttttagtagagacagggttttaccatcttggccaggctgttcttgaactcctgaccttgtgatccgcctgcctcggcctcccaaagtgctggaattataggcatgagccgccgtgcccagccagtgttaaattatttttaacttgttagaaataattgtcccacaacttactgaaggttggtttaatattcactattgttcccaaaaaactcttaaaatattaaaccaactcatagctcataacttttcaaggtagcaagtgtttgctaatcttaaaatgtgttactattctttttttgttttttttttgtttttttgtttttttgttttgagatggagtctccctctgtcacccaggctggagtgcagtggtgtgatcttggatcactgcaacctccacctcctgggttcaagtgattctcctgcctcagcctccccaagtagctgggattacaggcgtgccactacgcccagctaatttgcttgtatttttagtagagatgaggtttcaccatgttggccagactggtctcgaacccttgacctcaggtgatccacccgccttggactcccaaagtgctgggattacaggtgtgagccaccatgcccggccactattcttaagtgaccttctgcacatctctgtagttttatgcctggtgatggcgtttaatttaggagtatctggcatgccactccagtctgacagctaggggcatgttagcaaagggggcatttttcaggtgagtgggtgagcatagccgtgctgaccatctttcctatccagagggaaggcctagcagggactcacgccatcttgacttgcctgccccaggctccctctcactgctcccctggcctcttcctcttctccagacaatggggccttatgctcgctgtgtttgtcagaactctcttgtggttgtggctgcaagtaagagaaactcaactcgagcttattcagaaagaggggatggattgacccagataacagaaaagtgctaggctagatctggccttagccacagctggatccagccttctggcatttgtgctccgttcctcagccctgccccactgggagtgatgccttctgttcacagtgtgatctgcttcatactcaaaactccctatccagaggaagaggaatcttttctctcccaccatctgcacagcagtattcaggaatcccctgccaggctctgttggcctcatgtgccctgtcctaatccaccactgtgcccagccagggtgtggccatacatgcccatcctgtgcatagggcaggagcagacccacctgcaccacatgcggtggccgccatgaccacaagaccaggataggagtgctgatcaggccagaccccaagggctgttgctcagaccatacctggcctgtagagtagaagaactaaatgtctcacacaggcaaagactactcttcaattcctttaattgcaggtgtatgttggagtccatgaaatacaaagttattgagaagcataactaaatttatagtagctcctcattatatattttcatgttgataggattctgcccccatgggaattaattttcttcatcaaaagtgatctccatactcacaaacactgaatagctttgggcttttaaaaacaatgttttggctttaaaagaaccacaggaggctgggcgcggtggcttacgcctgtaatcccagcactttgggaggccgaggcgggcggatcatgaggtcagaagattgagaccatcctagctaacatggtgaaaccctgtctctactaaaaatacaaaaaaatcagcctggcgtggtggcaggcacctgtagtcccagctattcaggaggctgaggcaggggaatggtgtgaacccaggaggcagagcttgcaagtgagctgagatcatgccactgcactccagcctgggcgacagagcaagactccatctcaaaaaaaaaaaaaaaaaaaaaaagaaccatggcaaaagtgtcctttagccgggtgcggtggctcacacctgtaatcccagcactttgggaggccgaggcgggtggatcacgaggtcaggagattgagaccatcctggctgatacagtgaaaccccgtctctactaaacatacaaaaaattagccaggcgtggtggcaggcgcctgttgtcccagctactcaggaggctgaggcaggagaatggcgtgaacccgggaggcggagcttgcagtgagccaagattgcgccattgcattccagcctgggcaatagagcaaaactccgtctcaaaaaaaaaaaaaaaagtgtcctttagtctactgttggttcttccaaagagccatcctttcgctgatgctttaggaactcccaacctgggtcctgtcaaggataagctctcatcttattcccacaaaattcctagagttactcatcattttcctttcatattcagctcattaaagcagtttgtaggtctctgtagtccatattagtaagtgttaaaaatgtatcaatttgattttttttttttttttgagacagagtcttgctctgtagcccaggctggagtgcagtgttgcaatcatggctcactgcaacctctgcctcctgggtttaagggattctcctgcctcagcctcctgagtagctgggattataggcgtgcaccaccacgcctggctaatttttgcatttttagtagaaacggggtttcaccacgttggtcaggctggtcttgaactcctgacctcatgagccaccgctcccggccatcgatttgattattataaaatcaggttatattggtttgaccagttaaaaacatcacaggttatttaatctttttatttatttatttatttattgagacagagtctggctctgtcacccaggctggtgtacagtggtgcaatctcagctcactgcagcttcgacctcctacgtccaagcaattatcgtgcctcagcctcctgtgtagctgggattccaggtgtgcgccaccacacccagctaatttttgtatttttagtagagaccaggcttcaccacgttggccaggctggtctcgaactcctggcctcaagtgatccacccgccttggcctcccaaagtgctgggattacaggtgtgagccactgtggccagctaatcacttttttaaatcacaatttgtgttacgttcatgagtaatgggtgccagaaataatgttgtgtgttaaacataaatgtagatgggtaaccatgtatacaaatgcatatctcctcaacccagagagtgaaatttccccaccccagtgaccctgcctcgctgtatggttcattcttctccaggaattgaaacatggtggcagcctgccagcttggcgttaccattaattcttattctcttcccctgccgatgtcatggggacaccagccaaatgaactctgatgtgtctcacgtaatgcatgtggacttctggtgcatgtaaacagagggtggttattcttgattgcacatttgtgatttttagtgaggctctaagggagaagcaagaggacttgaataacagatttattctcgggcactggtacatgaaagagatgagtaatgccaaacaaataacacaattctgattcacgccattggtaatggaggagacttctgggtaaacaaaccaaagtaacagctagaatgcagatctgatcacagcagtgtgttttgattcagtctaaagatgacaaagaaaagtttctgctggtcctatctgtagcaacaagggcctgcccgcctgaccacactgcagtggaacagccacattgtgattttgcgggcctgaagcctttcgtctggtgaccctttaagaggaacttgagccaagatcttatcagtgatggagatggagacacctcaggattttccagtatcgtttttcactttttgttcttggacatagttaataacgctgccaggtctttcaaatgctgaggcatttcctcatagctccaagtagctgctgcgggtcagattctgcttgaaccgagggttcaattacaacatccgtatgctttccagcccactctctgacctttgttctttttttcagtactttttcaggctcttaatgtttccatccactaatctcaggagactctgtaaatattctgagtatacatagcccaattacttttgaaaagctaatttaatagaaacttcttgatatgaattgaataaattttttaacttaaaaatcatttacttacaacttaagacagttaaacttgagagtatttgaaagctagtaaacttcagagctttcttcagtaggcacgaactttaccatttttctgacactcagcacggtcagcaatgacacattcattggaggactcatcaatatccctaaaaatagtagcagtactcgtgcacagcctgatttcttttgaacttggctcaatttcttggaagcattgatcatgggatcccgctttgattccttttctgtagactagtgccagtttgcccagtttcattacatttttggaaagagctaaaactatggtatcgttttattgcagtcctcacatcaatcataatttggagcagtcttggtgaaagatgaggaattcagactgggatcctgggcaaggcaggtccagggggcaagagggatggaatgcagtgagtacttattttatatcataagtacagccacctcagcctcatgactttttagccacggcttcattccaaagtgaccacagtcataaggcccaaaactatcttctctctctttctctctctctctctctctctctctctctccctccctctctctgtcatagggacctccctaatcctccaggttgtacagccaggaagggtaaggtattgtcaaaaacaagtgaggtacccccttgatagctcagtgggccagagggcctctggatgctggctgatcatggcaaaaactaaatacagaatccatacagtggattctctgtgctttttctcttcacccctccttacccttgaccaaatttctgactgtgttattttcttattgcagtcctccctgctagatatacaactttgactttcatcagaagaaagtgctcccattgcattattagctaaaccatgttgcagtggcaacgctccttcttccagcttgcctcggtgtttctgtagttagcatcaggtgtccttggttctgtttaccagcctgtccagggatcacttccctggtgggatctctctggtgaccctcatctcagagctcagcggtgcctttggggctacttgccagacaactccatgtgacagagggccaggtccaagtgctcgatcaccccagccaccatttcagagttctcggattatagatccctcaacgagtcccagtgagacaccgaacatgccatagaagctatgtttttctatttcagcacacagtaaaacactacctcttagatgtcgatgagtacatgctgcttttatgttgacgcagaggacctgtgttgactcttcatcggcaaggtgtcttttttttaagtttcaattgacacataccacctctggcccaagtggaccacacagttatgcatgccctttggtgcaagatacatcacgtctccaagaactcgggtgtttttctgatcatggagaattagattccacatatagcttgtatttaggatctgcagattaggttttataaattatgtttggcaaatgataatccacaaagtagattctaagttaaaatactataaagtactataatttatgtttaaatgtctttcaacctgagagttactctcccttagaagtccccaaaaatgctgaaaccacaccaggttgatatctgacctttcacttttggaaaatgtgtatattgttgaacctctaatctagattcggacaccatcaccaaccagcttctctctttcagttgccatctgcactttactgtttagtttttgttgtctttagggaaagttgtaaaatacccacattcttctcaagttcttcaagtcttttggtttttagtaaacccttttgtgacattgtctttgagaacagaggtcaacaaacatttccttaatggactagatagtagatatatcaggacttgcagaccacatggtctctgtcctaactactcaactctgccgttatagcacaaaaccagccgtactcaatatataaatgaatgaccctgtggctgtgttccactaaaacttcataaaaataagcagctggccagatttgctgtgtgggtcttagtttgccaacccctgatctagaagaaaagagttttgtgtaatgtttgggtaataaaataaacataccaaaccatctcaggaatccctaaccttttcctcattgggaactattttcccagtatccccaagtactggtgggaatgagataaaaagggccaggcatgccattccctaaagcagatagccaaccctctttctttccctgtggaaatcccctctgcctacagggaggagaagcaactggtttggaagctgccagccagtccgtttatttagaaaattctaagcccagttccagatcactttgcgtcaactctaaaatacagccacaaatgaaataaatgttgtttataatcctaccaagtctagtaggtgtgtatgtgcttgaggttaaacttttgtgtaagctccagacttactttaggtttatagaaaattacatcgcaattgatacaatggttgtgttgggtgatggagatagaaagagggagaagaagtgaaagtgaaattttggtcaaaattggataccaccctaataagccgggagataaggggtgctgcagaactgttttctgtgatacagtgcatctacattgataatttgtgttttatgtacttttaaaatgaggctttattggcttgatttctgtgagaaaaatcactaatgggctgatcgtactgctctacttcaacatgcaagagaattgctcagacgcttgtcagatgcctgaaccacatacttatttgagaatgtgccatcataggaagctttcattcaccaaggtcaccgagagggcagcccagggaagcacgttgaacttcgcatggttctggccactcgtgtcagtagcaaagcaaggaaataaggagctgacttgcccaaaaattacaagttcagagaaaacggacttgttttgtttggaaaaggcagataacggagcagtaactaaagaatcctctttttttattattattgttgttgctcaatttataaacctaaacagaaaatgtgtgttgccttatttcctcttcttttctacagataactttcttttaaaacattctaaatattaagcaacattgtaagtacagattttttttttttttttttttttgagttggagtctcactccgatcatccagactggagtgcaatggcgcgatcttggctcactgcaacctctgcctcctgggttcaagcagttctcctgcctcggcctcctgagtagctgggattccaggcacccaccaccacatttggttaatttttgtatttttagtagagatggggtttccccatgttggccaggctagtctcgaactcctgactcacctcagcctcccaaagtgctgagagtacaggcgtgagccaccacgcccggctagtacagaattttttatggccccttttaaagactgcaaacctttttataccaaaaaaaaattatttttcctgtatttattttacacattagtaaatgaatgaaattttggctctaggtttagaaagcaatttcattttaagctcattttactgtgtcattggactttttattaattttattcttgaactacttagctgaaaatcgaattctgtcattatatgtaatcatataatgcttctcataatgttacactttaattagatgcagttgaataataacctaaaaaatcttcatagtctataaaattcacacttatatttataagacaatattatctcacccattgatacataatgttatgttaaaagtacacaatatggccaggtgtggtggctcacacctggaatcccagtactttgggaggctgaggcggcagatcacttgagcccaggagttcgacatcagcatgagcaacatgttgaaaccccgtctctaccaaaaatacaaaaattagccaggcatggtggcgcacatctgtaatcccagcaacttgggaggctgaggcaggaggatcacttgaacccaggggacagaggttgcagtgaacagaggttgcagtgagcggagattgtgcctcctctgcactccagcctggatgacagagtgatactctgtctcaaaaaataaaaagagtacacaatattatctcacccattgatacataatgttatgttaaaagcacactgcattctagagaaggtagagtaacagggtcttactttaccctcccacttgaaacaagtaaaaaactggacaaagtatatgaaaaatacatcactcagggcattggacaccaggcagcaaaaaacagtggcccctgagaaattggaaacaaagtgagtcctataattgtccttatctagaaaaagtttcctggctactgtgtagagagaaggaacccaggagaaagagctcaactgtctccctgagttgaagacagagctggggatacatcaagggaaaccaaggcagctagtttgcagaggtggaggaccggagaggagagaactgcatagagagagctttgcggatgtacagagtcctccttgagcatgcaagtgcgtactgatcaaagtgtggttgtgagaaaactacccatcaccagagaaaggatcacccgaaagaatgagggaacagtgcctgcctcccacacagtagccaagaagaggtgcctgttgccaacagctagagtgaaaacctctgaatgcaggggcactggttagaatactaagaagggtcttgccagacatccaatccaaaattagcaggcatgcaaagatctaggaaaataccacctaaaatgagaaaagtcaatcaaaactaacccattatacagatgatagaattcatagacacggacattaaagtagttgttgtgactgtagtttgcatgtttaagaaactagaagaaggatttaacatgttaaatagagacaaagaagatataacaaagatataaatcaaactgaagagatgaaaactgcagtgcctgaaatgataaaaaaaaaaaactcttaattaatagcagattagacattgcaaaagaaaagcctagttaacttaaagacatgcagtagaaactatctgaaatgaaacagaaaaaggctgaaaagaagcaagagagcaacattgagctttgggatcattttaagtagccaaaaatatgtaaaactagagtcccacaggagtggaaaaaaggaactgaaaaatatttgaagaaataatgggcaaaacgttttcaaatttgatagaaactataaactcatacattcaaaaaaatgagaacattttaaaaagagaggataaatgacacattatgtagagaggaacaaagataaattggctgatgatttcttgttggaaacaacacaaactagaaggtggtaggtcaatatttttaaagcagtgaaagaaaattcacagcctagagttttttacctggttaaaatatctttccaaaacaaagctgaaataaagactattttagacacgtaaaagctgaaaaaattcatcactagctaacctgaagtacaaaaagtgttacagaaattcctgctggcagaaagaaaatgataccagttggaaacctgaatctacccaaaggaatgaagaacaccaaaaatagtaaccgcatggatagaaagacttgttcttactgtttatcttaaaagctattactgtatacagtaattactgcataaagcaaaaataataaaaatgtagtatagcgttaaaaacatttagaagctaaatatatggcaacaataacacaaagtctaagaggagagaaatagaagcatgcttttgtaaaattcttaggctatatgtgaagtagtataactatatgtggtgtggtagtataattatatgtgaaggtagactgtgcaaagtgaaatgtgtatgtagtcatgtgctgtataataacgttttggtcaaaaacaaaccgtgtatacaacagcagttccatcagattataatactgtattttttactgtaccctttctattgtatgtttgcatgtataaatacttaccattctgttacagccacctactgtattcagaacaataacatgctatgcaggcttgtagccctggtgcagtaggctgtaccatacagccaaggtgtgtaggaggctataccatctaggtttgcaagtacactgtatgatgttcacacagtgacaaaatcacccagtgatgtgtttctcagaatgtacccgtctttaagcaacacaggactgtgctgtaaatgcaaggtaaccatttcagtaattcaacaacgttatagttaaagagttgtaaccttgttatagttaacaaagttaatatatagttatctacaaagtagataaaatgaaatcattaaaaataatccagaggaagcagaaaagggaaaaaggaacaaagaacagataggacaataagaaaaagaatagcaaaatagtagatttaaactcaactatatcgataatcacactagatataaatgtcctaaatacactaattaaaatgcaaagaatgtcagattggctaaaaatgcaagagccgactattactgtcaacaagaaaccctttttaaatctaaagacataagtaggttaaaggtaaaaggatggaaaagcgctaatactaatcaaaagaaaattgaattggtatatcaatatcaaagtagaactagagcaaagagtagtaccaaggatataaaagaggcttgtttcattatgacaaaggggccgtttcacgaacaggacatagcagttctaagtgtttaagcatataataacagagcatcaacataaatgaagaaaaaaaaagataaaattatagggaaaaatagaaaatccacaaatatagtcagaattttttaaacccctctcagaacaagtagagtaaaaatcaataaggatttagaagacttaaacaatgctacaattcagcttgactccacccaacaacagcagattacgcattcttttcaaacgtacacagaacatttgccaaaatagaccatattctgagtcacaaaatgtcttaataaatttgtaagggctcaaatcatacaaaatatgttctctaaccacagtgggattaaattagaaatcaacactgaaagacatctggaaacactccaaatatttggaaataagctacagagtgggagaaaatatttgcaagttatctatttgatataaggatttgtatatggaatactaaaactcaaaactcaatgagaaaataacgcttttaaaagatgactgaaagatttgaacacatatttcacccaagaaaatacatgaaaatatgcttaccatcacaggcattagggaaatggaaatttaaaccacagtgaataccgctgcatagctattagaatgtctacaattaaaaagattgaccagctaagcacagtagctcatgcctgtaatcccaacactttgacaggcagaggcaggaggatggcttgagcccagcctggacaacatagggaggagactctgtgtctacaataaaagaaaaagaaaattagccagttgtggtggcctagctgctcacttgggaggatgaggtgggaggattgcttgagcccaggttgaggctgtagtaagctgtgattgcaccactgcactccagcctgcaagacagagcaagaccctgtcccaaagaaaaaaaagattgggctgggcacggtggctcacagctgtaattgcatcactttgggaggctgaggcaggtggatcacttgaggtcaggagttcaagaccagcctgggcaacatggggaaaccccaactctactaaaaatacaaaaaattaattgggcatggtggcacacgcctgtaatcccagctactcgggaggctgaggcccgagaattgcttgaacccaggaaacagaggttgcagtgagccaagattgtaccactgcactccagcctgggtgacagagtgatactctgtctaaaaaaaaaaaaaaaaaagactgaccataccaaatgttggcaaggatgtggaacaactggaaccctcatacactgctggtaggaatatataacagtaccacccccttggaaatcaatttggggtcgtttcttaaaaagttaaagtgcacctgccatatagtcaagacattctctttctaaatatttacccaagagaaatgcagtatatgtccatgtaaagatccgtgcatgaatgttcgtagcagcttttttgtaataatatacagtaagctttacactttgacatgtgcagtttattgtatgtaatttgcctcaataaaagttttaaataatacaattttatccaaaataaagttgtgaaaagtagaaaaatgaggaaaaagtttcaaaggttagaggggtcagtccaggagacctaacatctaactaatgggaattccaataagacagaagaaaccagaagggaagaaattatcagagaaataatcctcagccttccacccaaaattttctctcctagaactgaaggactcccaaatcaaaagggtcagcaaaataaatgtatagactcacaccaacacacttcatcataatagtaaaaagaacagtagagtcaaaaagaggatactaaaagctttcagagggggaaaaaacaaaacatgcaaataatctggaacccgaatggcatcagacttttcaacggtaatactgggctgggtgcagtggctcacgcctgtaatcccagcactttgggaggccaaggcaggtgaatcacctgaggtcaggaattcaagaccagcctggtcaacctgatgaaaccccatctctattaatagtacaaaaattagcttatttcttaaaagccagcaagggggatggttttttccttgggctggtggcacgcatctgtaatcctagctactcgggaagctgaggcatgagaattgcttgaacttgggaggtagaggttgcagtgagccaagatcgtgccactatactctagcctgggcggcagagtgaaactgtgtcttaaaagaaaaaaataaataaaagttatcaaaaaacaaaaacaaaaccataatactggaggctagattacaatagagcaatatcttcaaaattcaaggaaaatggccaggcgcggtggctcacgcttgtaatcccagcactttggaaggccgaggcgggcggagcacgaggtcaggagatccagaccacggtgaaaccctgtctctactaaaaatacaaaaaattagccgggcgtggtggcaggcgcctgtagccccagctactccggagaggctgaggcaggagaatggcatgaacccaggaggtggagcttgcagtgagccaagatcgcgccactgcactccagcctgggcgacagagcaagactctgtctcaaaaaaaaaaaaaaaaaaaaaatcaaggaaaataatatacccagctaaaccatcatgaagtgtgataagaataatgacgaagccagacattttagaaaaatctacccctagcgccctttttctcaagaagccactagaggagtatttcactcaaatgagcaagcagaggaaggaggattgcttgagcccagcctgggcaatgtacagagaccccatgtctacaaagaaataaaagaagaaaattagccaggtgtggtggcctgtagtcctagctactcactcaggaggatgaggtaggagaattgcaagtaaatgagcaagtaaaccacagaagaatattaattttctcttttttctgctgcataacaaatgagcacacatttagtggcttaaaacagctcacatgtattatcttccatttctctgggtcagcttagctgggttctctgcttcagactgcgaaaattgtctcatctgaggcctgggttcctcatcaaagctcatttggcagaattccattccttgaagttgtgggactgagggcccagctttttgctggctgtcagctggaggccacacccaggtcccagaggccatgtgggtttttgccatgagaccttctccttcgtccattcacagcatggcagcttatttcttgaaagccagcaggggggatgggttttctctggaatctgttagatgaagtgacctcccttcactgtcactcgtgccatattctgctggtgagaagcaagtcacaggcctcacctgcactcagggagggactcactgggagtcgccgccacagtgtggctccaggaatggaaactaccacactgcagaggtgcagggaatccccaggattatggtcaagaaagagcccactaagtgttttgttcagtaggcctgcaggatgaagggtgccaggaggatggctccatgaaagactgagcctatacgtgaacgtactgaaagctgacttacagttcagccagtgtggtggtatgtgattgacagcgccctagcaagatgagcaacaaagatacaagactccagcagaaacaagctgcagaagaacaggagtgtaatcaataaatcagatggccttgctgtgaacggttacatagctctgataaatcctgatctaaccaaaagtcatgacagctcgatatttgggagctggagggggtggggagtaggggtagtaggatatgaaggagctaagtccccattgttgatattagaaatccagtgggtaacatctgaacggcaagaccaggacagcagcgaaaggcaaaaagacaccactgagtgttgacagtggctgcctttcaggagtgggaatgccactgggggcagggcagtggggggcagggaacaggtttttctgtttgttttttgtttgtttgtttgttttgttttgagatggagtttcactcttgttgcccaggctggagtgcgatggcatgatctcggctcacagctggagtgcgatggcgtgatctcggctcaccgcaacctccgccccccggattcaagcaattctcctgcttcagcctctcaagtagctaggattacaggcatgcaccaccacgcccagctaattttgtatttttagtagagacggagtttcaccatgttggtcacgctggtctcaaactcccgacctcatgtgatctgcccacctcggcctcccaaagtgctgggattacaggtgtgagccacttcgcctggccatgggaacagtcatgttgcatagtaagccctaaagagcagtgtgatctcttaagccagcacgtgatttactttggtaaaaattaaattaaaaaaaaagaaattaggccaggcgtggtggctcacacctgtaatcccaggactttggagagccgaggtaggcggttcacctaaggtcaggagttcaagaccagcctggccaacgtggtgaaaccccgtctctacttaaaatacaaaaaaaatagctgggcgtggtagtgcacatccataaatcccagccactcgggaggctgaggcaggagaattgcttgaacctgggaggtggagatttcagtgagccgagattgcgccattgcactccagcctggatgacggagtgagactctggcccaaaaaagaaaaaaataatcctattggtctcatagtgtttctctgtatttttaatatactgtgtatgtgcttatgagaaaccgaaagagaagtgatttgtgaacgatttgaggacttttggtccacgtttttttctcccacttatacttgtggcataatccagaggaagaagggcagctgcggagtcccagcagtgttgcgggtatcagggcagccagtgagaggatggaggagaaacccaggagagggcagaggaggagggacagctgtgcccacctggtcctttcattgttgtctgcctctgcccttgcagttagaaaaagagtgttctgtgtatagaagcctttgcaagtagcatagttaggagtctttcggtccaggaattgaaggtgctaaagcaggaggaaaacatacatagaagaaaggaaatgtccacataagtaagtgtattagtctgctagggctgccgtaacaaaagaccatagactgggtggcttcaacaacagaagtttattttattttctcacagttctggaggcgggaagtccaagatcagggtgctggcagggctggtttctgctgaggcctctcttcttggcttgcagacagctgtcttccctgtatgtcgtcttctctgtacacaaacatccctgtgacctcttcctcttcttttaaggacactcagtcctattggattagggccccatgcttatgacctttttgggttgttttttgtgtttgttttgagatggggtcttgctctgtcacccaggatggagtgcagtggcacgatcatggctccctacagcctcgacttcctgtctccaaatgtagtcgtattgggggattaggatgtcaatataggggttttgaggggatgcagttcagtccattatatacagtaagccacttctagacccagtctgaagtcctgagcattcagctggtatctggagtggatcacctaagaaacattacagaacaatataggcctctggtatttaaaatagtttaattacgtcacagggtagtcctgaattctttcctacttcagccagtcttggccagccgagtttcagggtagtgatgagcactgatgaggtgactcccccttctccaaactcttcctttgccactgtcccaagaaaaccataaaggggaagtttaaatgatggatgtaattttcctgacttgggctgggcgcagtggctcacacctgtaattccagcactttgggaggctgcggtgcgcagatcacctgaggtcaggagttccagaccaggctggccaacatggtgaaacgctgcctctactaaaaatgcaaaaaaaaaaaaaaaaaaaaaaaaatagccaggcatggtggcacacgccagtaatcccagctacttgggaggctgaggcaggagaattacttgaacctgggaggcagaggttgcagtgagctgagatcttgccactgcaccccagcctgggtgacagagactgtctcaaaaataataatgatttccctgtcttatgtttttctactacacagcttattatctctgggcaggagctttcccagggtcggaggggcaagggtctagttgtgagggagagaggtgaaagcaaaagggaaatgctaaatgacatggcacagcaagcaaggtctaggcagctgcgcctttgataacaagctgcttgaagagaaagaccagatcggctgagtgaaagcactgtccatcctccccaccccttccttcctgcttcctcctcttcccatctcctccagcttctccttaaagggactaccgaatgatgatttccttgccagtaggaccttgacataaaacccagcccacaacatcacagttgattttcaagggatgagcttctcagaaaccagaatttaattacttaattttgagtttccaaacaataaaatatattattaaattgatttgttttccacacgtagtggagattttcatggtgtgctacctgtcggtcaaacggctgatgaatgagtatgtcgcaaaaactctaggtgggaatatgacacatgaggaatggaatttgtgcttcagctcttcccagcatcttcttgggctgcacaagagttggtagtctttcatctcctaaggactgaagggccatttagaatcacacctgttttgagtttatagtcacgcttctgaaactttctctcttacagccttatctgacctcaatcaagctacccctgttcatttaaatactttaggtcttggctattggtttagcttaacatttgattgccataaataagaactacagaaagcgtgacttgtaaaattgtagacccagaaaaattagggaacaatctcataatactaatgaaaccttttttcccataaaataaatacataattagatatagaagattttttttttggtttaagctatcttttcctatttctatcttaaataatttacaactctcctttaatccaggcaattatcaattctataataaaataacaacaatgggtactgtgtattaaactctaaactagggtccttcatctcatttgaattttgaaatgactccataatatattgttatactcatgctgtagttatagataaagaacgagggctgacctttgacaatcacaatcaaaaaaaacaaaacaaaagaagtgaaggctgagcgaagtaactcacccagcaagatgcaattcgtatagggtagagtcccctgtctcccgataatgctttgccccacacctgaaagtcttgatctggttcccattacccctcagactttgggtccccagtagaacctttgcacttgcagttctccttcctaatgggctcagggaaactcacatgactgcctggaggctgtttctgcacctgtagatgggaatgggcaagtctctcccgactcacttgtctcatagtgttgttgaaaggctcaggtgtgatcattacagtgaaataaggaaaggcagggaagaatctccatcgttctccaaatacgaagaatgaaatgcaatttttttttttttctttttgagacgaagtctcactcttgtcacccaggctggagtgcagtggtgccatctcggctcactgcaacctctgcctcccaggttcaagcgattctcctgcctcaacctcccgagtagctgagattacaggcacctgccaccatgcccagctaatttgtgtatttttagtagagatggagtttcaccatgttggccaggatggtctcgatttcttgacctcgtgatctgcccacctcggcctctcaaagtgctgggattacaggcgtgagccacagcgcccggccacaaataagtttatacccttgtagtcatggcctttcttttatctttctggtaatgaataaaaatgaagcatataagtgacagagaaaccagctacttgatcaatagtggcattgtttcacaattgtctgtattggattttgccaacccactagagagttaccaaagcacatttctgacataactatgattgatttttttttaatttttgactaaatatgttactttgactaaattggttacttcattgcataatggtgaccatttacacttttcagataggtacaaaaaatctgtgtattctagctggccatgaaagagtagcaagcctgttatttttaagaaaaaagctcgagtagttactgtatttgtatcattttggaaatctctcatttttctaatcagcaaaatggggataatgtaaataacaataaccctgacctcacagggttcttgggattaaatgagatatggtgcatacaacgtgcttagcatggcgcctggagtatggtcagaacttaacaaacacaagttataaatgaggtcccgaaatacaagaaattcacttcctcagaaaccttccttgagcctggctacatctatagctacattttctacatgttaaatgcctccctcagaagtgtcactgttggagttgccagggcaccaatttattactttgaaaatagataaataaaagaatcaagacaaaagaaaaaggtgctaccaaagaagacattctgtcttacactggatcacacgagatgtggatatttggcccggaactgctcacatgggtcagcaagcctgagaatgaccgtggagagaaatggctggggctgcaggactcagccaagcctggcacgcgtgtcttccgggcaccggagcaggacgttgtctgaaaacatgaagaatgaaatggaagtaatgtaatacctggggtcggggctgggggaagctttctaagtacaggcagggtctttctatgttgcccagggtggtcttgaactcctggccccaagcgatcctcccacctcggcttcccaaagtgtggggattgcgagtgtgggccactgtgcctggcctaattactgattttaaatattaatctttctaaaagtcaaactccagaactgtgcatgtagaactattcaatttctgtatataactatagaaatatatattagacgggccgggcgtggtggctcatgcctgtaatcccagcactttgggaggccgaggcgggcagatcacgaggtcaggagatcgagaccatcctggctaacacacggtgaaaccccgtctctactaaaaatacaaaaaattagccaggcgtggtggcgggtgcctgtagtcccagctactcgggaggctgaggcaggagaatcgcttgaacccgggaggtggagcttgcagtgagccgagatcgcgccactgcactccagcctgggtgacagagtgagactccatctcaaagaaaaaaaaaaaaaaatatatatatatatatatatgtatatatttatatatgtatatacacacacacacacattagataagcacattgtttatataggaatcaaaaattacctgtgagtaatttttatttatgtaatttaataattacataaaaattatttgcagaggttacctctggaagcagtattagaagtggaggacttttttcttctatgttgaaaatattttaagtaaatttttaaaaacgaatagaaatttaatcaggaacaggctttctaccattaaaaaactttatagtcttctttacaaaagaagagaaataattgtacttgttcagtcattcaaggccactgaaataattggcatagcttgagctctgtagtactgtcacaatatgcaaacacagtgtggtaatttttatagtaattgaacatgacttacgtcttagaaagtcataagttaggaatttattctgttcgttcttttgaagtgaaaagtaaagaaagcaaaacattttttggccgggcgcgttgtctcacgcctgtaatcccagcactttgggaagccgaggcgggtggatcacctgaggtcaggagtttgagaccagcctggccaacatggcaaaaccccatctctactaaaaattcaaaaattacctggccatggtggtgggtgcctgtaatcccagctactcgggaggctgaagcaggagaatcacttgaggccaggaggcagaggttgcagtgagcagagattgtgctactacacttcagcctgggcgacagagcgagactctgtctcaaaaaaaaaaacaatgactttgacctgaatgtcccaagggtctgctttgtgtagtctgcccctctacaagcagggaccaggtcttggtcacctggtgtccttgtagtaagctcttagcagggactgggtcctggtcacctgggtgtcctggtagtaagctcttagcagggactgggtcctggtcacctgggtgtccttgtagtaagctcttagcaaaggttgctgagtcgaatgaacttcaccgtttcggtcctttggtacagtaacaggcactcaagagagtccacgctgtagggttgatcagccaccatgagagagaagtatactctaagagcacacaccatcaaccccagagcatccctgccgaccaggaatgtagttacagcggtgcaggttcccagctaccccaaagaaatcccaggagagtccatctctactaagtcaagcaaatagaaattgcaactgtagcagcacaatctattttcattatatagtgtgtgtctctctctcccctcatctctctctctctctcctttcccctcggtcacttgacattgatactgggccatttatcctcgtgcatcatcttagagttacatttgtataattatcaacatggccatttgatataaacaattccgtccctcacatccaaagaaaagggaagagacagaaagaaaaggcctaatttctgagcaatttttgttgtttgtttcccattttgtaattgtcctccatctttactcatctgtttttttaaatattaattatttttttgagacagggtctggctctgttgctcaggctggagtacagtggtgcacatggcttactgtagcctcgacctcctgggctcaagagatcctcccacctcagccccctaagtaactgggaccacaattgtgcaccaccacacctggctaatttttgtttgttttttgtagagatggggctttgccatattgcccaggctggtcttgaactcctgggctcaatccatcctcctacctgagcctctcaaagtgtcaggattacaggcgtgaaccaccatgcctgaccaaaaatactttctgagggtctaatattgccaggcaccgtgttaacaattcagaaaatactcctgcttaataaataaagacttgaatttttttagttacttcattgaaaagaaaatctttttatttaaattgtatcgtcagccaggcgcaattgctcacccctataatcccagcactttgggaggccgaggcagacgaatcatttgagtcaggagttcaagactagtctggccaccgtggtgaaaccttgtctctaccaaaaatacaaaaattagccaggcatggcggcgggcacctgtaatcccagctatttgggaggctgagacaggagaattgcttgaacccacgaggcggaggctgcagtgagctgagatcacgctgctgcagtccagcctgggcgacagagccagaggccatctcaaaaataaataaataaataaataaataaataaataaataaataaataataaaattgtgatgtagttaactggtataatcttttcagttatttttaaatttttgaaacaacacgctgtatatcagccatccatcagagaaggaaagaaatatgtagaaggactgtcttctgcttcagatcatgaactgtaggaacaaaatagatatgtgtaaaaatgctgctccttttctgaaccaaaataaaattagatttttgttgttgtggttgttgttggaaaaggtagtagatttcaggcaaaatcagaaaataaattatttcagaaacacaacaaaactaagtacaacgatattttggttaagaaaattatggttagaaattatgattctatcactttatgaaacagaatctttaataatttttcagcttataccaaggatattcttttatttcttaatgactagttttaaatatatgactattctctctgtacagatttttaattaatgctcataaaggctattgatagaactcattctttctccaaaatggagttaacccgaaatgggtagagattcagaagcttcattgtagttaaaattagggtcatgaagggcaaaagcccaggtatttcagcctttgtagaagaatccattaatgcagcattacaagtaagtgtaatttagtggctccttagttattttaagcaagaggcctccttaaagggcacacagataaagtcaacatagatctccactgaccccaggcgtgcggccagaggtcaactcccaacggctgtctgggctcctttttccctgcagtgctgtatgtctgggggggtgacaatcctttgataacagttttttttattgggagaaaatttgtgggaatgcataaggtcttgctaacataattccacattatgcttgctcaacaggagaagttttagtttaaatgtagacttattggagatggctgtatatctgcaggtcagggagtctcgcgtctgcagattctttgtggtttctcgtctgtcgtcgcttatcccaaataagtagctgcacttcttggaagagatgattgcgtcacttgaaggggtcatgggagtctactgattgaactcatttttctcccatctgaaagaaagaaaagttgaaacaagaggaaagacatttcacactttctggcatttaatatttcggctagtttttgtttgtttgtttcttttttgagacagattctctctctgttgcccaggctggagtgcattggtgcactctcggctcactgcaacctctgcctcccgagttcaaacgattctccttcctcggcctcccaagtagctaaaacgacgggtgctcattaccacacccagctaatttttttttttttttttttgtatttgtagaagagacagagtttcgccatgttggccaggctgacttcaagtgatccgcccgcctcggcctcccaaaatgctgggattacaggcatgagccactgcgcccggcctggccaggtttagatcctggttttgtgaaagaatcagaatgactagaagattcatgttccgatccactgcagctaacaaatacagctccaggaaccgcacaaatcctgcatcgcctttcatcagcagatagttaaaggcggagaattgggttttcttgtttgtaaagatagtgcgtgtaaacaagcatgcagtaaattatgttatctgcagtagagtcttccattggtagctttggtcagacgagctgaaatacactgccttcagggttcttcttggtttgtcaccgtgagtagagatttgaatttacactgcctcatctgtactgaattctgcccttgctgtgaatcatgtcacagtctcagaagcagcagcagccatagagtccagtgacatccttaccagtaagatacctttgacctagagagttcatttcaggggtggggcagcatcagtgtggctaaatgtgaatattcatttctttttcttaaactataaaatgcttgttcttttccaaatccatagctaggcacagattatagaggcatcttaaaaagccttctatagctgggtgcagtggctcacgcctgtaatcccagcactttgggaggctgaggcgggtggatcacttgaggtcaggagtttgagaccagcctagccaacatggtcaaaccctgtctctaccaaaaatacaaaaaattagccgggcatggtggcaggtgcctataatcccagctactcgggaggccgaagcaggagaatcgcttgaacccgggaggtggagattgcagtgagccgagatcgtgccactgcactccagcctgggtgagagtgagactctgtctcaaaaacaaaaacctcctataaatgccataagatgccggcaaatgccatctcaaaatgcagttaggcaggaaaattacctggtatgagttgtaacctaggcaactggaaaaaaatatgtgtccaccagttacccttgtgtttgatgtttcaagtagtagaacagtataagtgtggttttctttctggggtctcccccattgtatgcactcactgtagtaaccagaggaaaatgttaccttcctgctgggaaccttaacttccgaggctgtgatacccatcttcatacctaaagttttaacatatagcaagtccccacctacaagcaggtcttatgtcaaaagtgtagttgcagtttattgcctggaacccggaatggattttcccataggcgtgttatgaacggcagctgtattccaggcagctgtggaagcctttttagcccatttatatacctgaagtgcagtcatgtgcaattagcaagacaagaaccagccatcatccatcacaatgttttatgtgttcccccagcctccccactcccactctcagttggcccagctaggcagggaagggggtgttaatgaggcctgcaggtgcacagatttactccccacctgctgcatctgcaggggttaaaccggcttttccctccccttcgctctcaccattccttctctccctctccccacccccagtctccctttccctgtgctgaaggggctgggcagtgaagtgaggaagggtggctggagctgttgggggctgaggccacattgtgcagttcacatcagaaccccctggggacttgctccagttgcagattcaaatgcagcaggtctggggtgggctctgaaattccgaatatctaacaggctcccaggtaatgcccatgcacaggcccacaggccccatttgagtaacaggagtctctaaacaccatgcagggaggagaggctggtgaagagggaaacctcgagtcacgactgaaaggcagtggagggtgagagctgagttctattctctaggccttagggaggtcccttttacactgagaactttttgccacatgggaagaagcaggcaaaccctggatgccatcaggtgctggcacatcgcagcctcatctcatgcaaggtgttcttggccagggcctgtggaggttctacatgatatggcattaaccctcgggagagcaggcacagtagaacctgaatgtctcctccaagcgactgggtgcagcatcgctccatgtgactgggtgcagcatcgccccatgcgactgggtgcagcattgccccatgcgactgggtgcagcatcgttccatgcgactgggtgcagcatcgttccatgcgactgggtgcagcatcgccccatgcgactgggtgcagcatcgttccatgcgactgggtgcagcatcgttccatgcgactgggtgcagcatcgccccatgcgactgggtgcagcatcgttccatgcgactgggtgcagcatcgttccatgcgactgggtacagcatcgttctatgtgactgggtgcagcatcgccccatgtgactgggtgcagcatcgttccatgcgactgggtgcagcatcgttccatgcgactgggtgcagcattgccccatgtgactgggtgcagcatcgttccatgcgactgggtgcagcattgctccatgtgactgggtgcatattgctccatgggcatggtttgtatgaaacactcactattaaagcacagtaggaaatgctgaaatggaaaaggaatgggtcatccgggagccccaggatctagaccctggagcagtgtttcagggcctgaggatccgtcaagggggccagcatcagaagccccagcacacagggggcttctgatgcaggaggagagtgtgcggtttgaagatctttcatcccaacacagcaaggcggtgaagaaccagttttcatcctgtctccaccactaactagccatgtgtccttgagctcataccctcatgcctaagtgtcctctgtcctcatccgtaaagtaaggctaaaatgagtacctacctcattagggtgctgggaagctcaatgagattatttctgtaaaacccttagactgtccattaagtgtcacaaaagcagtcgtaggggtggctgtggcggtatggtagtggtgaaatgagtaatttgagattataggcctaaagtcaaatttctggttttgcaactttttactagtgtgacctgggcaagtgacttagcctctccaaacctcagtttcttcccttgtaaaatggaaataataaaagttcctacctgctatattattgagaggataaaatgaggaaagcacgtagcacagtgcccatcacaaagcaagctctcagtagatatcagttactgttattgagggagaccggggtgacgactggcatctgaacaggagttttccagctgtgctccaggagctataggttttacaaaaatgtgtcttgggggtgagaaggaggccattattcaccctgcccacacctgctgcccccttcaacctgatgggcttgtctttgttggcgttcagcatgaagattttattgagaagaaaaggtttggagtttggaagatcactgttttgtagttcgggtgtgttatggggccacagggaaggtaaatggtctcaattttcaggaagttgacatttgccttttctacttcatttccttaaacaaaaattgaaatatcagatgacaaatttaaagagatatatcccatataaaacctaaagttctatgaggctgtattgaacgatagagttaatttgcatcatcagatgttgtggccgctttgtagcatttgctaatctgtaacgcttggttttctcccccagatgagcaccatgccaggactgcccacccggccctgcttttatgacatagatcttgataccgaaacagaacaagttaaaggcttgttctaagtggacaaggctctcacaggacccgatgcaggtaggctgatgtgcttcaactttttctctctttgtttttttccagttcatatcctttttttgtcattttttttttctgataccacagaagtgatctgataaatcctttccttcctttgttactcaaattcctaccaaatgattttccgtgactggagttcactcctgggtgtggctgtgagttacatgctcagatgctcagtacacaacccttagtgtcctgcgctcgagtccagtgaaagccaagttatgtcatccctgaatatagatgtgtttagagcatctctgaccataacagaactctgtaaactcattgttcttttccaggattaaaaccagcgtctgttataattttaaaagagtaacttcctaccttcctgccacgtatctcttggtacagagctagaatcatgtgaaagaggaatcttggtgtatccgtttcctggggctgccatgacaaagtatcgcaaactgggtggcttaaaacagtggaaagtttgaaacagttctggaggctagaagtccaaagtcaaggtgtcagccaggccatacgccacctcgagactctgggtggaatccttgctggcctcttcctagcatccagtggtggctgtcactccctggcgttcccaccttgcagctgcgtcactcccgtctcagcctctgtggtcccaccacgttctccctgtgtctgtgtcttcacatgatgttcacctcttataaggaccccagtcctattggattagggcccaccctaagaacctccttttaacttgattactctgcaaagaccctccttccaaataagatcactctcagccaagcactttgggaggccgaggtgggtggatcacgaagtcaggagttcaagaccagcctggccaagatggtgaaaccccgtctctactaaaaatacgaaaattagctgggcgtgttggtgggcacctgtaatcccagctactcgggaggctgaggcagagaattgcttgaacccgggaggcggaggttgcagtgagctgagattgcgccactgcactccagcctgggcgacagagcaagactctccttctaaaaaaaaaaaaatcactctcacaggtgctcagggttaggacttaagcatatcttttaggggacacagttcaacccagaacactcaactgtgtggcacaacaggtgtgttcggctctcttgtccctggacagacacatagccatgggacagaccatttaactagagggccccatgggttccaggaagggcagggcagcagaaagtaggccacttgatgacttcgggtttgcacagtctcaggttgggctttgactctgagctgtcttaggcagcccagacctggggactctcggtcttattcatgtccacgccacagcactgcagccatacctgctggcttctatcctgactccccatcgtgaagaaaaatgaccacattcctaaacctcttccctgggagacaactcctaatcagaagcttgaaaggctcagggctgcttctcctaccccagggatcaaacatgtcctcaccatattctaaagacacattctttccccgcaagcaccccgcctccttctccccactgactcctgttcctgagcccagaacctctccctcttgccagcatattctcggcctttgcagatgagcttttgtggcctaaagaccttcttcttcaaccatctctgagttacggctccaagccaggcacccaggattctcatttcatttgtttcactaccaggagtccacttgaggacttgttgttgttgttgttgtttgagacagagtctcgcgctatcacctaggctggagttcagtggcgtgatctctgctcactgcaacctccgcctcccgggttcaagcaattctcttgcctcaccctcccaagtagctgggattacaggtgtgtgccaccacgccccgctgatttttgtattttatttatgtatttatttatttgcgacagagtcttactctgttgccaaggctggagtgcagcggcactgtgtgggctcactacaacctctgtctcctgggttcaagcaattctcctgcctcagcctcccaagcagttgggattacaggcgtccaccaccatgcccagctagtttttttatttttagtagagacagggtttcaccatgttggccaggctggtctcgaactcctgacctcaggtgatccacccgcctcagcctcccaaagtgctgagattacaggcgggagccaccacgcccagcctaatttttgtattttaatagagatggggttttaccgtgttggccaggctggtctcaaactcctgacctcaagtgagccacctcgtctggccaagtttttttgttgaggctttgttgctaaaacactaaagacctaggctatggtgagaaagataagggaaccataaatgaaattacattaaaacaaagtgtgaaattgtttgttttgagttgtggatgttgtttgggggtgtttgtatgtgttttttgctgaggagcgggagctgtgttaagtttgagccataactgcatctttgatctttgttatttcagaaaaaataaaactctagaaaatgaagtaagggagactagtttaacaaagaaacccataaactcaagtgttgataaaatgttgtttcatcttttggtgtgagcttgtgtgttgccaatgtcttccattccccagtaaggctgtggggaaataattgctatttccccaattgctagttggcctagcaattctctttttatgtcaggaacccattatgttacatttctgccatttgtcatttttctccagaataagtgtgtttgattctcccatctctcttggacagtatttttccagcttttggtgagttttcacatgctctccaagtaggtcatataagtccaattataccttaatcactgtagttaggactcaggtcctactcagggatacatccttagcattattaatgcatacccttaaatcctttattacctactccctaacaagaattcctccagatcttatatacggggcctgcagggcaggacacaggcctatggtaattacttccaatgtatcgggcattgtgctaagcactttgcatgggtggtcacagcacctctggagccaagtgttgtcccataagggccacaaggcttcaagaggacggagcctaccccttggtcactgaggggtggccctggtctgcaaggctacagaactgccttgccaccctgtggcactgcctctcatttcatagctggcacatgtcattttgccacccccatcacatgtcatgctggcatcaacccagggaggtgggtagtatttttgttgaagagctgcaagaactctgcccagagaagtcgacaacctgctcaagttgtgcagctaataactacaaaagccaagactcaactcagatctgttgactctcagtattaccccaacctttatgccccaaaccaaaggatgcccttttcatttcagtcacgggtaaaatgaactttggcccattccgaaagatgataccagctatttgaacagacaggtacttgaggataatgaggtaattttttctaataagtaaagataattgtttgggtattaaaagctatgattttgtcataattctttttagtccaagtataatagagccagctctttcctaattctctaatggaatggcatttctaccccttacccaccccccaatccaaggcctctttcttctttgtgaattgctaaatacagttctgggctagtgggcagtggttcaaaacccatcgtttgaccctgcttgaacaatcaaaaacagatccagtgtcctaagataaaaccactatacaaagcaaacattccctctcagtggctcctcggtaatgacccagcaagtattgtctgtttcccgtgcctctcactatagccatcagggaccacttctactaataatcagaggtctgcggctattcaaaatgcataaaataaaaatgttaaagcttaggtgacagcttggacaaacgtgggcatctgaaaggaaatgtctggcttgctgacgttgctccttcagggatcacaccgtagatggtgtgcatacccaggtgcggagcagcacactcattattcccccaggaaagtgttgaaggcgcgttccactcaggaagaagattgtgcttggttgatgacaactttctgtccttcccttcctcacctttctagcctgtctcacctcctaggaaaccgtgtgaaaccaaaggtgaacattatatgccaaaaaacatcagaattggagctctccttgctccctcttcccaagacttctctgtagtgccttcactgtggttagaataagggcatgactcattcttttggatgtcactaaatagaactaattaaaatagattttttgtcccagtgaaattgatccggctgttgagtcttttgtttaaagattattggaatgaaggatttgatacttttccccccattcttttttctcacttggaaactttatcatatttctgagctttggcaagattcattcaaatgaacacacaataaagtctggcaaatttcctgaagaattcaaggactcccttacttctttattgtactgtgcaaagttacgttgagtacggaatcagattcactccagtcctgctacaaatgtttgttatttacaaaagaattgctttttcttgaattacatacacagaaataagttcaggaaagaaattagtttctttcctaaactggctttagggcatctacagacaaatggttaaagaaaatgtggtatgtatagagagtggaatactacttagccattaaaaaagaatgaaataatgtcatttacagcagcatggatggaagtggaagttattatgtgaaataagctgggcacggaaagactaatgctgcatgttctcactctcatgtggaagctaaaaagcttaccctcatagacagaataaatggtagataccagaggctgggaaggatgggtggctgggaggaggttatgaagaaaggttggttatgggtacaaacatacagttagacgaagaaataagctctaatgtttgatagcaaactaggatgactatactcagcaacaatattttgtatacttcaaagtaacaggaagagagtggggtgtacttgaaatgataccaacatacagtagtaatgataaatactcaagataatggacaccccaggtaccctgacttgatcactacacattccaggcacataataaacactcatatataccccataagaatataaaatattaggccaggtgtggtggctcatgcttctaatctcagcagtttgggagtccgagtgggtggatcacttgagcccaggaattcgagaccagcctgggaaacatggcaaaaccctgtccctactaaaaatagaaaaattagccaggcgtcatggcacgcacctgtaatctcagctactcaggaggctgaggcaggcaaatctcttgaacccaggaggtggaggctgcagtgagctgagatcatgccactgcactctagcctgggtgacagagcaagactcggtctcaaaaatatatataatgtatcaatacaagggaaaaatgggcagaaattttcaatgatatttaataaccataaattaatcttgagttgggttgctgcctgccagcccttctgtgaacatgatttgttcagtcccaagtcacaaaccacagggttacaaagtaccctgggagggtgcctgagctctgtggttttagtcttgaaactttatcttttcacaaagcaattcaaaaattgctcatcaccattgtgttccgagaaaaggggcgccaaggcatcaccctgagccatccgaggagtgctgtgtgccttcttcctttctgcttccaagtaggatggaagctccagctttatacttaaataatcctcatcaacatctaaaagatagtgataattaaatctctcctatctaactaaaatggaatgttttaaagcttaggtaacaattctgaaattcttaattccccccaaaacaaactttttctgagcacattttgatttcttattcccatgccagaatagactgttttgtatatggtatcttccaagatattttcccactgagttaacttctgaaattgcttcttccaacgcataagcaataaacaacagattcgtttttacattctcaccttagctattgcatctctgattgttttcatctataatgagactttctatactttggccagtccttctgtttttcttaaaatgtgggaccacaggccaggcacggtagctcgcatctgtaatcccagcaatttgggaggccgaggcaggcggatcacctgaggtcaggagttcaagaccagcctggccaacatggtgaaaccccatctctactaaaaatacaaaaattagtcgggcatggtggcgggtacctgtaatcccagctacttgggaagctgaaccctgagaattgcttggacccaggaggcgaaggttgcagtgagctgatatcgcatcgctgcactccagtgtgggcaacagagcaagactccatctcaaaaaaaaaaaaaaaaagtgggaccacatactctaagcacctttagacaaaaccacaggatacaaatgtaatgtggctaatcagctggtcttccaccacccacctctggagcatggaaggccttgtccagccttgccttgccaagccaagggtcatctctagtccactgagcccaccctctaccctagcacccctcctgtcccaagagtcattgaccctcaggtcaagggataccagagccactacagtgaggctggccgtgtctctgaaatattttctttttttttttttgcccttctctcttcctcggcgctgcctatggaggtggcagccatctcctcctcggcatcttggccgccctcagaccccttgtgaagcccaagatcgtcaaaaagagaaccaagaagttcatccggcaccagtcagaccattatgtcaaaattaagcgtaactggtggaaacccagaggcattgacaacagggttcgtagaagattcagggtccagatcttgatgcccaacactggttatgggagcaacaaaaaaacaaagcacatgctgcccagtggcttccggaagttcctggtccacaacgtcaaggagctggaagtgctgctgatgtgcaacaatcgtacttgtgccgagatcgctcacaatgtttcctccaagaaccgcaaagccatcgtggaaagagctgcccaactggccatcacagtcaccaaccccagtgccaggctgtgcagcgaagaaaatgagtagacagctcgtgtgcacattttctgtttaaataaatgtaaaaacagccatctggcatcttcctttaaaaaaaaagaaaagaaagaaatattttctttcttttctttttttttttttttttgagacgcagtctcgctctgtcacccaggctgaagtgcagtggcacgatctcggctcactgcaagctccgcctcccgggttcacgccattctcctgcctcaacctccagagtagctgggactacaggcacctgccaccacgcccagctaatttttttgtatttttttaatagacacggggtttcaccgtgttagacaggatggtcttgatctcctgacctcgtgatccacccgtgagccaccgcgcctggcctgaaatattttatttttgttcatctttgttgtgcttataatactcctgttttctgtttattcccctgacttgaaccagatgttaggggagtatttgaagctcctcgttccctctcttcatcaatatcttctgtctagaaactaaccaagcaccttatctggctccagacctctcagtgatctgtgggaggccaactcgcaggatttcagcagagtttgcactttctaggcctaaaagataagtccttccatgtgtaagttcagattaaaggcaacatattgcatttacattttagagaggtgaacacattattttctgggacttaagtgttgttttgtttcttttttttttttttaatgtagtttatttctctttctaagagattacaggattcaagaatggcaatgaatcttaatagcctttgggagaaagcagcaaagctttaatactaagttccaggaccatgaacttccatgttgtcctaaatgcatttttcaaacattgctttctgtgcctactctataaaacctaaaaatccaaggtgacagtattccttatctaaaatcctaaacaaggctgggcgtggtggttcatacctgtaatcccagcactttgggaggacaaggcaggcggatcacttgagcccaggagttcaagaccagcctggccaacgtggtgaaacctcgtctttactaaaaatacaaaaattagccgggcatggtggtgcacacttgtaatcccagctactccggaggctgtggcgggaggattgcttgaacccgggagacggaggttgcagtgagccgagatctcgccactacactccagcctgggcgacaaagtgagactctgtctcaaaaaattaaaaaaaaatttttttaaatcctaaatattctcattccacaggatcctgcaaactgtagatcccaaacttggaagttctgggaattctgccagtatccccaagtaaatctcttgggaagtttagaatgctgcatggcgtagctgtgcctgctcttatagagtggtgcagactctgcttctccacgtctgctaagtaaaatattccaaacacagatcagccttatctagcgaaccatcactctgctcttgaattttcttttggcctcaaactctagagctataacatgttaacggtttaacaccagaggagaaagctattcttaaactactcaaacatggtttttttttctatttttcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 2021 - DNA, 236210 bp, Homo sapiens; identical to SEQ ID NO: 2020

SEQ ID NO: 2022 - DNA, 235556 bp, Homo sapiens
cacgtgcgcagccggccgccggctctgatgcaatcgcgccgggcgcgacccagacggtaaaggggcggtgcggctggggcggaaaccaggggagggggcgaggagcaggaggagggcggggctgcggctcggcgcgccggctggcccggggttcgggaagggcaagcggagctcgggagaggcgggctcgggcccagcgccgcccgcgcgaagctccctggtgttgtgcgcccttccccgcgcgcggcccctcctgctgggctggggtctgtggctgacgtccgcttttcccggaacggcaaaggtggagccgggcccccgggacagccgccggggggaatccgagaggtctcagcgctggtttccagcttcgccgcgcagcgcccacggagtccccgcgcagctgggtttgcagggttttctgcgggcccagagcgaactgggagccccgggcccggcctttcccgtcccggtccccgcccctgggctccagccttccccgccctcgcccagaggggcgcacgggtctcgggccttgcagggcgagcccttcgggacaacttgggggtggcaagaaagccccttccgcctccctcggaactgggattaggaacgagttccaggatgcggtttccccggccagcggaccacctcctccattcacatcctcttccctttccttctagccttctttcttagtcattgcctgcttgcctttctctctgcctttccttcctccctctgctctcccattttcctccccactccccttctcccatctcagtaaaatacgtttcctaggctctttattatgtggcggatgattttaaggggccatttatttagtttttcttgttctctgtcttctttttcttttagaaatggagtctcgctttgttgctcaggctggagttcagtggtgccatctcggctcaatgcagcctccgcctcctgggctcaagcgattctcccgccttagcctccagtgtaactgggaccacaggtgtgcgctaccatgcccggattattttattttattttcatagagacagagcaccactctgttaccaggctggtctggaactcctgggcgcaagccatcatccctgcccccaaaagcgctgggattaattacacgtcaggtcattaggttttaacctgcacgttgctgagactcatcttaccggttagagtctgaagccaggataggcggcaaaaaaacttctcccgtcatgctgttttattttctaggtaaactgattattacctgaaacttccttctttgctcatttcttgtctgtctcacccacctggaatatgagcttcatgagacagccgtctcttcggtgctatatcctaggtcctggagagagtgcccagcatgtaataagcacttgtgaaatggttacagaaggaatgcttcaagatttggggtcatctgtgggttttattcatacatattctttttttttttttttttttttgagacggagtcttgctctgtcactcaggctggagtgcaatggcacgatcttggctccctgcaacctctgcctcccaggttcaggcgattcccctgcctcagcctcccgagtagctgggattacaggagcacgccaccacgcccggctaatttttgtattttgagtaaagacaggatgtctcaccatgttggccaggctggtcttgaactcctgacctcaggtgatccgactgccttggcctcccaaagtgttgggattacaggcgtgacccaccgcgcctgggctattcatgcatacttttaggtttaaagccatgactgccttagagatgagtaaagaggttagtagggggctttagggcctgcactgggttctccaaactcaattccttcaggaaaatgggaggagtaacagtacttacctcaaggggttatggaaacaattatgtgagaggacacatgcaaaatacatagcccaggactgtcacatacaagacaagtccctcaacaaatggtggctattaattttttttttttttttttgagacggaatctcactctgtcgcacaggttggagtgcagtggcgggatctcggctcactgcaacctccgcctcccgggttcaagcgattcccctgcctcagcctcctgagtagctgggattacaggctcgcactaccacgcctggcttattttgtgtttttagtagagacggggtttcaccatgttggccaggctggtctcaaactcctgacctcgtgatctgcctgcctcagcctcccaaagtgctgggattacaggtgtgagctaccatgcccagcaatatttttacaattcactaagccaggggtccacagacgttttatatataatgggccagatagtaaatattttaggtttagtgatcctagaggcaaatcaaaattattagtaggtacatttataacaagagaaaagacaaatttaggccaggcaccatggttcatgcctgtaatcccagcactttgagaggccaaagtgggatgatcacattcccaggagttcaagaccagcctgggcaacatagtgagacacccatctctgtaaaaaattttaaaaaattaactgggcgtggcgcgtgcctgtagttccagctactcagaaggctgaggcaggaggatcacttgagcccaggaggtcaaggctacagtgagcggagattgcgctactgcactgcagcctgggcaatggagtgagaccttattttttatttttgcaattaagtatttttaattaaggtatgtacattttttagacaatgcttttgcacacttaatagatggcagtatagggtaaccataacttttatttttattttctattttactttaagttctgggaaacgtgccgaacgtgcaggtttgttacataggtatacatgcgccatggtggtttgctgcacccatcaacccgtcatctaggttttaagccccacatgcattaggtatttgtcctaatgctctccctcctcttgccctcccaccccctgacagaccctggtgtgtgatgttcccctccctgggtccacgtgttcttattgttcaactcccacttatgagtgagaacatggggtgtttggtttctgttcctgtgttggtttgctgaggatgatggtttccagcttcttccatgtccctgcagaggacatgaactcatgctttcttatggctgcaattttatttttgtagagatgaagtctcactatgttggccaggctggtctcaaactcctgggttcaagtgatcctgctgcctcagcctcccaaagtgctgagattgcaggcatgagccaccacgcctggctatattgtacctttcaattgagttatgtgcatggtttactgaaactctagccctgaattgattctccgaggattggagcaaagtgggtgggggtgtgtgtcagctagaagtcacctggaatagacatccaggagcggaagtgtattagtcagaaaaattaaagaatgagctccctcaaaagcatagtgacctgttgttcctggtgatgggactagatgaccataatccctcagcctcccaagtagctgggattacaggcaggcaccaccacacccagctaatttttgtatttttagtagagacggggtttcaccatgttggccaggctagtcttgaactcctgacctcaaatgatccacccgccttggcctcccaaagtgttgggattacaggcatgagccactgcccctggccagtaataatacattctgtataatagtcacagtaatggtgaaaataacaaagctgctgctgatggcttagttctgagttttagctacacatggcaacctagctagagagctcacattccttcccactgtcctcaaccaaagtggaagctcacaaggccatttttctgccccaaggacatgaaaatctctgattagaaacatttatgctactttttggatttattgagcctaatgactcctttttctttcttgctttgtcactgtaggaatgagtaaccccaaaaaatgaaacattacacatataacaagttgtagggagcatgaacctattttgttttattagcttgggtggtagtagcgttgaactcctttacatacctgtacaggcacccctaagatattgtgggttcagttgcagaccactgcaataaggggaatatcgcagtaaaacgagtcacacaaattttgtagtttcccagtgcatataaaagttatgtttagacaatactgtagcctattaagtatgcactagcgttttgtctaaaaaaaaacccatatataaggccgggcgtggtagctcatgactgtaatcccagcactttgggaggctgaagtgggtggatcacgaggtcaggagttcgagaccagcctggccaacatagtaaaaccctgtctctactaaaaatacaaaaattagccaggcatggtggtgtgcgcctgtagtcctggccacttgggaggctgaggcaggagaatcgctttaacccgggaggtggaggttgtggggaggcggaggttgtggtaagccactacactccagcctgggaaacagagcgagactccgtctcaaaacaaaacaaaacaaaaaaacccaaaaaacatatatatatatattatatatataaaatatatataatataatataccttaattataatataatataattatatataccttaatttatatatataccttataatatatataccttaatatatataccttaattatatatatacacaccttaatatatatataatatatattaatatatatcttaatatatatatataaggtaatatatatatacaccttaataataatatatataccttaattttaaaatactttattaccaagaaatgccagtgatctggtggaggatttgcctagatgttgatggttattgactgatcagggtgattgctaaagattagggtggctgtggcagttttttaaagtaagacaatgaggtttgctgtattgatggaactcttcctttcctggaagatttctctgtagcagtgctacagagaaaatggtaacattttacccacagtagtaggacttctttcaaaatgggcgtcaatcctctcaaaccctgcaactgctttaccaagtacttgatatcaactactgtaatcttttttttttttttttttttttttgagatggaatcttgctctgtcgcccaggctggactgcagtgctgcgatctcggctcgctggaacctccgcctctcaggttcaagtgattctcctgcctcagcctcctgagtagctgagactacaggcgcctgccaccacgcctggctaatttttttgtatttttagtagaaacggggtttcaccatattggccaggctggtctcgaactcctgaccttgtgatccgcccacttcggcctcccaaactgctgggattacaggtgtgagccactgtgcctgcctaactactgtaatcttataaatcctttgttgtcattttattttattttaattttattttattttattttaatttaattttattttattttattttttgagacagtctcactctttcacccaggctggagtgcagtggcgcgatctctgctcactgcaacctctgcctcccgggttcaataaattctcctgcttcagcctcccgagtagctgggattataggcgtgcaccaccatgccctgctaatttttttatttttagtagagacggggtttcactatgttggccaggctggtctccaactcctgacctcgtgatccgcccgcctcggcctcccaaagtgctgggattacaggtgtgagccactgcgcccggcctaataaggctgttttcttatcatttgtgtatccacgggagtagcacttttaaatttcttcaatagcttttcctttgcattcacagcttggctaactgtttggctcaagaggcctagcttttgacctatcttggctttcaatacaccctcctcactaagtttaattatttctcggtttttatttaaagtgagagacctgcaactcttcacttgaacacttagaggccactgtagttactaattgtcctaatttcaatattgttgtttctcagggaatagggaagccagaggagagggagagagaagggggaacagccagtccagtgaagcagtgagaacacacaccatcatgaaccatcatggccacggtttggccaacacaattacaacagtaacatcaaagatcgtcaatcacacatcaccagaacaaacatactaaaaatgaaaaagtttgaaatattgtaagaattatcaaaatgtgacacaaattgagcagatgccattggaaaaatgactcccatagacttaaaacacaggttgccacaaactttcaatttgtagaaaaacacagtatctgtaaattgcagtaaagcaaagcacaaaaaatgatgtatgcctgtatttttttttctatccacatccaccccccaactttttttttttttttggtagagaccaggtcttgctatcttgcccaggctggccttgaactcctgagctcaagtgatcctctcacctcagcctcccaaagtgctgggattacaggcatgagccactgcgcccagcccccatccccaactattttaaaagtctaattactttttgacgattgccgacttacctatagaagtgttcctttcagcccggcgaggtggctcacccctgtaattccagcactttgggaggcctaggtgggcggatcacgaggtcaagagatcgagaccaccctggccaacttggtgaaatcctgtctctactaaaaatacaaaaattagtgggacgtggtggcatgcaccagtagtcccagctactcaggagactgaggcaggagaatcgcttgaacctgggagatggaggttgcagtgagccgagatcgtgccactgccctccagcctggaaacaaagtgagactccgtctcaaaaaaataaaaagaagtgttcctttcatcaactatgaatggatcaagactatgaatgtttctgagaaaattattgctgttagtaagaatgtttttagtgtttaagggtagctttggggcacagaaaaaaacaaacgtacatttataagaaaaaggggaaagagccactgtagtatacctgttttacagatgaggaatctgagactcttagagacttgtccacgctagtaaatgaaatgcccagtaccaatcctgggccgtatttccacttagtgtctcagaattacctggactctgttaaaaatgcacatttctgggctccactgagacacgttgaatcagactttctagggctggaactgttattttttttgagacagagtctcgctctgtcacccagctggagtgcagtggcatgattttggctcactgcagcctctgcctcctgggttcaagtgattctcctgcctcagcctcctgagtagctctgggattacaggtgtgcaccaccatgcctggctaatttttgtatttttactagagatggggtttcaccatgttggccaggatggtctcaaactcctgacctcaagtgatccatttcaccttggcctcccgaagtactgggattataggtgtgagccactgcacctggcctggaacctttacttttaccaaactctccagtgatccttataccatgaaccgcttgggtcccacactccggtgctttcctggacccagacaaaaataagaacccagcatagccaaattaacagtcacgacaggctggaaagagtgcggtatatgggcctcagtcacccattattggatggatggattttagtgcttatttataaggtgatttgtaaactttcccatatggtcacatttattcagcacaataatacaattaattccctgggaatgaagtagctttatcccaagtgtttccaaacaaaactaactgaaatgttcccaggttatagacagttgcctgcacccagtccatctgttccggcccagctggcagtagaaagactggtcctggttgtgaatctgagcagctctctcccctaaagccccgcctgggaactgcagtgcctctggttccatttgtcagctgtgtctctctgaaaactggggaaagcttcccgatgcctttctgctcttggcagtgtaccgttgatggcattggctggaacttcttcaccccgcatttttgttaggtgcagtgcaagaccctgtcggagactgaaaacaaaatgtaaaggtggtcttagcactgaagcctgggggctcctgtggctgcgcctttggtctattgtgagagggggaaaagccagctcccagtgctcatgtgctgctgagaacatatcatagggtggtggcgaaggtagcctctgcagtcactcatcccagaaggttccataaagagctgagctcctaacacttttttttttttttgagacggagtcttgctgtgttgcccaggctggagtgcggtggcacaatctcggctcactgcaacctctgcctcccaggttcaagagattctcccgagtagctcagattataggcgcctgccaccacacccagctaatttttgtatttctggtagagacggggtttcaccatattggccacggtggtcttgaactcctgaccttgtgatccacccgcctcagcttcccaaagtgctgggattacaggcgtgagccaccgctcctggactttttttttttttctttttttaaaaagaaattgagtcttgctctgccacccaggctggagtgcagtggtgcagtcatagcttactacagcctcaaactcatgggctcaagcggtcctccagcttcagcctcccaagtatctgggactacagtcacgtgccatcacgcccagctaaattgtttatagagatgggatctcgttatgttacccaggctggtctcaaactcctggtctcaagcagtcctaccgccttggcctctcaaagtgctgggactacaggtgcatgccaccatgccaggccttctaccacttttacctaggcctgctcaccccaggctggcacctccctcagaggtgggaggtgaaggtggctgctgctgggcatttaggaggtacaggtgcagactatgttgtggattctcagaggactgagaagctctctgtctctctctctaggaggctttgatagtgttatcaaagtgggtctccagtgtttctggaactttcctccccttccttccttacctaattccttctttaaattccaggacctggaatttatcctgtctcgacacttcttgtccaacagtgagccccctgtcttcacccccctaatcccctgtcttcacatccctcttcccactttatttgctttccccatggacccatactcagggttttgggaggatggcagcggagtatggtggaggagagcgattatttaaagtagaaacccaaagcttttattatagtaaacttggaaaatacaagagaaaaattcacccctagaaaattattgtaaacatctagtttgtttccctctgcatattttaaaaactggattgccgcattttaccttgtgttagtgtcttgatttcattgttacgccgcctaccccctccacagtgtacacttggagtgcgtccttctgtggtctagttattttcacttggaggaaggaactttcacagaaaatgtgttgtgtcagtcctttctactcattaaccaagaaatcacaatgttgttttctttctcaatgtagagaagtcattcagaattcaaaagaagttctaagtttattgcaagaaaaaaaccctgccttcaagccggttcttgcaattatccaggtaagccgagaacaaggttcagtcctactattttaggatgcctttcaatttagaaaatgattgtatacaaaagagcagctgcatttcttgccaaagaggagagggctcagttggcaatgctgttttctttggtcttttgcttctttggggtcacgggtgaagtactgccctgcttgagtgtgtcttcttttgtgaattttcctctctgaggtatgggtagctttcagaggtctaggaggtaagcacttacatgcattgcattacacaggatatatcgtggtccatgtgtcctcacaaatgcttaccaaatgtgatttgaaggtgctgggggaaaaagtggcactttgtttcaatggacacagatgctagatgaaacatggatatttggtaatctttttactctatcttttaaaacctgccataaacttaatgggacaaaagtcattaccctgtcaaaagggctttgcattccacatacttcttttggctgcaggctctggttctgagccacagttggccccagttgccatcctgcttggcacacttgtgtgatggcaggtgctgagaaataaggaggtgagccaagcctggaagcaaacacagcctgacagttgggctgctaccgcagggcttggcatgcccttagcgtatcaaaatagcagcctctggttccaccgtgctgcgtatttcaggattacagagctgtgctcaagttacttacattctctgggatctgtagccacatcttgttacaaagaaagacaagttagaacaatagaaagaaaattagattagggctcgggcctcctgggaatctgcttactccctggctttccatctaaaggcaaaccatttcaactcctacctttggtatccccattttttggcttctttttgtgatggggtcttgctctgttgcctgagctggagtgcagtggcatgatcttggctcaccgtagctttgaccttctgggctcaagtgatcctcccacctcagcctcctgagtagctaggactgcaggcatgcaccatcacgccgggctaatgtttgtattttttgtagagatggggtttcaccatgttgcccaggctggtctcgaactcctgggctcaagcaatccaccgcctcagccttctgcagtgctgggattacaggcatgagccactgtgcccagtcggtgtcctcatttttagagaggaaagctggctaggttactatgtcttctaataggagggatattattttccttaaaaaagtgacataatttgaaggcctgaggaattactctgttaaatactggccccaagtccctttttataagcagcaagattgtttttctgcaccttccatattatctttgtaattagatcatctgtaatcacaaaattcatctctggattatcttttgtgccttttcaagctatttttatgttgttatgttgtttttaccttcctaaggcaggtgacgacaacttgatgcaggaaatcaaccagaatttggctgaggaggtgaggactgctgcttttaaaaaattcactataacttttaacaatacattctcttatagtgacgaataaccttgtgttcctttttcaggctggtctgaacatcactcacatttgcctccctccagatagcagtgaagccgaggtaataatggcagagctctaaactcttgcttcttctttcctcttgagacttaataggcccattggcgtctcttagtggtggctgggacagatctaagatttgcttgtgactgaatgttagagggaagacttcacttcttttctctagggtaaatgcttcatgatatccttgtttcttgtcatttgtatgtttctactgaagacttgagttgcgacttgttgagttcggttgtgtttcttcagctgcggtggcagcgtcatctagtggaaattgtcaggccgaggcgaggaaactggaccttggaccacagatccctgtgccagggcccggcccttctgtggttagcttttcttcctactggcttcatgtgacagaaaacctcaaataatggaatcttaaataatgtacaagtttatttctctctctctctctttttttttttgagatggaattttacttttgttgcccaggctggagtgcaatggtgccatctcggctcactgcaacctccgcctcccaggttcaagcaattctcctgcctcagcctcctgagtagctgagattacaggtgcgtgccaccacgcctggctaatttttgtatctttagtagagatggggtttcaccattttggccaggctggtcttgaactcctgacctcaagtgatccaccctccttggcctcccaaagtgctgggattacaagtgtgagctactgtgcccggcctagaagtgtatttttctgggacatgaataaagtttggaagtaggcagtccctggttggtgatatcaccaagtcgcaggagctcaggctcctgtccctctgctctgccgcctttgtggtttggttaacaagcactttgttctgattgatcagtgaggcccagcaggtctgctagtcatttgtgagacaaagaatgggaatttgtagagtttgtatctggccttgtgctatgtaaacaagggggcattggtgagtcttatttgagtcctatggagaagagcagttctttgcagtacacagaggctgcagggatttgttaaccttccctcttttccaggatcacagggctcaggtaaagttcgttgtcaccaagaagaaaaaggaaggacaaagacaggcccctgctgtctttaaagacatttcctgaaagtcacagttctacatccatcccgttgtcccctacttagttgcctggccaactgcaaaggaggctgggaagtgtagtttttataccaggaagccttagatcatttattagcaagctaaaaaccaagagtttattactaagaagagaaaggaaactatatactgggcgataagtgtttgccacacttgccattgtagcgtggtacaaatatgaagtgttaaatatgtaacaaatacctatgataccagcagtgacagcatgcaaaggaagttgttgttcatttgcacgatacccactgtctgcagcagaatttgcttttctttctttttttttgagatggagtctcgctctgtcaggctggagtgcggtggtgcaatcttggctcactgcaacctctacctcccgggttcaagtcattctcctgcctcagcctcccaagtagctgggattacaggcgcccgccaccatgcctggctaattttttgtgtttttagtagagacagggtttcatcatgttgaccaggctggtcttgaactcctgacctcaggtgatggcctgcctctgcctcccaaagtgctaggattacaggtgtgagccactgcgcccagctggaatttgcttttctttaggttgttttgccactggtgtttttttttttttttttttttctgagacggagtctcactctgtcacccaggctagagtccaatggcgcaatctcctctcactgcaacttccacctcccatgttcaagtgattctccctgctcagcctcccaagtaactgggtttacaggcacccgccattatgcccagctaatttttgcatttttgtagagacggggtttcaccatgttagccaggccgttctcgaactcctgacctcaggtgatctgccctccctggcctcccaaagcgctgggattacaggtatgagccacctcacctggccttgacactggtattaatagcccttgattttcgtcgttgttgtttataattgacacataataattgtgcatgtgtgtggggtacagtgtggtgtttcggtacttgcatatgttgtgtaatgatcaaatcaggttagttacattcatcacctagaacgtttatcatttctttgtggtgatagctttcaagatcttttctagctgtctggaaatatacaatacattgtcattagctttagtcactctactatgtaagagaacactggaatttattcctcctatctaagtgtaactttatacctactgatggaccaacctctccccatttcccctcccccatccctctccagcctctggtaaccaccattctattctctatttctatgagatcagctttcctagattgcacatgtaagtgacatcctatgatatttgcctttctgcacctggcttatttcacttcatgttatgtcctccaggttcatccatgttgccacaaatgacaggatttcattcctttttatggttgaatgatactccattgtgtatacacaccacactttctttatcctccattaatgggcatttggattggttccatctcttggctactgtgaatagtgctgtaacaaacatgggaatgcagacggcttctcagcatagcggtttcagttcccatgcgtatatacctagtggtgggaatggctgggtcatatggtagttgtttttttaattttgtgagaaatcttcatactgttttctctaatggctatattaatctgcattcccaccaacagtgtacaagagctcccctttccacatatcctcgccagcatttgttattgtcatttttgataatagccattctagcttgatatctcattgtggttttgatttgcatttccctgataattaatgatgttgagtgttttgtcatatacctgcaggccatttgtatgtcctttgggagatgtctgttcacgtcttttgcacattttttatttgaattatttgtttttttgttattaagttatttgagttccttatatattctggatgttaaccccttgtcggacgcatactttgcaaatattttctcccattctgtaggttgtctctgctttgttgattgtttgctttgctatgaagaatgtttttagtttgatataatcccactgatgtatttttgctttcgttgcctattttgttgaggtcctatccaaaaaaaccttgtccagaccaatgtcatgaagcatttcccctgtgttttcttctagtagttttatggtttgagaccttatatttaagtctttaattccttttgagttgatttttatagaagtgagcgatgagggcctactttcattcttctgcatgtggatatccagttttcccagtgctatttattgaagaggctctctttccacaatgtgtgttcttagtacctttgccttgacttattttttgacaaggaatcatttattccgtatttttctttgggaaaattctcatagagtgaatttgtatggtgttatattgaaaaagagtaggtaccttaatttattagttaagatttgtgttggcatttgttgcttctaccaaatgcttggtacaggtggcaatagtttcctcgcttcattctggtctctgcttggacatcgtggcctctgaccaccctccacccatcatcactctgttagccttttaccccactgaacctttatttttctgcatgtcatttattctttccagtgattttattattattattatttggaagggaggaacttccctcctccactagagtataagatccacgaggacagttttgtttatagctgtatttcctttacttagaactgatacagagtaagtgctcaaaccatttgttgaatgaatgaaagaatgccaaatgaatgaaacaaagctttctttctgattttgtacctcaaatggtttcccctgccactgcacaggtagtgatttttgctaggcaatgaaacaaaaatggtaaaccaacccttccccagagcctctgagtgagatctatatgcaaagataagtatcttctcacttgtgagcaaatatttttgttaagtgagatgaatcaggatcttatctcctggcataaaatagacagagaggacaaagcattgcttatttagagacacacccagacatttattagcttcccaaaatgtagcttggtctttttcctaaatagtgaattattttagtgtttcccataaaaggagctgtgcatgctaagaatttttctagcataagcctttggaaaggcttcttgtgtgtcattgaggtccagataacccgagggcctctgtgactgcttggacgtcatgattagtgagctgtgttgaacacattgtgtttgaaacgcacaggcttagctgggccagattggaatgcttcagattcatgcttcctgtccttcctgaaaactggcagtgtgtttggcttaaagtatgcttgttgacagagaagtgtcctttgtctatctaaaccttaatagctgttgagctttggttttgttctgttttgtctttttctggcacagagtagagccatagaaaggcagagaagtcactaaaaaattcagccaagccttttaattttttttttgagccttgtacacatgatgaaaagaaaaaaataggctttttattatgctttacaccaagtttccaacaaggagcaaaacaacaacaaactataacagatgcattttcatgaatccactttttatataaagcttcctttgttgggtctcattttcacaaaactaatttttattttgtttttttgttttctctttagattatagatgaaatcttaaagatcaatgaagataccagagtacatggccttgcccttcagatctctgagaacttgtttagcaacaaagtcctcaatgccttgaaaccagaaaaagatgtggatgggtaagaaaataaaatcaaataatcaacctttatggctaaatcactttttctattgtgcctgcttttatttttctaaatttcttctatttatttcaactgtgtcagtaattggataaaaaaatcattttaaatatttcaggagtctataggatttttttttttttgagatggagtctcgctctgttgcccaggctagagtgcagtggcgtgatcttggctcaccacaacctccatctcctgggttcaagcgattttcctgcctcagcctcctgagtagctgggattacaggcatgcgctaccatgcctggctaatttttgtatttttagtagagacggggttttaccatgttggccaggatggtgtctatctcctgaccttgtgatccactcacctcagcctcccaaaatgttgggattacaggcgtgagccaccgtgtctggccatctgtagccttttaaaattctgcatgcaaaagttacatattttggaaaatacattagcccttttatagtgcttcaatgccatatgatcttacaccatcagattcatttaataaattccggtctgacttatacaatctttagccagctctattcttctaatagttttttccttggtaattctaccagaccagagaagaaaacttagaaacctgattccccagcagtaccatattctgtcttagtcccaggccagttgagaaaagcaaaataaatacttttcttaatgacacaaggttttatttgaaatttggaggggaacatcataactattgggtgctgtaatgttggcctgtgattcatgtcatggagtgacataagcttcatagaacaaaggataccggccgtctccagtgggggataagcatgcttcctggggattaaaaccccattttcctccatggaaatataggaagtgttttgtactgtggccaaaaagaacacaatgtgttaatggttataggttgtaagcagatttataaagttagattccagatccggtagaccctgcaggggctggatggggaggctaccaccttcctgagacacccagcaatcttccattctagccttttattgtgacttgagtagacccaaacacaggctgaaaaggtgtcatgaacacctccagtcctggctgggcacagtggctcacacctgtaatcctagcactttgggaggccaaggcaggaggatctcttgatctcaggaggtcaagaccagcctggacaacatagtgagacctcatctctattttttttttttttttttgagacagagtctcactctgttgcccaggctggagtgcagtgacacgatctcggctcactgcaagctctgcctcctgggttcacaccattctcctgcctcagcctcccgagtagctgggactacaggtgcccaccaccacacctggctaatttttgtacttttagtagagacgaggtttcaccgtgttagccaggatggtctcgatctcctgacctcgtgacccgcctgcctcggcctcccaaagtgctgggattacaggagtgagccaccgcgcctggccccttgtctctatttttaagtaaataattaaacatttttttaaaaaacgacaatctccagtcctgtcgtagactaactgtaaaaggagaagaagcactaatccatgagaaaactttcagaacttgaaggtcctagggcatagtttcaagtctttcataaaaggaggggaattcatgctgaggcccagccaggaaaaaccaaccaaacaaaaacaacagagagtaaaaggagaaattacgaaaatggttctaaatgtctccattctgttactgagattgacgtgctcagtttaggctagatagctgtggaatgttttgtcctagatttgaacagggaaaggcacagaacccttcagaagtgtgtggtcactcattttttccactgccccccaccccgacttctcaaggagataaatatcgaggtcaagttgaaatcagacctgtgacctgtgcctcaatcccaggtcttactgggtcactccagatttataggattggttctgggttttgagtggactgcaggaccatgcttctgtgtaactctagggatgctagtccattggggtccattgaaaggagctccctggagttgcgaagtgaagccctgtatggctttaggctgtgtcctggtatattggcagaaccggaacacccaatgtcagggccagggtgaagtttcctaaggtactgccttagaattttctaagacctttattgaatggcctttattgcctgctttctctttaattcattttttatgggtttttttttttttttgagatggagtctcgctctgttgcccaggctggagtgcagtggcatgatctcaactcactgcaacctctgcctcccaggttcaagcgatcctcctgcctcagccccctagtagctgggattacaggcacgtgccatcacgcccagctaccttttgtatttttagtggagttgaggtttcgccatgttggccaggctagtctcgagctcctgacctcatgtgatccacccgcctcagcctcccaaaatgctgggattacaggcgtgagccaccatgcctggtcctctttaattcatttttatgtattctgtctatcaaacattgacttggatgttatttggggttaatatatgtacattacacgtgagtgatttttttggctgggctttgacttaacctacttctttattttctgattcagagtaacagacataaacctggggaagctggtgcgaggggatgcccatgaatgttttgtttcacctgttgccaaagctgtaattgaacttcttgaaaaatcaggtaggatgctccttgagaaatgccgctgatttctatttattggtatttacattatttttaataaggatttgtttggggaagaattaaaaatttttttaaattattattctgatatccttttaggatgtttctagaagattctaattgaacatagaagtgatatttcacgttgactttttttatttttctcatcttttgggagatacagatgaatacctagaaactttttctagtaagaccatcttataaattaaaagagaaattagtagagataaacgattagccctgttttaaacatgctcaatttctctcatgaaacagtcaaaataaccacagtaaaatatgcttccagtttcagcttactaaatctatcaatatgtagccttagataagacttacgttgaagacttaaatgaggccaggcacagcggctcatgcctataatctcagtgctaggcgaggccaaggccagaggatcacttcaggccaggagttcgagaccagcctgggcaaacatactgagaccttgtctctacaaaaaaaatttaaaaattagctgggtatggtggtgtgcacgtgtagtcccagctatgctggaggctcaggcgggaagatcgcttgagcccaggagtttgaggttacagtgagctgtgattgcaccactgcactctagcctgggcaatatagcaagaccctgcctcaaaaaaaaaaaaaaaaaaaaaaagagaagaagaagaagccggtagatgtagtttagggcacaggagcctaggttgggatttattggtgagcagcttgcttttcagtagtcaggacttaatttccattgttgtccccttgacttggcgtttttatgtcagtgaaatagaaatgaatattttctctttcttcattattaagtttaatgagtaaattactaccaagtatttatatatttaagggctttctgagaacataaagattcaactaattgggccggcacagtagctcacacctgtaatcccagcactttgtggagccaagatgggaggattgcttgagcccaggagtttgagaccagcttggggaacatagggagactccatctctaccaaaaaaaattttttttttaattagccaggtgtggtgacttgtgcctgtagtcccggctacttgggaggctgaggtaggagaatggctggagcctgggaggtcaaggcttcagtgagctgtgatcacaccgcagcattccatcctgggcaacaagcaagatcctatctgaaaaaaaaaaaaaaagaaaagaaaaaattcaacgaactaaatctttttctctactccagtttgaatagaaatgaagcaaatgcccctccctacccctgaacatccaacaatcaaagaaaaatttcaaaaatatatggcaaagttttattaaaaggttaacattcaggatatatatgctttttggacagtaatattaagctcaaatctatgaaataatccatatatacagtgctttttcattacgtggattatcaagatgaagattctgagccacttcattagaaagtactcaaagaaaagagtaaattaggctggtgagttatagttacatattgtggaaagaaattcagcaacaggaattggaaccaaaagggtttgaatagagaatttttgttgattacaacaccccactcctagttcctagtcattgtaggttggtgctgagaaagttcaagttttaaaagggttttttgttgttgttgagacattcttgctctgttgcccaggctggagtgcagtggcgtgatcttggctcactgcaacctctgcctcccaggttcaagtgattttcctgcctcagccttctaagtagctgggattataggcatgtgccatgacgcctggctaattttctatatttttagtggaggcggggttttaccatgttggccaggctgatcttgaactcgtgacctgaagtgatccgcctgcctcagcctcccaaagtgctggaattataggcatgagccaccacacccagcctaaaagggtctttttttcttaagataaagttcttaaaggaaggatctgaagttttgagtataatattgaattttcatttggttagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaaggtaaatttcatgttagaaacatacatcttgaaggcttctgttagaacagaagaaagtctagaaatgtataagctaagtgcttaattcaagaaattagaggaagaaaattgaatagacccatatccattaaagacattgaatgagtctactcaccagacaaacaaacaagaaaaggcaacaggtggttttacaaatgagctctatcaaacaaagaacagatcattctaatacaatccttttctccagcaaatggaaaaagaaggaacgtggcctaacagactttatgagtgccaaaaccaaagaagggtaacatgctaaaggaaaattaacaggccagtttcagctatgaatataaatgaaataatcgtgagcgaaatctgagaacaccaaatacagcaggaagtagggtttattttaggatttccaggtgattgaacatgagaaagtctgtcactgtaattcaccacattgtgattaaaaactaaattctcaccatagtaagtacagaacagtcatttggtaaatctaatatgcattatgaccttttgaaagtaattataattttgatgaaaattattaagaagacccatataaaagcagaggtatcatcttcatggagaagatgcaatatcttaaagatactaattgtctgcaaattttgtagaatttgacagtctgattctgaaatccaaatggaagcataaaggacaaagagagtcaagacaattttgtggaaaaactaggtgggagacattcccagccacacagtgtgaattattatgcacttacagtaattaggataatatggtagacaaacagacgatcggaacagaagaaagtggaaatttatgcatatatggaagcttgagagcaggtaccacagatcagtggggaaaagattaactattaaaggccgggcgtggtggctcatgcctgtaatcccagcactctgggaggctgaggcgggcaaatcacttgagctcaggagtttcagaccagcctggccaatatggtgaaacaccgtctctactaaaaatacaaaaaaattagccgggcgtgtcggcgcaagcctgtaatcccagctactcgggaagctgaggcaggagaatcgcttgaacccgggaggcaggggttgcagtgagccgcgatcgtgccactgcactccagcctgcgcgacagagtgagactccgtctcaaaaaaaaaagctaaaacattaactattaaaaatggtgctgacttaactagttatgtatatgagtctagcataggattactaacctgccactacatataaaaatcacttctatattaaaatacctaaatgtggaaagcaaaactgtaaaacttatagaaaaaaatataggcgtatgcatttaagaggttggcgttggaaggatagcttaagagaccccaaaagcacagattgctaaagaaaaggtatataaatctgactgcatccaaatttttaaaaaccccaaagtttttctttctgaaaagaagttcttaaaaaagtgaaaagacagctatagtgtagaagatatttacaacaaacatttagccaataattagtgtcttataaaagattcctacaaatcagtgagacaaagacaatctgttagaaaaatggacacatgacagaccactaacaggtgaggaacccgaggtttaaaagacacgtgaaaagctgtctggtttcctgctgtttttgctcaccagtcatattggcagtaggtaaaaagtgccagttagccatattgacaaatgtctggagctatgggaattcatatattgctggcgggagtttaaatttgaaataggcatttcggaaagcagtttaatggagtttgagctactctttgacccaggaatttcactctaaatatatatgatatggccaggcatgatagctcacccctgtaattccagcactttgggaggctgaggcaggcagaccacctgaggttggggtttcaagaccagcccgaccaacatggagaaaccccatctctactaaaaatataaaattagctggatgtggtggcacatgcctgtaatcccagctattcaggaggctgaggcaggagaattgcttgaacccgggaggcagaggttgcggtgagccgagatcacaccattgtactccagcctgggcaacaagaacgaaactccgtctcaaaaaaataataataaaaagtgtatatatatgtgtgtgtgtatatatatatataatagacaaaacttgcccatatatatacaaaggtgtgtttacaaatggtcagagcagcatgtttatagtgcaaaaagttttgtttgtttgtttaagacagaggggcagtggtggttctgtgggtcttggcccctttctgctgtcagggctgagttggctccatgagttggtgaaagcggtatctagccaggttcaagggagacaggggcaggatttcgccttcactgatgggcaggccagcggtcccctgtggaacggtgactattgaatattgagaggacagtatccctccctgagcatcttctggagcttgatgaccactagggaatgtatctgagtcacgcgcaccaaatgtgttaccggtggcagctattcgagttatcccgagttcgtgctggtgtatccgtacagttctgcagcaacttcagctcttgcctcctcggaagaaagaattggactgagggccataaggcagaaggagagactgaggcaagtttcagagcaggacggaaagtctagcaaaaagctctagaacagtaaggaaaggaaagaaggaaagtataacttggaagagagccaagcaggcgacttgaaaaaccaagtgcactgcaacaagtatttaaacagtgatctaaatgcccatcagggtgaaaggataaatcagtatagttgcatgtagagtatgcatagtcatagttcataaaacaatgatatacaagcagtgaaaattaataaactagagctgtagatagcaacatgttttcttgttttgttttttgtttgtttgtttttttgagacgaagtctccctctatcccccaggctgcagtgcagtggcgcgaactcggctcactgcaacctctgtctcctgggttcaagtgattcttctgcctcagcctcctgagtagctgggactacaggtgtgcgccaccatgcccagctaatttttgtatttttagtagagacagggtttcaccatgttggccaggctggtctggaactcctgacctcaggtgatccgcccacctcgacctcccaaaatgctgagattacaggcatgagctaccgcgcccgggctggaagaattttttaaaacactgttcagtgaacaaaaacccaagttgcagaaggatgtatttcatacaacaccatttatatgtgtctgaaagcaacacaacatatatatatatatgtaatctaatacatacatacatataatatgtattacatataatccttatatatatatagaatcttaatatatatatttaggtcaggacatttagatcactgtttaatatatatattaggattatatataatatatattatattattatgtattaattatataatccttatatatatattaggattccatgcaaatgaagtaaaaatataaagaaataatgcaaactacgaaccaaatccgaaaagcatttattgaggcaaggatgtggatatagatggaaaggaaacctagacaccttcatgccttttttcttaaactgggcaataggtgttgtctaggtatgttaggttattgttttccatttctatgtctgaaatgattgtttttcattttaaaaaatgatggtacagctcacagatctaaagcaaagtgaagttttaaatgaatgcattaagtacaatcagtaactacagaatgtgatctaaaaatacatgttcctcatgttgcagggtgagaatggaaatgaggagtaaattgtaatcgtgccagggaagccaggtgtctcagcagatttggaatctttgcatggcaggtggatccaatttatgtaatgcttgggttaagacagctcaggaaggcagccttgcaatgaaacgtgaacctgtgtgcgtttttagcagtcaccacatggtggcagcctatccaagaaaattcaagggcaatagtttgcacttgagagcccagaaattttgatttggaagctcagtggaagaggaaaataaaccgtgccctgcactgaacagctgtggtgaagagagaaaataccttccttggcaattgaatgttttcgcagctgtcacagatacttttgctagttgtatctatatttttgaaaaacaaagacatttttcaaagtacttttttattacgggaataaatcaccttgtctctgtactttgggatgaatctcatctgaactttgagaacgattaagtggcttcactttctggagaatctggtcattgggtaacattcttgttttcatatggaccagaaggttctctttcatagttgatgttgcacacacgtttttttccctaagtccttggtatttatagtggcaccattgcgaatgttagaggctatcaactttcattcttattattgcttcatctttgtagccaaaaatatgggaagaaatgttcatagccccgccccatacttgtccccctctacctggcctacctacctacgtcaggctcctgtcccaccacaaatgacagcctgtgtctttcatgttagcagctagtctttcactagccacatacttccccgtaacccatatgcctccctgtgtctgcctgacgtttgaattgtcactattctgttgttgtatttttacaagaagaatgtatggggcagaaaacccttgccattcatttcctgagtaggaattctagccttccttggagtcgtggtaatatggagacatggtaatatgtggattgtaccactcaatggctgtctggaggccacagtggtgcaaaaagccacctaggcatgggttagtgtcctggggcacccaatcaggacaggacacctggcacacccttggaaaagcttcactgtgaaaaacactggaagtaaaaattttaacaacagatagggatttttttccccttgagacagaggctcactctgttacccaggctggagtgcagtggcgcgatctcggctcactaaagcctctgcctcatgggttcaagagattctcatgcctcagccacctgagtagctgggattacaggcgagcaccaccatgcctggctaatttttatatttttagtagagatggagtttcgccatgttggccaggctggtctcgaactcctgacctcaagtgatccacccacatggccctctcaaagtgctggaattagaggcctgagtcactgtgcctggcccacatggggatttttgttgcccagcttaatcaaccaagaataaaagtgcattttaagattataatctatttaacttctccttattggcaatggtaaaagagttaaggaaaaaagagaataagcttaggattatggctactaagtagaaggacgttatctttgacgggcatttctgttgtgcttatttgtacctgacatggaacaagacccccccatcccctcaacacatacctgctgtgggacatctggctagagatttccaaagctgagggtgaaaggtttgggcatcggtgtgactgtgtaacactagagttctatctaccatctcttaaactacaggtagtcttaccggtgtgggctgaccttccggttatcaggcagcctgctgcaaccactagaaactgcctttgaaggtttccagtccggcacaacatttgtgttctcattaaacagtagagcataggctttggggacacacagctctgggctcaagccttagctgttgctgctctgagcctgttccctcgcgtagaaaggcaatcataatactccctactttatggggcagttgtgggaatggaattaaatgctaatgtgggccgggtgcagtggttcacgcctgtaatcccagcactttgggaggctgaggagggcagattgcttgagcccaggagtttgagaccagcctggcaacatggcgaaactccatctctaaaaaagtacaaaaattagccaggcgtggtggctgtagtcccaggtactttggaggctgaggtgggatgatcacctgaatctggggaggtcgaggttgcagtgagctgagattgcaccaccgcactgcaacctggagtgcaggctggaggaagagaaatatatgggtcaattaggcaaatcactcagatcgtaagtagatatactagtaaaatagcgtgacttagggtccttcactggaagcctggtattaatgcttccattgtgtgggtgggggaaggagagagtgtctccagctctctgtctgtgaggtctcccagccgaatattggccaagggagtgaaaccagaagcaagactaccatgagacaacgttccagagaaaggagggactaaccagagcaggtgcccagctttggccagtcaggctcatcttccagtcctcagtagattattatcaactttaagtgatgtcacagactcccttcctccaaagctgtggacctcttccttcccatgcctcttgttacttggaagtcactctacttccaaacatgtcggctggagatccctgatgggccagttactactttcaggctctgtaggtttaaagaatggttatatccagttagttacaaatagaaatcgatcctttctctgtccgtctgtctaaacggaaggatattctgtggacgctgattaggtataaaatctccacggagcctgagcatgaagaattgaccttcttagggttccacagaaaccagaatagacttctgtgtttggtagctttgtaacttacgcccgttgaggtgtacggttgaaaattgagaataaatttcctgttctgtttctgagcatcttttccaggcttggagatgcgttgagcatttccacggagaccctagaggtggggaggggaagaacgcctgggcatttgtccaaattagccatatgctgtggagtgtcacatgtcaggaagccaaggcactggagctagtgtttttgggcagggctagggaaccccccgcctttcctccacccaaacgcaggcccccacacccagcgtcctgggccctgcaggggaatgacactgttggtttcactctcaggaatgagcctagatttggaggtaacctcttcctgaccccgatgatttcactctgatgccaaaaccagtctgaagtgggtgtggttttgcatttggtgtttacaaggtggagtggtgccctctgcacggaagggagaggtgggcaggtacggcagggccctgctccctcgggagtctcctctgaacctgtggttagggcacagctggacaatgctgaaatggtctccagctgggagatgaggtaaacctcagctgcatgccgaagaaataacctagaaatcagagaaccgttttattttgtttttctcagaggatctcatttctccctctcctcctgagcacagagaccctcaaaactggtattcacagaaggaaaaaatataggtctttcacctttgaaggatcaaagtgtctagggttttttgtggttttttttttttttttttgaacaaagctgaactattacaaagtccttttcagtttaaatttagtgcatggcatggctcatgaaagacttttaaaagtgaattggaaaattctaaatgtacttgtattatacatgtgaaaggatgacttcttaaaaaaagaataatgtctgtcccaaacgggagaaggaaggaactctagcttttaaactgcactacattagtgagttacatgacaattctccttttaacaggatggaatgcacttaaagcagtaatgtgctatggtgacagtaatgacagacaatgttaattgacagaatggctactctgaaccaggcactgtcttgtactcctgttatctcagtggtcttcacacttattctgttaggcaggactgtcatcctccccacattacagatgaggaaactgactgaggcttagagaggagactttgcaaagatcatgtgattaaaaaatggtagaggtggcaaaacagcctgtgtttttaacactgtcccatgtcagctcttattccagatcatcacataaagtctaatctctaatcttgaaaaccgaaaagcacctgccacctcagataagagagaccaagaccctagacattcgacttgtgttgaattcactcttattttgttttgatgtttgtaatcccagagccatacttgttaatgagctgaagtagagtgaatgctgtcccctccctgaggcctggggctcatcatcagctctccaggctcccctttcagaggggatggtgagcaccttcggagagggcagggatggacacacaagacagcctcagttatgtgagttcatcccctcccctgcctgctgtgggtgagatggagaaaaaagcactggaccctcctgggcatcacagccttgtacttagcgagtggctgaggtcatcagtagcccaggtcatcagtagtgtggaattaagtgcactgaatagtgttggcccctgagctttgtttgacagatttagggggtcagctcaccactttcccctcttgcttctgtctgatcattgctctgtttgttaataccaaggaagaaagtgaatagaactttttagagagccaaaaaaactttattagactttatgccattcattatacttagcagtgttgagggaaggatttgtgagacgatatattcaaactaatgggcatgagaccaagaaggggctgtgtggcgggcgcggtggctcacacctgtaaccccagcactttgggaggccgaggcaggtggatcatgaggtcaggaatcgagaccatcctggctaacacggtgaaaccctgtctctactaaaaaaaaaaatacaaaaacaaaattagcagggtgtggtggcaggcacctgaagtctctgctactcgggaggctgaggcagaagaatagcatgaacccgggaggtggagcttgcagtgagccgagatcgcgccactgcactccagcctgggcaatagagtgagactccatctaaaaaaaagccggttggggtgggggcatgtaattaacagactgattggtcttaggtggctcagaatttaagctgagaaattaagattgagaagaaatgatgtattgtcgttatatcaaatatgtgagtaaaaacataattaaaacaccatctatctccagttttcccaacattacctcccttttatgatgcccttcctgtaccttattaggcaaaatattctaatttcagtctcattggattatgttctaaatgtttgaaggttggtctgaacatggaatgtattttctcatagatataatagtataaatggtgttagggtcatgggattgcgaagccagttccactgcagtagaatcatattgacttgctttccgatttttctgtgggaaacttcatctggagctttaatgcacttcttagctgtggggtaagtttcagcctccatgacgcttgtgttactttgtagtcacctgtggccaaccacaaataaatctttgtggtcatcaggggccagtgaagtgtatactgcacaaaagagagcctaccccaattctggaagaagggctgcaggcctgtgtcccacaaagaacaggcaggaagcatcaccttcagcccactggcagcaggtcatctcccatttgcttttctgcactatcagcagagtctggcttccttttccaccccctctccaatgtgaatgctttttaaggtcgtggaattagaatttaaaaaaaaaatttttttgagacagagttttgctcttctcgcccaggctggagtgcaatggtgcaatctcagctcaccgcagtctccgcctcccaggttcaaatgattctcctgcctcagcctcctgagtagctgggattacaagcatgcgccaccacgcccagctaattttgtatttttagtagggacagagtttctccatgttggtcaggctggtctcgaactcctgacctcaggtgatccacccacctcggcctcccaaagtgcagggattacaggcatgagccaccgcgcctggccagtattagaatcttttaatgggaacgtcttaaacataacctataacaatgaagcaccttataagtgtgtggagatttccttttcatggcttttcatatatgcctcgcactcacccagcaaccctgcaaactggatgttatactcaccagagagccttgaccctgattgtcactggcaaggagcagtgtctggacttgaacgcaggtcgcaggactccactcatggtgctctccccactgcacctcaattcctcacttttcaaaggaggcagcggaagcctggagagtttctcaaaggaaacggaatgcagaaatctgtctgtgtgcaatgtgaggctcagaactgaaaaccataaatgtcaggaaatgcaaagcagaattttcccctgcaacggcagtttgcatgaatatgaagacgctgtatggatgaaagtttgtggctgcagcatgagcataaatcctcggggctgctgttcgtctaggagcctgacttgcctggtgttgccctgagaactgcaacttgagcatttccttaattttgtactaaaggaaccaaaatgaggtattttggttctaagtctttgtcatgtgaaggaagcttcctgttaccaccccccatctacatacacattctctttcttagccccacgtttgaattttatgtttttcctaaagtatagggaagattattattattattattattttctttttcagacggagtctcgttctgtcaccaggctggagtgcaggcgcgtgatctaggctcactgcaagctctgcctcccaggttgaagtgattctcctgtgaaagggaattatttttgatgagtcattaaagtatatccattcccagaatggtgctgcatttttccttttatcatctgtcatgacttttttaagtgtgaagcttacttccagaggaattgtcttttctagcattttggacacaactaaatatctttgatattttcttctcatatgttgagcagtaaattaagttgaatggtgaagtcagaggtgaacttaggaacatttagaaaaaggaaggtcatttattatttttcaggggaaaagtttggtagaaaaatgctgtaatcctaattcccagatgtccatttggcttgtagtcattttgatttatgaaataatcataagaaatgtcttcaaattttaaaagccaataatttgttctactaatcacagatgagagtagaaataaaagaaacacacccaattcctgaaaggaaaaaaattctcccaggatgagatcactgggtggacgtgaagtgggtaaaataccttttgctgcaattgtcatccccttatcttgccaaagtacgacaacatctgaatgaagatggtttgatgttcttagtttagagtagttatactattattttaacattcctatttaatgatatgttttaatactgcaggggaaaggtagatacagattcatagctacaaagcaatactcttatgatcaatgttcatttaatttcaaatacaaagttagacattcagagttaaaaaaaattaatgcataggctgggtgcagtggctcacgcctgtaatcccagcactttgggaggccgaggcaggcggatcatgaggtcaggagtgtgagaccagcctgaccaacatggggaaactccatctctactaaaaatacaaaaattagctgggtgtggtggcatgcgcctgtaatcctagctactcaggaggctgagacaggagaatcgttgaacccaggaggcagaggttgcagcgagctgagattgcaccactgcactccagcctgggccacagagtgagattccatctcaaaaaaaaatagatatatatatattttttatattatattatatattatatatttatatttttatatatataaatgaataaacaaggcatctgcttatgaaacagtctgcctgaatgaaatctccatttgcaggcaacacagtctacagtaatggcaggactgtattaggcatggttcctaatgcccatttctgtagcaaagtcaccagtagttcctaattgccaaaagtgagtcaccggtagttcctaattgccaaaagtgtattttttgcttttatcttgcttgaccacagctgtcatataaacctgttggccacacccttttcccttagcctgaatgaaaatgccccttcctgcccttcgtagctcctgagccaccaggacatggtggtctccatcatctgttcgttatctctaaccatttaagattagtgctccccaaggatgtctgttaacctgctttccttcccattctgccagtttcccctggggaatccacacttctggttttaaccatcacctaaatgctgtgtgtcccgacccgcatccgcatgctcccaggccattctcagttccagacccgggcccccagcttcctgcagacgcctcctccaggagatctcagtatcttgcttttcctcctaccccttctaaggcattctcaatccagcttccagaggaatcttcctaaaacacatctgactgtgtgagccacatactgtagcccaacctgacagcttcttttctatattaagaaaaagtgcggccgggcgcggtggctcacgcctgtaatcccagctctttgggaggctgaggcgggcagatcacgaggtcaggagatcgagaccatcctggataacatggtgaaaccctgtctctactgaaaatacaaaaaattagccgggcatggtggcaggtgcctgtagtcccagctactcgggaggctgaggcaggagaatggcatgaacccaggaggcggagcttgcagtgagccgggatcgcgccactgcactccagcctggacgacagagtgagactcgtctcaaaaaaaaaaaagaaaagaaaagaaaaagtgcacacattttgacatctgagaaaagtgatgtttttcttagaaaagtgacatctaactctttatagaaactttgccacaaggtagtctaggagtccccttactacctaagattttcatggacatgccctgtctgatcataaagcatgtggcacagtggctcacgcctgtaatcccaacactttggaaggcccaggcgggcagatcacttgagcccaggaattcaagaccagcctgggcaacatggtgaaaccctgtctctacaaaaaatatttaaaaaacaaaatgaactgagcatggtgaagcacatctatagtcccagctacttagaggctgaggtaggaggatcgcttaagcccagaagtcagggctgcagtgagctgagactgcagtgccactgcattccagcctagaggacagagtgagaccccgtctccaaaaataaataaattaattaaataaagccttgtgaagaatctgccgtggagcataatgtaacccataaagccacttaactgggcgcacataaactacataaactacagtgtgtcccagttcattgagagtgaaaatcaagcaagggaccacctcagtgtggtagagccccctccctgccctccagaccctgctctgttctctgtgtctgaccattgactggccatcactcaggcactagttgagaatgccaatgtctttagttattgtaatttcagaagcacatccttgctggacaaagaacctacctgttaattttttaaagtaatgttcatcattttgaacattgttttctttcttttttattcagctgaccctcatgaggaatttaacttggttttctgaactgtgttggtaacatttgaaggacatagaaacagttttcataggtctcaagtgatataaaccacaattctttagaaaatatctttttttttttacccattctggattttgaaatatatacagatctcatacctcagattctcatatgatatgaactgtttcaaaacacattgatagcagaagatacatactgtcttctagtcaagagggtagcgctgtatttagtttaaaacattttaatgcattttatttgctaaatacaaaattataatattctgtataactttccaaatctcatctgtcctccctttcccccatctctttatattcagatgcttgtccctccagcttaaaaattcatgactttgagaaaattcgtcttcatgttatctaaactactgcacccccacacgctccctgttaagtgtctgcatatctgtgtcttactgttgtttaaaattcacttgtctgcctggggagtggggtggtttgctttaagctgctccactcaagtctcagcagagaaagcaataatttgttatgagatagagttttaagccaagctttggccagggtctctcccatttgggaggaggaaaataggaacaagtgagatgataattttccttgaattttagctcattaaaatcttcccttgtcctgggcaggctatttactgatttaagcatctagcacttttcctttccagaaagaattaacatctatgatgcaatcattgctaagggaggaggtttttgtgttttctctgtggaattagctgttctccagttgcagatgagcacagcccactttagagttgtgtgtaggtatggagttgaggggtcggaatgagatttccaagatttataggtaatgaaaagaacaggttgtatcaaagacaccacgtgtaggaaactaactgttcttaggggacttgtgtgaacctgtgatccttggctttctccaaaatgaacatttcagccttgttcatattaacctcctttttacagttgttttaccgtgttctggttttgctgctattctgcctgaaaatctagcaaaatggcgtttcttatctgcagaactgcgacaaagcttaaacatttgtatttctcttgaggattactgtggttgaatttttgacagtactatatataaatgaagaaataaaattttttatacagatgtttaaaatcctctttccactagaacatttctttctccctaaatatactattacctggaactctagctgtttttcagatctgtagagatcataggtggcttaagggactagattgctggtgatattggctgcaaaattttttttttttttttttttttttttttttttgagacagagtcttgctccatcgcccaggctggagtgcagtggtgcaatcttggcttcactgcaacctctgcctcccaggttcaagtgattctcatttggctgcaaagttcttagtgaggtttagtggtattttggccctgtggcacagaagaatggttatttagcaaatgtgttttgcttttgattttgttttgtttttgagacagggtcttgccctgttgcccaggctggagtgaagtggctcgatcacagctcactgcagccatgacctcctgggctcaagcgatccttccacctcaacctcccaagtagctaggaccacaggcatgcctcaccacacctggctaatttttattttattttatttttgtagagacagggccttactatgttgcccaagctgttctcaaacttttgggctcaagcagtcttcccaccctggcctcccaaagtgctgggattacccagcatggcagcatgagccaacaggtctggcctcggcaaaggttttagtagggctttctcttttcttttgaagatgattaatacagtagattcatacagccagaagctgaaaagcagggaatactgtttggcttattaatggataatcaatcagtgttaatacacttttccctatttacatggtcaaattgatcaaatatttccaaggtattagcttttaaaagttgactttgtcagctctatgaaaagacatgcatttacatttttatcgtgctcctcctctgtcaggggacttggatctgtccttgatcttggcttttctgttcataaaccaggtaggactgtcatgggtttgctcccattaccatctcttgtcccaagatttctaaaaggcatcacctgatgcacccttttgcccaaatagtgttaaaagtcctcaggctgaggagctgtcctggttcttctacaggatctttaatgatcagcctgtctaagctgagaatggataagggtgtccccaacacgtttatttggtggtttggtgggggtagtgacactggggatgcttttgtgtgttgtaatctgcccctctgtctgtttgaccccagagactctgtggttagttgcaggacatcaaaatacgcaggaaagacagtgggggaagagaccatcagtcgccctcttgctgcctaggttcactagaatctctaagactgaattcactaggagacacaggacataccgtagagctgtttatgtcttgagagccccagtttcctagtctgttaaatgagcatagtaacaccaatctcactcctttggaatattcaatggtgtaatacttacaacatctagctgacctgtacaattatagctattctcttctgcaagtctaatattcctattcacccctccctctgcatagggatccagtttgaaatcatcagttgctcagtagggcctggggagctagctggtcattctttggttaaagtcaaagccaacctctttgcctacctttttgtcttaatgtcaacttcctaccagacatgttcctcccgcactggatgatcaaaatgcaaataggatggacacgatcaatgcattttgttggagtggttgcattctttctactttcttagggcaaaaaaatgaatggttggacaagagactaaccaaggcctcaaagaaagtgaaattctttctcaagctcctgaaagtcctttcatgggtatagtaacagttctataggggtctcattgtgatggtgccattatacaggccagcaagccccctgtgtgagccagacctcatggccttagcccttgttttcctctttttttttttttttttttttgagacagggtctcgctctgttgttggagtgcagtggtgtgatctcggctcactgcaacctctgcctcctgggttcaagtgattctcgtgctgtagcctcctgagtagctgagattacaggcccccaccagcacgcctggctaatttttgtatttttagtagagacagggttttaccatgttggccagtctggtctcgaactcctgacctcgtgatccacctgcctcagcctccctaagtgctgggattacaggtgtgagccactatgcccggctgccccatcctttttcttgatattatagttagtggtgaaaacatgtaaatgataatactccatgcagtatgtatgctgaagtgactaccctgaagacattttttaagtcctattttcttttctttctaggatatgataatcattttctgtttgtattaatacatgcttgaaaggaattagtaaagcgattccatccttgtcagcagcttggaacaaagctgtggatctgggattgtgtagaactcatttgacatcagtagttacttgtgtctttatgcctcagatcaagatgtgcgtgtttttttctttctccttttagcttcacgaggctgacattgtggtcctaggctcacctaagccagaagagattccccttacttggatacaaccaggaactactgttctcaactgctcccatgacttcctgtcaggtaaatgtcttcacattggtgttgagccactgattaggtcagatagttcaaagaaatgttaaccttttcctaagaggttatgtttctgaaatgttagcagtcgtcaacattaatatatagggtaggaaacttagactgtgggctacctgatagaaccatgctgttgagcaaagagagaccaagatggcggttgaggtgtctgctcccacagtgaagtgccccctactggcctctagcagtcaggtcagttgtgacctcaagtagatgatttgtatgtgtgtgaggtaaactagaaatagcggttttcacagtttcttaaaaattagtaaaaccctttcttccaaagaaatcttcgtggaatctcactatgtaaaagcagatgagcgccggattgttgggagggatgggaataggatcagcctgtgtgtctccctgatttcctcttgcattgacccatgaagcacatccttggagccccagagtcatctcagaacagtatgaaaatcaccactagatgcagaaactgttgtaggattggtcctgctatttgatggcattttgccaaggtatccaggaatactcaagaccacaccaggcccactttgggggcagcccaagcagtgcccgcaacagggcagccagcagccccgggtccagcaggagccggcccagagtgggttcctttttccagttcgtagaaggactgaggctaagaaagccttggagcacacccaggccctcagcaagtccctgagtagcacaggtgagccagagacgatggcacagggaggcagaggagagcccctcttcctgattccttctggctttggcctccaaatgtttgtgtggaagagaggactgtgctgagctgggctggaggacaggggcagcttttatccctaaagctgggcagaacatgcaccaaggttggcagcctctgctctccttctcctccaccaggaccatacttgaggttgaaatcttgaaaccttgtaggcagctccataaaagcatgagccctagccagaggttgttactgaccctcctctctaggaaatgtagctcctgccagaattgaccgatcagattaaaaaccccttgggggctggagagggtggaatggaacagagtccaaggaaagaggcattaagagctgtggccctaatggctctttttaacaaacagaaagcatgtactaaataacattttaaaaatatgtgtaatttattcatataactttttttcccctgaaaaaaaaaaaaaacaaagcctaacctattaatagtggacagggcttcctctgttcagcatcccagtcagattaggaaaatcagttccaacatttgtttcttgtaaatgaatgctgctttgctgtaatatttacttgctgtgttttattaaagttttcatgtaggacagttttggcagtcatggctggagataggagtctactttgatgttctggaatctctttgagctctgtggttatatgacagtgacatatattttgttagtgaaagtgctttatttttaataaggtttccttttaggacccttatttttgaaaaaaagtattccctgaaatattagatatcaatgtaatgattctctgggggaaaaaaagaccaaggcgttacagatgttcctcgactgaccatggggttatgcacagataaacccatcagaagttgaaaatatcattagtaaaaaatgggcatttgtagccaggatgggatgtgaaaacagaaaacaacgtccaaaaatgctggcagcacagtacgctgtagagtattggttgtttggcctcgtgattgcatggctgaccggaaaccacgatttgctgtcactgctgcccagcgcctcaagacagccttgttctttgtatagctggcctgggaaaagatcaaaatttaaagcacagtttctactgaatgcatgtccctttcccaccatcataaagtggaaaaatagtaagtgaaaaggttgtaaatcagggatggtctgtgtatttcaaaatgattctataagtagaatttatttgaaatttatctggcccaactgtaatagttttcttgttggtttttgaatgcccagtgtccagaatagtacctgacgcttagtaaccgctctgtgaaattttttttttttttttggagacagagtcttgctctgtcaccctggctttagtgcagtgggtgtgatcttggctcactgcaacctccaccttctgggttcaggtgattctcctacctcagcctcccaagtagctaggattacaggtccctgtcaccacgcctggccaatttttttttttttttgtatttttagtagaagtgtggatgcaccatgtttgccaggttggtttcgaactcctgacctcaagtgatccacccacctcggcctcccagagtgctaggattacgggcatgagccactgggcctggctaactctgtgaatattgagtgtttgacaagttaataagcatgaatcaaaattctactctgcttgtagttttaagttagtggcatgtttagaaacatttccttgaatttgtctcccacttaaagatggggctgatggccaggcacagtggctcacgcctgtaatcctaacactttgggaggccgaggcaggtggatcacctgaggtcgggagtttgagacctagcctggccaacatggtgaaactcttgtctctattaaaaatacaaaaaaattagctgggcttggtggcaggtgcctgtaataccagctactcgggaagctgaggcaggagaatggcttgaacccaggaggtggaggttgcagtgagccgagattgcaccattgcactccagcctggatgacaagagcttttttttttttctcaaaaaaaaagaaaagaaaaaaaaatgggctcaactaggcagtcattgagataaagatgaggaatgctatgttgatgaaacagatgaacagtttcggggtggtgctacccataatagcacatttctaaatagtctacaagttttaattttagcaactttgtttagtatgaaaatttgatctaggaataatggagaaaggttttttttcccctctttttttcataatcccactactgtaaagaaatgaataaactttttgaaatattaaaaagaaaagagctcttatttaaacttaagatgagaagaacttttaataaacttgtggctgggtgaagacagagttttataatgaaatttttattcttaccttcatggtacagagtccctcctccttacccccgtaaaaatagatgggatgttgtgatttatgatgaggcaattctgtagagacattttatggaatacgtaatcctaggagagattttcctgatggctaatatcccagacacagagctcagaaaacaattatacccagctagttggttctgttcactctactattgcatgagtccaatgtttagattttaaaacaaggaaatttcaacattctgttttctagctgtaagagtaactactttaaaaaaaaaaaaaaagacaaccaaaaaaacctatttcttagaaaaagtcttgctctgttgcccaggctagagtacagtggcacgatcacagcctcaaactcctgggctccagcaatcctccctcctcagctaattaaaacaattttttttgttgttgttgaggcagggttctcactgtgttgcccaggctggtcttgaactcccggcctcaaatagtcctcccgcctccacctccaaaaagtgctgagattactggtgtaaaccaccatgtctggcctaaaaaaattatttcaaatgaaaaaactacgcactgctcttgtagtgccctgcttgctaaacagcagatttcatcataagcaaaatcattttgtaccctaaatattaggacttatttactgatgtaacaaatgggaccaaggagaagctggtcttccgtcttaggctcagaaaacagtatcaaaacagcaactctgtggctcagagtaatttatagcatcattttaagctaatgtaattctatttagtgtggaagaggggaagagccctgggatgctgatgtgctgggggtcccgagggaccttgagactttctctcgtatggctctgaagggagacattagaacttactggaggctgggcgtggtgtggctcatgcctgtaatcccagcactttgggaggccgaggccagtggatcacttgaagtcaggagttcgagaccagcctgagcaacatagtgaaacctcatctctattaaaaatacaaaagttagccgggcatggtggcaggcacctgtaatcccagctacttgggaggctggggcaggagaatcgcttgaatccaagaggcagaggttgcagtgagccgagatcacgccattgcactccagcctgggcagcaagagcaaagctccatctcaaaaaattaaaaaaaaaatgtagtggaaagaacatggactttggagtcaggattaacctaactcaaggacaagggagctgtttttgtaaaaaaaattcttggccggatgcggtggctcacgcctgtaatcctagcactttgggaggctgaggcaggcggatcacctgcggtggggagttcgagaccagcctgaccaacgtggagaaaccccatctctactaaaaatacaaaattagccgggcatggtggcgcatgcctgtaatcccagctactcaggaggctgaggcaggagaatcgcttgaacccaggaggtggaggttacggtgagctgagatcgcgctccagcctgggcaccaagagcgaaactccatctcaaaaaaaaaaaaaaaagaaattcttaattgcattgcacttacaggctgtgtgactttgaggaaataagctctctgattaattaataagattcccaatttctttgtgggtaaattgggagcaaggctgttgggaggaatgactgagatgatacctcggggcagtgcctctttgatggtagctgccaataaatgctggtccacttcctgcattcctccctccacttccttgttgccatgtcacctgcacacaaaacagctttcagactccatcttggcacaatatacatttatatttgaaaaatcaaacccaagaaaggaagaagtccaatgaaattctgaacatgtaagaaaagtcagctttagagaaattggacatccgtgtaattttcattatgccaaagcaattgatataaaattaggatctttgcttgtgactcttgaactttagtaattccaaaatccattgtacctatcactgttttcttttatttattttttcctgtaaattctggatattctagatctatccctgaagtatattgccagttttccatttcaaattttaattagttctcaatacaatgtatttaatattttgctttttttaaaaaaagtaaaggttcatgtcatttagaatatgcagcactgtataaatttccttgttaatttggtttcagtggtccaaattaagttattactaatagcttattagtatcagtttactaatattttaatttttttaatcatgtcttacattgcattcttttaaaaactagtgatatgctgtcatttgacagtaagaattcaaataatttaaactaggattgcaactctcaagaacactgtcacaaaaattttaccaaatgatatgtattagtccattctcacactgctataaagaaatacctgagactgggtaatttataaagaaaagaagtttaattgtctcacacttccacggactgtacaggtagtatgatgctggcatttgcttggaaggccttctggaaggcctcaggaaacttacaattatagtagaaggggaaggggaatcacatatatcttacatggccagagcaggagcaagagagagggagggcgtattagtccattttcgcactgctgataaagacatacacgagacggggaagaaaaagaggtttaattggacttacagttccacatggctggggaggcctcaaaatcatggcgggaggtgaaaagcacttcttacatggcagcagcaagagaaaatcaggaagatgcaaaagcggaaacccctgataaaaccatctgatctcatgagacgtatttactaccatgagaagagtatggggaaaaccacccccatgattcaaattatctcccactgggtccctcctacaacacgtgggaattatgggagtacaattcaagatgagatttgggtggggacacagccaaaccatatcagaggaggaggtgcatactacatacttttaaaaaccagatctcaggataactcactcactatcatgagaacagcaccaatgggatggcgctaagcctttcatgaagggccacccccatgatcctgtcacctcccaccaggccccacccccaacactggggattacaattgaacatgagatttggtggagacacagaaccaaaccatatcatgatactcattttatttattgcattttactttatatcctacaaagtcaatatatttaactgaaaaactggctaccagtgtttttgtttttttttttcaagttctacctgtactgatttctaatttttagccattcctgattttaaaacctcgcatacattttggggataatttgttctcctagatggcgagaaaatatttaagtctgtgggcttggagaatgcttttttgataagaaggatgcccttggccagactgcatagaagctgagatgtttccgcagagccgagatggcatgaaggctgaagaattttcctgcatccctcccactgcagtgattgttctggcaaagttcccagggtggtctctgcactgctcatattagtgaaagggtggttctgatttctgaggaaggcatgataacactttggccttaaattttctttttgcagaaagtttgattatcattagaagaatggccatcttttaaagtgattcattgacttgtccctggagaaatcatgagttagatgagagtgtttagtgggaagtgaaaagacccgtccacggtttcggatgagatcctcgttggactgtgatcccaggatattacccaggcccagatcgtagacaacctcccaatggagtcctgcccctacacgggcagggggtgaaataatgattccctttcttaattttctttagccatgaaatttattaaaaatgtatgtctgattctgagttgccagtcttaattgcttgagattctctggattcagaacttatttttattttttttatttttattttttgagacagagtctcgctctgtcatccaggcaggaatgcagtggcgcaactgcaggcccactgcatcctgagctcaagcgatcctcctgccccagcccccaggtagctgggactacagacatatgccaccatgcccaactaatttttttttttgaggcagagtctcgctccctcccccaggctggagtgcagtggcatgagctcggctcactgcaagctccgcctcccgggttcacgccattctcctgcttcagcctcccgagtatctgggactaaaggcgcccgccaccacgcccggctagtttttttttttgtatttttagtagagacggggtttcaccgtgttagccaggatggtctcgatctcctgacctggtcatccgcccgactcggcctcccaaagtgctgggattacaggcgtgagccaccgcgcccagtcccaactgatttttgtaccttttctagagacgaggtttcaccaggttgctcaggctgctctcgaactcctggacttaagcaatcctcctgccttggcctctgaaagtgctgggattacaggtgtgagctactgcgcccagcctgaatgcagtcttaaaactgaattagaaaatctgagtgcaggctagagttatatataattaagagagtgtgggttttaagttgtgtcttaaaattgtgttgtttttggtcgagtctggtggctcacacttgtaatcccagcactttggggggcctaagtgggctgattgcttgagctcacgagttcgagaccagcctgggcaacatagtgaaactctgcctctacaaaaaatacaaaaattaagcccaggtgctgtggctcatgcctgtaatcctagcactttgggaggccaaggctggtggatcatctgaggtcaggagtttgagaccagcctggccgtggtgaaaccctgcctctactaaaaaaatacaaaaactaaccaggcgtggtggcacatgcctgtagtcccagctacatgggaggcagaggcagaagagtcccttgaacccaggaggcggaggctgcagtgagccaagatcgcaccactgcactccagcctgggcgacagagcaacagtccgtctcaaaaacaaaaaacaaaaattagccaggcattgtggcatgcgcctgtagtcccagctacttgggaggctgaggtgggaagatggcttgagcctgggaggcgggggttacagggagctgagatggtgccactgtactccagcctgggtgatcgggccagaccttatctcaaaaaaaagtgtttttaattacttgtaattttaattgcttgtaattaaaaaacagtaattaaaaggaccaaaagttaattttgcaggtagtaaaccttagcctactgtacgtaaaaatcagaaggccaaggcaggaggattgcctgagtccaggagctcaagaccagcttgggcaacatagtgagaccccgtctctataaaacaacttaacaatgtgccaggtgtggtggcacacccttgcaatcccaactactcaggaggctgaggtggacggattgcttgagcctgggaggtcaaggctgcaatgatcgtgatcacatcactgcactccagcctgggcaacagagcaagaccctctgtaaataataacagtaataatcagaaagcaacactgtatgtgaataaagtcaccttacctagctgccggtggacagcctttggtgtttcaaggacttagtttttatgcgttcctgctttcgatatttgttgactgtgagctttgggcttatccagggtccatgaagaagaaatggctcttccttatctcaggcttttgttattttggggtgttttaaattcctctcctgtggttactcaatccgaccctacttgcctctctcttccacaaatttctcaaatgtcattcatggtacccttttaactcttacggacttacttgtttttaacatatcttttattcactttgaatggagtttcgactggaaatagagggtagtgttgtgtgtaccacctaccatcttcagctagacactttcaaagagtttgttttgttaattatatcttcttacatggctcattatgcttgttgaaatttgcaagatgctttaaaccaatcctgtccaaaccacagcctgtgggccgcatgtagcccaggatagctttgaatgcagcccaacacaaattcataaactttcttaaaacacgaaattttttttgcaattttttttttccttagctcatcagctatcatagtgttagtgtattttatgtgtggctatggcccaagacaattcttcttccagtgtggcccagggaagccaaaagattacacattgctgaaaactttagatgtatcaggaatcatatagcttttcaaaataaaatatccacacttttgctaagttctatgctatgcaagtgactgaactataccaggacttatcttgtaaacttggaagtgaaatattcttcactcgcaagggtattttgtgattaaattctggaaatatgcatttataagttgataccagctcctggaatgtaactttttcttttttctttttttcttttttagattttttgagatgaagtctcactctgttgcccagggtggagtgcagtggcacaatcttggctcactgcagcctctgggtcccgaggtcaagcaattcgctggcctcagcctctgagtaggtgggactacaggcatctgccaccacagctggctaacttttttttgtatttttagtagagacagggtttcaccttgttggccaggctggtcttgaactcctgacctcaagtgatccacccacctcggcctcccaaagtgctgggattacaggcgtgagccaccgcacccggatgctttttctcatttctccatcgcttaaagatagaggattgagagaggcccgtttgtggacacgatcttaagtacagatctctagtggttaaaacgaaacacaacaattctctctcatcctctagactcttggcttttgcctaaatatgattcataaagctgaagtgttgctaatctttaaataacacccaagggatatgattatatgattacccaacaccctaatacagtttaagaatagagtgatccaaagaaggagaaaatagtgtcttcaaaaatgttgctattagaaatatttcttttctctaagggaggatgcaggctaaagtatttagcatgtgtgtttacttttataaattttctaagtgatgaaggaaggaaggtagaatctttttttttttttttttttttttttttcagatagagtttcactcttgttgcccaggctggagtgagtggtgtgatctcggctcaccgcaatctccgcctcccaggttcaagcgattctctgcttcagcctccctagtagctgggatcacaggtgtgcaccaccacgcccagctaattttttttttttttttttttttttttttttttggtatttttagtagagatggggttgcaccatgttggccaggctggtctcaaactcctgacctcaggtgatccaccctactcggcctcctagagtcctgggattacaggcgtgagccactatgccctgccagaagtagaattcttatcaacatctttctaggttgataatcaggtaatccctaaagttaataccctaaaatgcaattttttagttttgatggaaaattgattctatcccttttttttttttttttttttttttttttttttttttttttttgaggtggagttttgctcttgttgcccaggctggagagcaatggcacgatctcagctcactgcaacctcggcctcccggttcaagcgattctcctgcctcagcctcctgagtagctgggattacaggcatgtgccaccacgcctggctaattttgtatttttagtagagatggggtttctccatgttggtcaggctgttctcaaacccccgacctcagatgatccacccggcttggcctcccaaattgctgggattacaggcgtgagccaccatgcctggccggttctataacttctatgatagagaatttttaaattatcaaaaaagcctgatctttcatgtaacactttgaccagtcttaccctgtgagtgttttcatctgccttctcacgctttgcatccacaagtgaaagtgcttctatttttctatgtattgtacagtaaagattttagagctttctaggccaggcatggtggctcgcacctataaccccagcactttgggaggccgaggtgggcagatcactgaggccaggagtttgagaccagcctggccaacatggtgaaaccctgtgtctactaaaaatacaaaaattagccgggagtgttggcaggtgccgtaatcccagctgctaataaggtggaggttgcggtgagctgagatcgtgccattgcactccagcctgggtgacagagagagactctatctcaaaaataaaaaaaaaaaatttttttagatccttctaataagatgaagcccactgtgtcaaaaaaaaatctaaaggttaggatatgaagtcattctgacagattatgctgtggaagaatatatatccctgttcctttcttctgagccttactttcatgttaatagtttaaactacatactatatgccaagaactttatataccttatcatatttcattttcacaaaattttaggaggttgatattactcacattaattaacaggcccaacatcacaatttctagcaagaggaagaggtatgcttttaatgcaagtctgactctgaattctgtggcctaatctgcagtctatgttgcatccacatgttttaaatgttcgctatgaattctcttgagctattatttctatctctaattatgccataatttaaaaatcagaatacttgggctcgtgtgaagagatggtgtgcctagatgtttcttcctggctcagtgtgagatatgattttgaaagcacatgatgtgcttcattacattttttaaatccatttatcccaggttaatagcttagatggcctttttttttttttttttttgagatggaatcttgctatgtcgcccaggttgcagtgcagtggcgtgatcttggctcactgcaacctccaccttccagcttcaagcgattctcctgcctcagcctcccaagtagctgggactacgggtacacgccaccatgtccagctgatttttatatttttagtagagatggggttttgccatgttggccaggctggtcttgaactgacctcaggtgatccacctgcctcggcctcccaaagtgctgggattacaggtgtgagccactgcacccggccagatggccatttctctaatgtaaaatgtgaagcaggcccaatggagggccccaagcctgtgccagaggtgaccagtctgcagccgtgccccgacatcctaacttccttggtgaaaaatgagaccactattcagtgtgctagctgtttacaaggagcaattggttagaaatgacagtgtactgaaagtcttttttttccctccaattttttacagggaaggttgggtgtggctctccaagaatacattttggtggactcattgaggaagatgatgtgattctccttgctgcagctctgcgaattcaggtttgttcaacatagctgtctgagaatcttgagtttggaagtttgattaatagttgctaacattttgcaagtggtttctgtttaccaggtacagtgttaaacacttcacacacagtgttaggcccatttgataagtgaagaaatggtgattttgaaaaatgaagtgagttgcctatgatcacatggcagtgtggggcagggacccatcctggggactgtgtatgttatcttgtgctgtgtaataaattatcccaaaatttagcaactgaagcaacaaggcatttattatctcacagtttcttcaagtcagagatttggtagtagattagcagattaggtggtatgttagtccattcttgcattgctataaagaaataccagctactcaggaggctaaagcaggaggatcgcttgaacccaggagacagaggttgtggtgagctgagattgcaccactgaactccaacctgggtgacagagggagactgaaaaaaaaaaaaaagaaatacctgagactggttaacttagaaagaaaacagatttaattggctcacggttcttttttttccccttgggacagagtctcactttgtcacccaggctggagtgcagtggtgcgatcttggctcactgcaacctccacctcctgggtttaagagattctcatgcctcagcctcctgagtagccgggactgcaggcacacaccaccacgcctggctaattttttgtatttttagtagagacagggtttcaccatgtcggccaggctggtctcaaactcctggcctcatgtgatccacccgccttggcctcccaaagtgctgggattacaggcatgagccaccgcgcctgacctggctcacagttctgcaggccttacaggaagcataacacaggcatctgcttctggagaggcctcaccaagcttccaagaatggcagaaagtgaagggaaagcaggcatctcacaaggcgggaacaggagcagagagtgagggatggtgctatatacttttaaatgaccagatctcatgagaactcattcactatcacaaggacgctaccgagggagatgatgctaaaccatcatgagaaactagcccctgtgatcccatcaccctccaccaggccccacctctaacactggggattacatttcaagatgggatttgggcagggacacacatccaaactatatcaaattgtttaggctcaggatctctcatgcatttgaagtgaagatgtcagctggggctgcagtcatctgaggcattaactggggctggaggatctgtttccaagatggcatactcacatggctgtgggcatgtgtatttcattcctcactggccatcagcaggatgccttggttcctcatcatgtccacctctctgtagggctgctcacagtgtggcagctaacttcccccagtgtgagcaatccaagggaggcaaccaggaggagtctgcagtgtggatgacctgggctctaacctcatgtgccgccacttccttttatcctgtttgttagaagtagatcactaagtccagttcacattcaagagaaggagaattgtcctcacttcttcaagacaggagtattaaagtatttggaggcattttttcaaaccaccaccacctgtgtgacctaaaggcgaaggtcatcagtgttccaccatataagctgagtgttctcatggtgctggagcctgcagcagtggtggcctctggcagtgacatttagttcatttctttcttatgtacagggtaatacacaattgaaactctttacctcaaaatgggtcattagacatttttgtaaggattataagttacatttccatcaaagccaaattttatttttatttatttttatttcatttacttataatttatatgcatacataacactactcagtagttcaatttgcttgctcttttataccaactatggaaggatggtatttggaagctgggcatccaagctgatcattcacgcagtcctatattttcttcatttttcttttctaaattggatgacgaacctattcagtataagtttatccatgtacatgatgtcttttgtgaacacttaatctatttatttatttatttatttatttgagacggggtctcactgtgtcacccaggctggaatgcagtggcacgatctcagctcactgcagcctccacctcccaggttcaagtgattctcctgcctcagcctcctgggtagctgggattacaggcacatgccaccacacccagataatttttttttttttttttttttttttttttgagacagagtttagctcttgttgcccaggctagagtgtaatgtcgcaaactcggctcactgcaacctccatctcccgggctcaagtgattctcccgcctcagcctcctgagtagttgggattacaggcacatgccaccaccacgcccggctaattttttgtattttttgagatggagttttgctcttgttgcccaggctggggtgcaatggcacgatctcagctcactgcaacctccacctcccgggttcaagtgattctcctgcctcagcctcccgagtagctgggattacaggcgtgtgccaccacacccagctaattttgtatttttagtagagacggggtttctccatgttggtcaggctggtctcgaactcccgacctcagttgatcccgcctacctcagcctcccaaagaggattacaggcgtgagccactgcacctggcctaatttttgtatttttagtagagacagggtttcaccatgttgcccaggctggtcttgaattcctgacctcaagtgatctgcccacctcggcctcccaaagtgctgggattacaggcatgagccacctcacctggcctatttattcatttatttttaaagagacagaatctcagctaggatgaagtacagtggtgtgatcttgactcactgcagcctcaaacttctgggctcaaacaatcctcccacctcagcctcccgagtagctgggattataggtgcgcatcaccacacctggattttttaatagtgtattttctcacattttcctgtttttctttttaaaatttaacaaaaacaatgaacatagtcagaagttctggcctgtgacttgaaataaccctggatgtacatttttaaaaacattctcagattcattgctgtaagtatgaagagctaatagtctgcaagggaactatagaattaagctggatcatcaagttcatgcatgcatatttaagaaacagagcagcttcttttaatactatcaaactcttcagtgcgatattgaatagttgtatatctaactagtggttttcacgttttcctttttaagaaaaacctacaaacctagttacacgtgaataaaaatattcctaatatcctcctggcttattgtgcgactcgataatcttgttttgtaacatccacaaacaatatttccatggtttaagtgtgtgccctgtcagcttttaccattctaacatgttttcccctctatccctgctgaagaacatggtcagtagtggaaggagatggcttcgtgaacagcagcacaggcggtggagacttcactgcttgaaacttcagcctctctcccctgtgccaaggtaacactggtgttttatttacactgatgtcagctcagcacagtgccttagccctagttagtcatgggggagaagcacaactcatggtactgtggttttgatggtagataagtttctctattcattaaattgccaccctattttctctattgtaaattctccaaaattaaatcataatgaatgtattactgtgttctgtcaattctaagaaggcatatttttttatttcaatgatgttttctatattaaatggcagttttttaatgatgttttaaaattaatttatattaatttaatttcaatgatgtttcctatatttaatggcagtgttttccccccccacccttttttttttttttgagatggagtcttgctctgttgcccaggctagagtgcaatggtgcgatctcggctcactgcaacctctacctcccaggttcaagcgattctcctgcctcagcctcccgggtagctgagattacaggtgcacgccaccacacccagctaatttttgtatttttagtagagatgggggtttcaccattttggccagccggtctcaaactcctgacctcaggtgatctgcccaccttggcctcccaaagtgctgggattacaggcgtgagcgaccacgcctggcctggcagtggtttttcttcttagtggtccatgaagtaatggttttaaatttgacaaaatatggtaatgtaatatttggaatatgcttttcaatgtcagaaatgcccaacacgtatatatccgcctggtgttaagggccatataggtttctactctggggataaaggaccgtccaaaccaaacattattccacgtgggaactgagctcagctttcttcagaacgatctgatagaatagtctgtgctcgtcaaggtggatattttcctcagagtgctctctgatgaggtctgagctacatattctatctataaatttggaaatataaactgtaggtcatagtctcagcttgtggtttagaatgattgggtagggatgatgtctgaatcagacagctgcattttccagcctgatgatgagtcatctgtgtctgtcccactccaaggaattggccccacccccattatccaggtgtgcataatactaggtgtgcatccccaggtaatctcatccagcaacgttggaatgcacacagtgccgaggagataaaatccctctagtaactgacactttatttatttatttatttatttatttattttttcttttttttttttttttttttgagacagagtcttgctctggtcttgaactcttgacctcaggtgttccacctgcctcggcctaccaaagtgctgggattacaagcatgagccaccgcaccggggctgactcattttttacctgataaccagttgctttatagaattgaactccatttccttggacagtcagatgaacaccctggttcagttctacccactaggagggtgtgaccctcctggacatgttttcatccctgcaatagacgaaacatctcagttatgctctctgttcattaattatataagttgcaatgaggaatgttattctttgtaatatcatccctgggcttgtgcaatctgtttcataaaatatcttattttagagttatttttgttgttataagaccttagattttaaaagtaaatcaataatttctacttacaaagtgctaaaaaagattaagatagattccaccaaattgtgtaccaaagtttcaaagtaaattcttcttgttaaataattaaatccttttctcccccaagaagaatttactttgaaatcattgatttctagacccactgggcaaagagaagcaggctgagtagtttataaatcaccccaaaaatcggatgatgtctctgtgactagctagtaaagagaaaaccttacaggtgtttgttttgttttgtttttgagacagagccttgctctgttgcccaggctggagtgcagtggcttcatctctgctcattgtaaccttcacttcctgagttcaagcgaggacatctggctaatttttgtatttttagtagagacagggtttcaccatgtttgccaggctggtcttgaactcctgacctcaagtgatctgccctcctgtgctcccaaagtgctgggcttacaggcatgagccaccatgccaggcctgttttgtttgcttgtttgttttttgagacagtcttattctgttgcccaggctggagtgcagtggtgcaatctcagctcacctcaacctccgcctcccaggttcaagtgattgtcctgcctcggcctcccgagtagctgggactacaggtgccaccaccacacctggctaatttgtttgtatttttagtagagacgggattttgctatgttggccaggctggtctcaaactcatggactcaagtgatcctcccgccttggcctcccaaagtgctgggattacaggcgtgagcctctgcagcctgccaaaagcttacacattgttcaagattaagctcttcaatttaggagattgtgggaagagagagacagaaaaaaactatggccaggaaggcaaaacaaagtaggaggctagaaaggaaaggtcggataggtggaggcctggaaaggaatactcagcggtacttgaggggggtaacctgaactcctagtttctctggtgccctttggagaagtctgggtggaggtgtgtttgctgttgcctcttacccccgggtcaggcccctacaggatcctggaggagagtctagggtggtctgaacactgagggtagattacctgcagtagctacagaaacagtcagggccaaggggctgactaaagtccactgagggggttgatctgcccaccgcaaggaggcagaccacaacaaaaataagtgttctggggtgagtgaaggaatagctgtcctctctgatgcaacctttaagggtagtcccccgccgcgtggtctcccggggttagtcttgctgctgggggaacaggtgtgccttccatctctcactctcagacacatgaagggcctgactgcccagcaaagaaatgactgagcacatgagccccagaggaaagagtccagcattacacatgctggtatccagaccactcctgtaagacgagcagtggtggccagtaaaatagaagagttcagttacgtgcccaatgactctctggagttcctacaatttcctgtctgaacttgggctcagggcactaggtccttttaccgacagttatgtaattaataaaacattttgaaatatgattttagactgtaaatagagagggggaagtgtggacacagataaaacgaaatagcatttccacattttttctttttttttgtacttaatctctaatgtgatagtaatgttcacatttttgaatagccaagagaaacatgtggccagcccgatcggagattattatgcaatgaccctctattcatcgctaatgaataccatgatggcccatacagagcattttgctctgtagtcgaatcacacttgcaggagggttttggacacattataatatgctgttcttgtctctatgccataggtgttatacttccacctggacacaattctaggatctttgtgagttttttggagttgcatttctaaaatgatacaccattttctcatacacgttaattattagcagttgtgcttattactgcctgggagaaaggaccccaaagtaattgcattgatttcatcgttggcgtgatgtgtggctgttttcactccagttgtgaccacctaagctgagaagccttttctctctttcgtattgtctttcccctcagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggtaagacaccatctaacatctacttgatcaagcagacatatttacaaaactcttccctatttatctctctcctcgtacccctcaatccatcctattctcacatttgacatttcgtccatttcatttggcatttctttatttggtgtgagataagtttttattttcagtgcagagcaaactagtcgactctacacaagataaagtcaaacaagttgcagtgctttatcttttgtttctcatattatgttgttattacccctgctcctccttgactttttgaatttcatttttcattataaaaatcaaaataggaattgaaagtaaactattttgaactgagcagtttgttttgtgcgttctacttgaaatattttcgtggaaaaggtacagataatcatatgaaacatgttttcctgttaatatccttgatcttacctacatattcacatttcaaaagctcattatttccctttttctgcatttcaaaactaatgttgggccattttcatttgtgttggttattttataaaagacaaattcatagtttttgtgaaaaggagtgtttgcctttttccccttctttttaaaaaaagaagtacattcactagctgaaaagatgatagaaagcaagggatttcaaatatttattcagtgtgacctgagggaacatcatgagaccatataaattcctttgctgccttgaaatttcatttcagtgactattgcttatgatgtatacaaagcttcaggcacaaaacctatttgtcaggcagagacatttcttgtaattggaattgactcctaggtaactttgtttttacgtatttaattattaatgtaagtgcttttttctttatttctttttctggttataaaaagaatgtagtttcattgtagaaatattctaaaaattcagaaaacagaagtgaaaaagtaaaacatcccaaacccaagcactcagaggaaacaactgttgacctgcgaggactgttttgacgctgatagagtctctcagccatgaggtcacactcacatgctattgtgtaagcaacctgattattcaagcatatgtggcatactgagctccatgtgagtgaatattgagctatgtcaccatttttcatgacaacataacattccatcactcacatcccagattctttttttttttttttttttgagacagagtcttgctctgttgccaagactggggtgcagtggtgtgatctcagctcactgcaaactctgcctcccgggttcaagcgattctcctgcctcagcctcccgagtagctgggattacaggcatgcgccaccatgcccagctaatttttgtatttttagtcgagatggggtttcaccatgttggccaggcttttctcgaactcctgacctcaagtgatccacccaccttggcatcccaaagtgctgggattacaggtgtgagccaccgcacctggccacatcccagattcttaaacatgttggggaagcaggggctgggggagtagcaaaatgcccaggatgagggtggagatcccatcttacacatcttctggcacctctagttccatcaataagtgctaccctggtagttctgagtgtttctaattgtccaagtgcactgatgcagaaaaataatttgaacatagaatagggatgttccacaacttacttgaccaattttctattgatgggcaatcaaagtgttcccaatttttgccattttaaactgctagaattaacaaccttgggcatgtggatttgtgcatctgtttaattatctccttaggaaaaatccccggaagtgagttcaattatttataaccacaaataaagcaaaaatattatccaaaacaggccaagcgcggtggctcacacctgtaatcccagctctttgggaggccgaggcaggtggatcacaaggtcaggagatcgagaccatcctggctaacatggtgaaaccccgtctctactaaaaataccaaaaaattagccaggcgtggtggcaggcacctgtagtcccagctactcaggaggctgaggcaggagaatggcgtgaacctgggaggcggagcttgcggtgagccaagatcacgccactgcactccagcctaggtgacagagcaagactgtctcaaaaaaaaaaaaaaaaaaaaaaaatcacctctttaatgatatagtgatttcttcaaatcctttttccctcctcctgtcccactttcctgtcctcctctttctccttctctttgtgtagcttttcttttttttttttgagatgaagtcacccaggctggagtgcactggtgcgattttggctcgctgcaacctctgccccctgggttcaagcaattcttgtgcctcagcttcccaagtagctgggattccaggcatgcacccccacgcctggctaactgtttttgtatttttatagagacggggtttcgccacattagccaggctggccttgaactcctggcctcaagtggtccgcccgcctcctccttccaaagtgctaggattacaggtgtgagccatcatgcccagcttctgtagcttttttgtaagagggacagacagccagggcctctctgaatccctcagcagttggcattgtaaggaattcatcctttgctccacaccttggttgcctgtggcttcacccttctcccgcaggcttccaggctcactgcagttagattcctgagcccctttccaacctagaaccccaaacttaatgtccccataatcgagtgtgggaaagttcctggctgaggggaggggttggctccacctgcaggcaccctctgggcccacaccctgcaaggagctgcctctggttagattggctccggggtctctgagtttagggcacagtttagtcagggttgttttatggcagtatgcttgatgcatatttgtctgcaattaataaacaaactcttggccattaagaccttgaaaaagcatttgatttgtgaaattggttcctttcttccaggcttcagatgatcttggtaggtgggtttgcaggctttctcaccctgttcagataggaacacttaaggaaaacttggtaggatgtgttgtctgtttatgaaggaagaatcctgcagcagattttcttatccagtccttgtgctttactccattttgggcttgtcaataaaatcagaaatccagatatggatggctctgaccttagcttggaacacaaaactgatacttctaaaacaaagctgtgatgatactgttttcaggttccttacttgtaaacaaagctgggcctccagcctcatgctggagaatgctagctagcacgactgcctggggttacagccaatgcagtccatggccagtagaacatttctccacgctggctttttgctagcattaatatgtataatcaagctgaaattggcctgccatgttgtaaatagaaaagaagactaaagatgaattttcaagaacagattaaacaccaagggatcaacaattctttttctgaaattctaagtttctttacctaacaaagacctttgaaggaacaaaaattaaatggcctgtctcttttttaactgtagtggaaaaaaataaccgtgctggtaagattatgatatatgtatgcatttgtggcacagcttgaagatttttaggaaatagccacactggattctataagggaagaatgaacagccccttctccccaacacaacaaatgatatattttttagggctgtaaactgtcatcagtatctaatcccttaatagctgaatattgatatcagtttagatcacaggcaactattttatcgatagcctaaagtgggcctggcatgacgggttgtgcctataacccaattactctggagactgtgggtggatcacttgaggccaggagttcaagaccagcctgagctgcatagcaagaccccatctttaaaaaatacaaacaaacagcaaaaagcagcactggtttaaagcaacatttgtaatctaaagtgaaaagtcaatttgaaataaaaatcatcttcatatttttacatttgaccaggtcaagcgttagggggaaatgactgttatcaaaccattatatgcactgttgcaacttctttaaaaatataaatgacccctccattaaatggagaattatttcctttttctaaaagtcttttctaattctgaaaataatattagcttattgtaaaaaatttaacataaagtaaaaaggagataactaggtctctcataactcaatattttatttatatattcatctttttacacattgagatcatgctataaatatcatttttgtcctgcctttttctctgaacactgtaacataaatctttttccatgctttagaagaattcaaatacccaagtaatttttaaataatactaaataacaatatatttgttattacatattttaatttatatagaaatgtgatttaaatatatcagcaatgggattaaaatataaaacaatgagatttttttaaatcttctattattaataactcaaatgcagaacagattaattcttttaaaaagccattcttcaaactttaggatttcttattcagtcagaatcatctgcatttcatcaactacatatcgcatggtatttacacctacacatcactttatttgctttgcctgacaaaatgaaaagtattgggaattgttcagggaaatatgccaaaagaatcttagggactcatgagttttacatattttcccagttacactaatgaaaaggaattttgtttgagaacttgacttggagtgcagctgcagggcatttgaatctcagtctccatcaggcctgcacccatttctgtgcagaagtttctagaatttccctgaattggttggacagagcagctaaaaaagcagcccaaactgatctgggaatagactgaatttcacattaaagaaaaatttgaatcattcacatcatttcatctttttttttttttttttttttttctgcagagggccaaatacccgattggattttttaaaaatgtttcaaccctttatttcggtacaatgttaaaataatctgacttttctatgatttggcttttctgccttgagtaactatttaaatatctgtgtgattttcttttatttgtgctacttctagaacaaaacagaggtatttagaagaaaccacttcccacagggcctttgaaccgtttacctaagtcaagtgtaatgagaaacataaccaaatgcaccatggggtttattgttagataataaaaggcttaaaaagcccctagaccctaaagatgcctgggatggatgatttatgttcatatgctacttgagcatgtagttttggagtgcatggtgaggcccatggctaatggcagtggtgctattcaacaagattctgggtctttagaatagttcaaagttttaccacttctctctggataagccatctttttgacctttgagtaaattataaacttcttttcagattgtgtccaaatggtcacaggtactttgacagtttttactgtaactgccaataagtaatactcatctttaaaaagacatcattctggcagggcatggtggctcacgcctgtaatgccagccctttgggaggccgaggcgggcggatcatttgaggtcaggagttcgagaccagcctggccaacatggtgaaaccctgtttctattaaaaatacaaaaattagctgggcatggtgatgggtgcctgtaatcccagctactcaagagggtgaggcaagagaattgcttgagcccgggaggtggaggttgcaatgagcagagatcacaccattgcagtccagcctgggcaacagagtgagactccatctcaaaaaaaaaaaaaaaaaaaaaaaagcatcattccattgtcaacccttttttgctgttctgtgccctgaacaggtgatgtgatagcggtgcaaagagggtgagcattgtcctttacctcaacaagtgtgtggcctggtaggcgagacaggcatgtcagaatgcttatcatgaagccatctgaaaaattctagaataatcatataatcaatgctctagatatcagagagggggtacagaaatctgccgggagaagtggaggaatgtaatgaacaaaaatcacagttccatctctatgaactctaagctcccatagaaaaagaaattagagggctgggcgtggtggctcacgcctgtaatcccagcactttgggaggctgaggtgggcggatcacaaggtcaggagtttgagaccagcctggccaacaaggtgaaaccccgtctctactaaaaatacaaaaattagccaggtgtgatgacgtgcctgtagtcccagctactcaggaggccgaggcaggagaattgcttgaacctgggaggcagagattgcagtgagctgagattgtgccactgcactccagcctgggcaacaagagcgaaactccatgtgtctccaaaaaaaaaagagaaaggaagaaagggaggaagagagggagggaggaaggaaggaaggaaggaaggaagggagagagagtaattagattaccttaaggaaagaaggaaggaaggaaggaaggaaaagagagaaagaaagagaaattagattaccttggtgctcattctttcgtatatccccgttgatgatttggaatctgagctaaagatactggggggaaaactaaaccaaattttgataccaaatacaggaaggaggtgaaataagcttttttattgtagctctccttttattgctcacaataaatacttcctactttgtgattttcccgaactgtattagttggcagaaagctgagcagtcctgtgtttctaattaagaattggatggttagctggagttttgaggaggtcatctctgggcgtgtctgcttttggctttcttgggcagctatgctagcatatccttgggaatgaaaatgtaatccttcatgtgacacagtttaggtaaaccacttagtcctttgcaaacaccaaatgctcagtgcggtacttaaatgacaccatatttgatgccacagtttctttacaggctcttctaagattgtaatgcctgtgggcttttaactgcccttattgatgttgtatccaagaaaacagaaagttgactccaagcagaagtattaatatctttgtataactttcagtcttcacgttgaccccactgcagatctgctgtttagacagatgcagaggtgactgataagccggggtcatgtggcttcaggagtcttaggtttctccatgcagcggtgtcaggataggctcaccagctcctggccacagtgggtaccagcgacctccttgttgctgaatccaccgaccactctcggtcctcatcctgcttcctgcctcagtggcgtttgactttcctgttctggaaacagtctcatccttggcctccttctgagacttcctgtcatgttctgccttcttctccagggtcctcttattttttgtgtttttagagacagggtctcactatattgcccaggctggtctcaaactccctagctcaagcagtccttttaccttggcctcccaaagtgctaggattacaagcatgaaccactgcacacagccgggttctcttattttatactacgccttcttagtttccttttggactctcttcttctgacaactcattacaagcaaatgtgcttaactcttctgtccttatcccttttctcactcggtgcactgtccttgggtgatcttacccattccatgctttaaatggctatagttatgatttccatccatggagaacctggttaagtcagatggctggctttgcctcccagctctactgcttactagctgtgtgactgtcggcaagttgcttacactctgtgcctcagtttcctcatctatcaagtgagcgtacaaataattaaccccataaatatgaagcatagcacctctcctattaactgccccaatccactctcagttttatctagttaacatttattaatttgccgggtctcacctaagatgttacttcctacaggaaacattcccagatgttcaaatctagttagatcctttttccatgtaccctcataattcagtctgactgccctatttccctgtcttagtgtttgtcacatttatcgtaattgctgatatattcagatcagctggaagctcgtgaggatagagatgaagtctgactggatcatcattttgtccccagcgtctagctcagtgcctggtacatagcagtacttgacaaatatttgctgaatgaatgactcatggaattgtagggtatgatgacgcctctaaagacattctttctttgtggttacatccttaggttttgtagatcagaaaactctattagattggttgtggttgagtatccttgacaacatggctgacagtaactcatggaagaccaaactgtaaaccctaatgacagcctttaaattttttaacgatgcttgagagctaagctggaaggacgtggggtgcttatccctcgtagaaatgcctgccaatgctttctcatttggacccaaactccagatcgggagcagtcttatagctggatcagctaccaagagaaattctaaagcaagaagagaaaagcatttcaatttgggacatttatttgcacctggaaatggggaatgggctatcagaccagacttctatcctgtccaacctgccttcattcagtccttccacattgttattctgggtttggactgtgctggaaagacaactgtcttatacaggctgcagttcaatgaatttgtaaataccatacctaccaaaggatttaacactgagaaaattaaggtaagcttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcaaggagtccctgtacttatagttgctaacaaacaagacttgaggaactcattgtctctttcagaaattgagaaattgttagcaatgggtgaactgagctcatcagctccttggcatttgtagcctacctgtgcaatcataggagatggcctaaaggaaggacttgagaaactacatgatatgatcattaaaagaaaaattttgcggcaacagaaaaagaaaagatgaatatcaatatctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtttcttctccctaccccacacatcttttggtactaccatttggggaagccaagcaaggatagtaaattgatcagaacacagttgtgggaatttggcctgaagttagtgaaataaaactttaaagagtggaaaaaaaaaatttttaacaatgcttgtgatgtactaaagaacaattttatgaggccttacttggtaatgtaataggctctcttcaatacctaatactgtgatgttatgaacatgggaacatttggttttgcaaagtgttgtcatcaacaataagattctcaagagcagaagtttccgccatagtatgcacagggcctgtggactttttgaatatttgaaggactgtcatatggaaagggatcaggcttagtgtgtaggactccaagagctaggacacaacatgaatgcagatgccttctctctagaacaaagaacttttgaactgtaacagctgtctgtaaatgagtgggccaccccagaggtcatgaccttatcaccatctgtgttcaagcatggcagggagaagccctgggcagggatatctggaaggagaaggacaagtggggactttagggtcccttctaatcctgagagtctggcagtgccctactcacccaaggaccgttgagctaggccctgtccccaaaccataggccctgtgcccacaccctgccccaataaatggctcaggaagaacaactgctatatactcatcagcaagaaatgccccaccatcagctgaattatttaaaccattttgatgagtggttttatggcctttcttgaaactgatgttgttattagcactgcctaataccttttccttttttggtttcttggtaaaggtgtgtctgtatcttgactttagcttatgcctgtcctgtgtgatgtgagtagaccataatagcccgagaaaattaaattatggagtgcattttgaaatgagcaccctcagatttgattctggtgtcttcggctggttttgcataggttgtctgggaaatattataaaattcactttctccccccgaactcaggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggtactgtctttaacaactagtgtacttttcagggcaaagttggggggagagaattgtaaaaagaacattgtcaacagataaagagttaagacttttcaggggacttggtacatttcttcactgcacactcagtacatagtggtcgccccatgttggttcccccgggcatgaaaaagagcagtgggagccgccagggcttcactggatgcctcaggagcctgttcctggggctgcgttgctcaaggctcccgcctcgagtgcggtctcccatttcatcagggccttctttgccaagtgatcttgaaacacggccatccatatcggtgtttgatcatcccagtcccggggaaaggtctttccctctgctttagtctcggctcattggagttgctgtgtggggcccgcagagctctctggagacggactggctgtggacagcgagtcgtgatgaaattcctccttggccgtggtcgggctgatatctggcacttccccattcattactctttcttccctgatttatcatgaaatcattccttagctcactttacagtggtggttattgctgcaattacagtttgtccttggcacttcgtgattttttaagaatattgcatttgtattactgttaaacatattaataacgtatctcataaagtactgataacgcacagagtgtcatgcatcgtgtagtggaatgaacactagggttggagcgagaaagccaaggttttggtcacagctgtgtttcctaccgccatgtgacccttggccacttgagccagtcacaacctctcggagccgcatctctaaaagtccaaaatgctgagagcggcaccaggctcacccagttgttgtgaggatcaaatgagaaagcacgtaaagaacgagggctactgtcaaatgatacacacatgggcggtgttgttctgctttaggaaagagcagtccttttactctaacaaccaacattttgagggatacgcagcatgacaaatctcacatactattatctgaaataaattgaagtttataatttactcatttgaggtggttatgcggtggtttttttgtttttgtttttgtttttgttttgagacagagtctcacttggttgcccaggctggaatgcagtggtgcaatctcggctcactccaatctccgcctcccagtttcaagtgattctcctgcctcagcctcccaagtagctgggattacaggcacccgccaccatgcctagctaatttttatatttttaatagagatagggtttcatcatgttggccaggccggtctcgaactcctgacctcaagtgatccgcctgcctcagcctcccaaagtgctgggtttacaggcatgagccacctcgcccagccacagtgtattttttttaaacaaagtttgctcagatatgaaatcatatacaattgatttagataaagtatagtcacagagatctaataataaattatcaaaatattctcatatcctggtatgttttacagtaatgacatctgctctatttttaccttttttttttaagcaaagaaacagaggtatagttagacaaagtgtcaactttttttgttgttgttctgcttggatataaccattagtgtctctcactgccttttgttacttcatcttgggtgtgacgcctctctgttgggtttggggagctgtgtcccttggcctgtgtccatcgtggcagctgtacttggtgacccgtttgaaatgcctcttgctctgttgtttaggaggagccgcgggtggtggatatgcccaggtcatccccatggaggaggtaagaccttgaagagatgcgggtcagctatcactgtgtttccttcctgacatcttgtctctgctcccatccacacaggcccacagaccctcatccataatcccaaagtcattaaggctctgaaaccccaaaatgtttgcataactcatgcagtgacaaaccctagtatttactgtgatgagctataattatatggattttgtacgtgctacttggcgtgaatattcatatacattgctgtggaaaaattatttttgattaacaggtgctgacctagcccctgcttggggtgttttacaaataaactacatgtaaatcacactgccttcctaaacttcaaaaaattcagaatcttgaaaccctgctggccttgcgggtctggatgagagaatgtgggtctgtgcctcccttgatcatctgctgtactgccaagttcacgaagacttgacgcttcccctctgtcaattcaggctctagtgcgtgcctcggcagcatagatactaaaactggaatgacacagagaggattagcatggtccctgcacgaggatgacacacaaatttgtgaagtgtcccattaaaaataaaagaccccaaaataaaagagttccagaggaaaatgggcaaaaagaactgacgttgttaattctcacttctgtaagaactccacctttgttccacataacctctttgttgcctgtaactaaccagtgaccagctcttttcagtttcactctctgcatcagccttatcattcagggcctggacaatcttccaaaacccaaatctgagcaggtcactttcctgttctgtcatttccgccgttgcctgtcaccctccagcacagcacaggaggtcctcgtgggtggctgctcctgcttccctgtccacaagtccccacctgccttctctctactgcgtcaagctccttgcagactctttttttttttttttttttgagacagagttttgctttgttgctcaggctggagtgcagtggcacagtctcggctcactgcaacctctgcctcccaggttcaagcaattctcatgcctcagcctcctgagtagctgggattacaggcaactgccattgtgcctgactgattttttgtattttagtagagacggggtttcaccatgttggccaggcttgtctggaactcgtgagctcagacaatccactggtctcagcctcccaaagtgttaggattacaggcgtgagccactgtgcccagcccttgcagactcttttcctgttctctcttggttccaggattttcccatgcctggaacattcttccttttctgtcctctttacccagtttagtcaaggttttttgtcaaggttcttctctaccccacagactccctctgtgtttacggctatctggttcagttggctgtggcgagttgcgggcctttcttgaggtctcaggtcccagcattgagcagagtgcccagcacatagtaggaactcactagaaagtacttgttgactttgttaaaggaatagaagtgtttacccatggaggtctgagtgtcagggaagctaaagagaaaatctgtaggaacttcaagtactgggagtgggggtgagaaagagtagtccaaggcactgctgaaaaaaatcgtcccaggcctcaggtcagaatggggatgggtaccattcatgagccagcaagacccagaaccaggaggccaaattagaggtggtgtacaaggggcatacacaggggaatggctcgggtttagccagcaaattggaaggacattggtgtcccgctggtttagggcatcagctgcgtggcttggaggagagagctacttttattttattttattttattttttgagatggagtctcgctctgtcacccaggctggagtgcaatggtgcaatctcggctcgctgcaacctctgcctcccaggttcaagtgattctcctgcctcagcctcccgagaagctgggattacaggcacctgccaccatgcccagctaatttttatattttaatacagatggggtttcaccatgttggtcaggccggtcttgaactcctgacctcaggtgacccacccacctcggtcttcaaaagtgctaggattacaggcgtgagccaccgcgcccagccaagaagactaccttatgagggtagagtgggccagacacactcaggcaatttgttccttgaagttgagtgcctccagtcttttcttcatctgtatcctcccagctctgagcaccgtgcctgacacttggtggatgtttgttgactgtgtgccaggcacagacaatatgtactggacggaacataataaatcaccataggggaaaatgttagaataaattccagatgggctgaggaattgaaagtgaaaacactatgactggaaggatgggaaggagccggccttgtgaagaatgagggagagcattcagccagtgggaactgctggtgggaaagtcctgaggcaggaaagggtgtggcctgttcagggaactggaggacaccagggtggctggagccccgtgggccagcgggagttgggggggttgaggtagagaagtgtgcaggcgccagctctgtcgagcgattgcaatttgtagccaagaacctggattttatttgaagtgccaaggtcagccattgaagggatcttgacagataacacaatgcagattgagttttattaaaatcaccctgtcttctgtgtgatgaaaggaccaggggcctctcagtagacacgatgaatccaggaggaagactatggaagtagcctagggaaagatgtcagtgacttggcccaggatgggggcagtgaggatggaaaagaggaaaaaacagtttaagatttgtttgctgatgtttgcaggattagatgttgggggttagaaaagaggaggattcaaggacgacatccagggtactggcttgagcaactcagtagactcatttgttgaggcagagaacaggggagtgatggtatgaggtttgaactgtgtggtgtggggtgtggtggagggtggtagtcagaaggagggagtcagtttagaggcctatgaaacatgcaggtggacatcaagtagacggctggaaagaaaaacttacattccagttgtgaaatggccaaagagttcaatagaaacatcgaaaaagaaatattaactaaatgcatattcatcttcaccaataatcaagtaaataaatctacattaaaaccactatcaggccgggcacggtggctcatgcctgtaatcccagcactttgggaggctgaggcgagtggatcacctgaggtcaggagtttgagaccagcctggccaacatggggaaaccctgtctctactaaaaatacaaaaagtagctgggcgtggtggcaggcgcctgtaatcccagctccttgggaggcggaggcaggaggatcactcaaacctgggaggcagaggttgcagtgagccgagatcatgccactgcactccagcccaggcaacaagagcgagactccgtctccaaataaataaataaataaaaataaaaccactatcagttaccattttacttgtcaaattgacaaaattggatttttcaaaatagttatgataccaaattttggcaaagaaattgaaatggactcccacacactgctggaaagtgtatgttgataaaaacacttcaggaagaagagtagaaatacatattaagtgttttaccgtgcatatcctttggcccaaataaattcatttttagtgtaccctaaggaaaaaatgaatgtatgggaatatagatcattttaaattaaatataccctcacatagtttataacattaaaaaatggggggataataataggacatcaggttaactgtattttgaagaatctttaatgatgtaaaaatgcttgctatgttgagagtgtaagagctaaagtataaactgttacgatgttatgattccaatatttaaaagtacaaatatatatttataaaatatatatacatatgtaatttttcatgttttctccagttaacattattttatgttataaagtaaaattttaacaagaaaatatttaaccttccaagaaattaaggaaatgcagctttaaaaagaataacactttctcaactattaaattatttcttagtctaaaagttactttatttctgaagtaactgatctactactagtgttttgcagatgacacttcatctctttcaaaaagcaatttggtgatattatcaagatctcaaaggccggatgtggtggctcatgcctgtaatcccagcactttgggagtctgaggtgggcagatcacaaggtcaggagtttgagaccagcctggccaacatggtgaaaccacatctctactaaaaatacaaaaattaaccaggtgtggtggcaggcgcctatagtcccagctacttgggaggcaggagaatcccttgaacctgggaggcggaggttgcattgagctgagatcatgccactgcacaccagcctaggtgaaagagcgaaactccgtctcaaaaaaaaataaataaaataaaaatacttcatccctttcaaaaagcaatttggtgatattatcaagatcccaagggctgggcgtggtggctcatgcctggaatcctagcactttgcggggctgaagcgagaggatcacttgagtccaggaatctgagaccaacctgtgcaacatagtgagactgtgtctctacagaaaaaaaaagaaaaaaaagaaaagaaagagagctcatttaacctagtaactacctcctgaaaatatattactcattagcaattaatttttttaataaaaggaaaagctatttgtgtatattctttataactgtggcctttcttgtaaaagtgaacatttggtagtagcgtatatatccagcctgaaacttttggtacatctaccgtatacagcttctataaactatacaaaagattattatagaaaaagttttgtgaaaaacgaaacttggaagtttgtaggaagatgattctacaaatgataatcgagtgtgctcatgagactggaaggaaaataacagaatgagtagagtcatgagggtaaaatactctatttctccaaagttctgtaatatttcatattattttattgttactgtttattttatgccctgcctcactccaaagtatatttgatatgatactgttttctagataataaaacaatgaataaacgtagtgagtgactataaggagattcattattaaatgcatcagaatgttttgccttaacctgaggatggaagaatttatgatctgagtaattgctcaaaggttctttgttgtcacgtggaaggctttgaccttgattttctgatttaggcattcctatagactcagctcattataaggatatgtaatttgcatgctattttatttattcagtccttaaattccatagttgtttaaaacaaataggaagatgtcttagccgagcacagtggcccaagagctcataaccagcctaggcaacatagcaagacccccatctccacagaaaattcaaaaattagccaggcacaatggtgtgcacctatagtcccagcctactcagtaggcttaggtgagaggattgcttgagcccaagagtttgagaatacagtgagctatgatcatgccactgcactccagcctgggcaacaaagcgagaccctatttctgaaaataaataaatagaaagatatcttatttctctagttcaaccttcacttgactggagacatccacgccatcaccgctgccaataacttgctggctgccgccatcgacacgaggattcttcatgaaaacacgcaaacagataaggtgagaaggatgccttgctagccattttgggtattgtatcctggaattcctggattcttaaggagtttgtggaaagaattctggtgtctgcaaactctgaaatgttattcaattcaattttgtgatttttacatatgtccctgtttcccaaggagaaggagccatcctttgatcagattctcaaatgggtttatgagcactgccaagttattgggagaattgtagtatgttgtaaaagccaaatattctctaagatgagtctttagttttaaagatggtaggtagaccagttctcttcattctggtcataggtccaatctctgatctgttctaaggggattggacagatgtcgttttaagactaatgttatgtggagctattttagatgtgctgaaaagatgtcagagacccttattgggcttcatgtgcttgtaggttaagagttaaaccacacccccaaaggggacagcccaccagaagctaattcctcacagatataggacatagataaaaggggtaccttctggcacattttacaacaagggtcctcactttctttaattaaagtagttccttagtgagtctttgctacataatccagatacatcttcatatggtagttgtagcgatatagatcaagaaatatatttatgcaaactctttgcaatgtgtattatttcagatcttgtcagttttatgaaaatgacagaatttaagtcaacattgtttatattagcccacaaattttaatagggtcttttatctaaatagttcggttataaatgcaatgaatttttgtcatatcctgtgaattgtccaagttcatggacaactaacttttgtgtggtctcatttttgttttgtgtttttaggctctgtataatcggctggttcctttagtgaatggtgtcagagaattttcagaaattcagcttgctcggctaaaagtaagtttccagttagcaattctttaaaaagaaaatatcgtagaaacgcatcagaaagattgtcaaagcctgaaattttcaacttggtttgattttggttttcagatatccttttgggtattaaactctatagagaccgaacactggagcagagagagcacagtgttggaagcctgaaccctggttctacacgaaagagccaggtggacaaattaattaaccttttttggtctcagtttcttcgtctatgaaatgagaggactgttttgctaatttatgagtactctagtcaactgacaagttagctgggcacaggagcacatacatacctgtagtccgagctactcatgatgctgatgtgagaggtttgcttgagccaaggagttcaaggtttatagtgcaccatgatggcccctgtgaatagccactgcatgccagcctgagcaacacagcaagagcccatctcttaaaaaaaaataacaaattagaatttttggtgagtccttctctttctaaagtgaaatatttttatgaaatttgttaaatttctaggaaattataggataacctttgaaaactcatctatctcatttgtggttttctgttttgttttgttttgttttttgagacagagttttactcttgttgcccaggctggagtgcagtggcatgatcttggctcactgcaacctctgccttcctggttcaagtgattctcctgcctcagcctcccaagtagctgtgattacagacacgcaccaccgcacctggctaatttttgtattttcagtacagatgggatttcaccatgttggccaggctggtctcaaacgcctgacctcaagtgatccatccaccttggcctcccaaagtgctgggattacaggtgtgagctactgcgcccagcctcatctacgtttttgttgcagcaaacactacaattatacttgcgtatgccatcttaattcttaaaacctgtcttatcttttttctgatgccatttgctgcctctggtcttctaatcatattgcttgctactagccctgtttcagagactaaaaaataaccctaaatggtataacttaacaaccttactggttggtattaagtggttttaaaaattcacctcctgcctcttactgaaccaagttcagtgtgttgaattagtgagtaattccatcctcggcagctataacaacatgcagtttctgtttcccagatcttttttatgcttcattaaaaatcactattttgccaggcacagtggctcacgcctgtaatcccagcactttgggaggccgaggcaggcagatcctgaggtcaggagattgagaccatcctggctaacacggtgaaaccccatctctactaaaaatacaaaaaattagccgggcgtggtggcaggcgcctgtagtcccagcttctcgggaggctggggcaggagaatggcgtgaacccaggaggcggagcttgcagtgagccgagatcgtgccattgcactccagcctgggcaacagagcaagactccatctcaaaaaagaaaaaaaaaaaagaaaaatcactattttgtgtgtgtgtgacagtcttgctctgttgctcaggctggagtgcaatggcacgatctcggctcgctgcaacctccgcctcctaggttcaagcagttctgcctcggccttctgagtagctgggattacaggtgcccaccaccatgccagcgaattttttgtatttttagtagagaaggggcttcaccatgttggccaggctggtctcgaactcctgacctcaggtgatccacctgcttcagcctcccaaagtgctgggattacaggcatgagccaccacacccagccaaaaatcactttcttaagatgttttatttacacaaaataaataggaagatttcttggcttggtgtggtggctcacccctgtaatctcagcactttgggaggccaagacaagaggattgcttgagcccaggagttcatgaccagcccaggcaacatagcaagacccccgtctctacaaaaaatttaaaaattggctgggcattaaaagttttaatttttttttttctcctccataaattaggaataacttactttgaaacataggaataaacttaacttgaattactggtatttgtatttgaaaaactaaagaactgcggcatcaattatatggacagacagcagtttatgtctcttctgagcagcgtacatggtggccacatagagcagcccaaggagcccctggctaacgcagccagcagcaggcacaagtggtagttagctgtatgctgtccactgcaggacatcttcagatcaatccttttcagagtctattacgaactcacagtatcttactcgtagaagaaatctggccataggtatttgtctgacttggcctaacctataattcactcaaagttcagtttagtttagtttttttttgtttgttttttgttttttgtttttttttgagacggagtttcactcttgttgcccaggctggagtgcaatggcgcaatcttggctcactgcaacttctgcctcccaggttaaagcgattctcctgcctcagcctcccaagtagctgggattacaggcatgtgccaccacgccaggctaattttgtatttttagtagagacagagtttctccatgttggtcaggctggtctcgaactcctgacctcaggtgatctgcccacctccgcctcccaaagcgctgggattacaggcgtgagccaccacgcccagcttagttttgatttttgttttttggtttttttggagacagagtcttgctctgtcactcaggctggagtgcagtggcaggatctcagctcattgcaacctctgcctcccaggttcaagtgattcttctgcctcagcctcccaagtagctgggattacaggtgctctccaccatacctggctaatttttttatgtatttttagtagagacggggattcaccatgttggccagtctggtctcgaactcctgaccttaggtgatccacctgcctccaccttccaaagtgctgggattacgggcatgagccaccgcacctggcccagtttagtgttttttttgttttgttttgtttttgagatggagtttcgctcttgttgcccaggctggagtgcaatggcacgattttggctcaccgcaacctccgcctcccaggttacagcgattctcctgcctcagtttcccaagtagctgggattacaggcatgcgccaccatgcccagctaatttttgcatttttagtagagatggggtttctccatgttggtcaggctggtctcgaactcctgacctcaggtgatctgcccaccttggcttcccaaagtgccagtttagttttttaaaaggctttaccaatcatggagaaaataaaattagagggataattttggtgaccctttgctttctgtttcttctcaaacttctcaccttttttcttcttaatcattagaaactgggaataaataagactgatccgagcacactgacagaagaggaagtgagtaaatttgcccgtctcgacatcgacccatctaccatcacgtggcagagaggtgggtgctggggagatgccagcaggctgatggccaggtggggaggcgtgttcgagccgaagcgcttaaattcagaaacttacagtttgatcctgtccagtgatcttcccagcctgtgcttcatattcccaccatttatttcagttactattatcgtaccaccctcccttatccttgcctccaattaaaacaaaaattctgtccagggtcaatcccatctactcctgtgtcttctaaatttccaaggaaaattacctaattttctcttctgtttctctctcctttggcctcttgtatctatattaagaaaaaaaaaaagaaactttttttaaagaccacgcctccctggctttgtcctgctcctcctccacccaccatcccaccttcttctgttcacttccttaccactggctctcggcagctctctgtgtgtttccagtgctggattttcctccaagtctgatatgtgctttcacccacttaacgaggcatcgctccactgcttcacatgcatccaggtggagtccccgtgagctccccaccacctcgacttccctgcttccctctcagttgtgaagtccccttccttctcccacactgccctcagtctcatcgctcactatgggatgagacagagggaaatgcactaaacaggaagttaggagccctgagtgtgtgtctcccctgccactgactcactgcatgatctcgagcaggtcgcatgcatgttcttggcgttggagatggagatggtcacatacgctgcacagaaacacggcaaccacattttatgaaccctgtgcaactgcagaaatgttcaatggcatggatccctgattcttcctggattattcttctcatacttgtgccctcatttacctctttatgctcacatttggaacatatttatcagatgcgcattttatagcagttcccgactaatagattatcttgcttccgtttccatcccccagttcagagggttcacattaacagagatatcccgttgtgatcagaggcctccagtggctccccacatcctgggtgatacagttgccatcgcagagcttggtcttcaggacacccgcagtggcttccctcactctgctccctgcctgctttctagtcagcagtgccgacctccatcctcctgccagccctagctgggccatctccatcctgtctcctgcctaggccagtgttgccctctaagatgcacccaggtctcgtcccttcagggagcttcccttctgggaatccacccagccagtccattaagaatttagtgtagtcccacaaaccatgaggtagagagacaaagaccagagactgagcgttggctctgcggtttatgggctgcacaactttggacagactgctcactcagtttcctcatctttaaaatggaatcataattccagctgccttgctgggaggcttcactgaaacataagcatcctttccagacccaaaagctctgcccacacgatcatcagaagtcactgtggtgatagctgtattgagtagagttttttgtttgttgttattttgagacagagtctcacttgccctgtcacctaggctgaagtgcagtggtgcgatctaggctcactgcaacctctgcatcactggctcagtcgattctcttgcctcatccttacgagtagctgggattacaggcacacaccaccacacgtggctaatttttgtattttactagagatggggtttcaccatgttggccaggctggtctggaactcctgacctcaaacgatccgcccacctcagcctcccaaagtgctgggattacatgcgtgagccactgtgcctggcttgggtagtttttttgagtgtctttgtctcccaaactaaactaaaatctccttggaaactttatggttttttttttgttttttttttgagacagggcctcattctgtcacccaggttggagtgcagtagtgcaatctccactcactgcaagctctgcctcccaggctcaagcaattctcctgcctcagcctcctgagtagctggaggctgtgcgccacaacactcagctaattttcgtatttttagtagagatggggtttcatcatgctgcccaggctggtctcaaactcctgagctcaggtgatcttcctgcctcggcctcccaaagtgctgggattacagacatgaaccactgcacccagcctagaaactttcaaggatacatttttcattttgaaataagtaataacattatagagattttggaaatgtctcaaaagaattttaaaaaccttgctatactaataaaactactattcatagttttttgtgtgcatctagttttttggtataactctagttataactttagtgtatagattttatatcctacgagtttcattcatttatatcataagcattttgtattttgttagctctttgttgtaatggccattttaaatactctagaatattcctttgtggatgaaccacaacttacttaagcaaggctcagttcttgaaaacaccaacagcattttaaataatggacatgaatactttaagcattttattgagaagcctacatattttctttgaaaattttttttataactaggaagatttattattaaaatgtcatcatgtccaaaatgtattgtcatctttttttttttcaaagcatttgtgattttgtgttactcttcaaaacttttttggaggtttactgatgataggaaaatcaggaaggtggaaattagtgtattttaaaccaagcatatggatgtgctaaaagagaaagttttatgccaattggtattctttggtgtctgctttggggttccagcctgagcagccatcagaaacagggcaatggcttagacatggatcttggaagagaaaggctacatcatcttttatacctgggtctggtctgcaattggtttctctctggagccaggaaggactgaagtgttttgtggttgtgaatcacttttaatggaagtgacaactttacaaaattcttccggaaaaaaatttgaattccattattgttcagggcactgaagtaaagaaaactttattgctgtggacaagctacctgggtcagaggaatttggaatgacatttgataagtagtttggctcttatgaccatgaattaataacagaaataggactcttcatcaaaagaattgagaacatttgctagtagggttttttggcttaaacctagaactaatgtaacccttgtgatgaaattggatccttatttgatttgacaactagagcaggacagtcagggtgcacggtggtgggagtgagaccctcttctcaggccatatggatgttgcgccatttaatgaccaccccttcctttcagcctgtgtacaaaatctgatgattgtttcatctttttttttgagacagagtctcactctcttgccaggctggagtgcagtgtgcgatctcggctcaccgcaacctccaactccctggatcaagcaattatcctgcctcagcctcccgagtagctgggactacaggcatgcgccaccatgcccagctaatttttgtatttttagtagagacggggtttcatcgtgttggccaggatggtctcgatttcctgacctcgtgatccgcctgccttggcctcccgaagtgctgcgattacaggcgtgagccaccgcgtccagcagattgtttcatcttatgcctcataccgaaagtttaaaggcctcatgttcctggacccagagtggaacaaggaacccacagacctttccagaaatacttaacataagcagaagaaaatatagacatacagccattttgttacagagcataattttgcacagatgagcctctgcctgtccgagccccggggcctcacaggcttgccgtctctccatctccctcgcatgcccaactcctggccatggaccaagggcccacaagcctccctcagcctcagggaatcaaccatcaagtggctggttccttgccccaacaacactctagggaatcagtaccgtgtcttccactggggccgaaacagtggacctgcccctgattgaacaccttgtactgccaggctcttggccaatattggctgtttcatcagccattaggcatactgtggatgttccttaggacatagtcagcactgtagtatagtcagcactgtagtactaaaagggatggtccagagcaaaaaataagcaaacagatctcccccggctgcctccacccccacacccactggcattgtcctagcatgccttacataagaggctggcactgtcttcactatatctctgtacagctggctcgggactaggcacaagtagcccctcaatacatactccaggagtgaataagtgtttcttattccacctttagttctatcattcagagaccaggaattccattttggatcactaacttagggttactttctagtatctttcttgtgggctggaatttaaccttcacatttcttatgtatcactgatgcatcacttaccgggccatgttaaaggcagaggtgggctttggaggccactgattctagttgatcttgccagacatttttttttcttgttttctctttgctagataaaaaacagctgaatttctcttgttgattttaaagaaatttgataaaaagattccctcaatctggtgccaagatcgtgtatactacagagcaggaaagaggtttttagttgattgactttgcaccccatgtacatcttgggaagaacagtggtggctgaggatactattgaaaagcaggcctttcattttgtatatgctctgcttatagctgaaaaactcataaagaaggtttctgtgtgtttatatgagtgtcagttggtgtttgtgtgagggtgtgagtgtgtctgagagagagggagcttgttataaagactaacaacagccgagtcagggaacagccataggccaagagggcaagctggcctgctggtgctttgcgtatgaaagaaaaggttaactttcttcatcctacggatgcctatagtaccaaatacgtaatttccatcaccattttcataagtgctgtatcgtatacattgagtaaagtggatctaaattgtcaatgtggacagcttgttatttgaagctgcataaattaacaaagtcagtgtactggctttgttttgttgcattggtattcactaaaccaaacctaattttcacaaaatgtaaataactgcaattcttgttttgttttgttttgagacagggtcttggctgggtgcagtggctcacgccagttatcccagcactttgggaggccgaggcaggtggatcacatgaggtcaggagttcaagaccagcctggccaaaatggcaaaaccccatctcttctaaaaatacaaaaaattagccaggcatggtggcaggcgcctgtaatcccagctacttgggaggctgagacaggagaatcgcttgatcccaggaggcgaaggttgtagtgagccaagatcacgccactgcactccagcctgcatgacaaaaaaaaaaagagagacaaggtctcacttccatctcccaaatgggagtgcagagacacaatcatggtcattgcagcctcaacccccaagactcaagcaatcctcccacctcatttttgtattctttgtagagacaaggtctcactgtgttgcccaggctgttctcaaattcctaggtgaccctcccgcctcagcctcccaaagtgctgggaggtgtgtgccaccacacccagccaataactgaaattctaataagccagtgaagaaaataaagagaactggtacttgctctattcaccattcacccccgccaccccccacaattctactttatttacttttgctttttaaaattgtggtaaaatatacataacgaaatatttttccccatttgtaagcacacaattcatggcattaaatacattcacaatgattgcactatcatcactatctatacccagaaccttttcattatccccaacaaaaactccttatccattaaataattactcccctcttctgcccctgcctattctaggtgcctgatataagtggactcatatagtacttgcctttctgtgtctggcatatttcactatgcaccatgttttcaacatccattcatgtatcaacatgaccttcttttatagccgtctaatattccattgcctgtctgtgccacattttgtttatccattcacctgttggtcgcttcctccttttgactattttgaatagtgctgctatgaacatgggtgtacagatatctgagtgtctccttttggttctttcgggtaatgccaagaagggaagttgctggttgggtttttttttttttttttttttttagagggggtctcactctgtcgcccaggctggagtgcagtggtgcaatctcagctcactgcaacctccgcctcccaggttcaagtaattctcctgcctcagcctcctgagtagctgggactacaggcacacacaaccatgcctggcaaatttttatatttttagtagagatggggtttcaccatgttggccaggctggtctggaactcctgacctcaaacgatccacccacctcagcctcccaaagtgctgggattacaggcgtgagccactgtgcttggcctctagtggatttttttgtttgtttgttgtttatttgattctttctctatgtctacccactagatggtcagcttgggggagcctgaccttttctctttcaccctctgcaacttcctgagcatcagaacaatgccagacacacaccaggtggctggtccatatttgtcgactgaatgactaatctgttctctttcagtattggatacaaatgaccgatttctacgaaaaataaccatcgggcagggaaacacagagaagggccattaccggcaggtaggtggtgctttcttcccgggtgtggctctgttcttacgttcatttctactggcctgggagctcactctttgcctttcttgtctcatccccaacctgttgtggccagtggttctctcactgttttgggtgctcagcagggctgggagaggatcagaagacatagaggctccagtgtctttttaccatcttttctatgtatgtttatttcattttctttttttcatgtatgtttccaattgtgtttccaggaagagccactcagggtattctttgaatataaattctcacttattttattgggaaccatccaggtaatactacatctgcataactgataaatgaaaatctcagacacattactcaaatttcatatatcaaagaacaaacacctagttattagacttaatagcatgaggattttttaaaggataatggcttattaatacaaaaatggcttattaataaaatacagagaatgcagaagaaaaattatgtctgacttcattgtaatagatattggatgtgcgtcaatggcacttagggaatacaaattaattcctatgatttttcatccaggcacagtgggcttctaaattgtgttgtgtttttttttcttttgaattgattataaactgtacatttaagaacagttttagatttctgtcctttatgttaagtttttattagtgaaaaaagagtcaccttactataataaccaatccttacgccaaatagacttgtgaccttttgaagtgtcttgaattaaaaagtgaatgtaggtattggattaagaagagaaacttaagttcgtggacctcgtctcctcccagtcctgtaacttacacacacacacacaaacagatttcaaatatccatgctagcaaactggaatcattgccatgaagttttagatagttctgaaaaataggaagatggaattagattgatgattaaaaggacagcccaaaatatggtggacttccatccttaacaagcattcttgcttttcatgttcttagcctctcctgctaaagtgggagctttataaaagcagaggttattcccctttttatttgctgctgtgttccctatgttcagaacagaactttgttacatatagtcgtaagtgttcagtaaatatctgttgaacaaatgagtagaataagtaaaagacaatttatggatacagaactaaaatgccaacataaaaagatgttcatgaataatcataaaactgcaaattgaaacaatggagtatcatttacctaggagcttgtcaagtgaaaatagtaggtactaaatgctagtgaggatgcaatgaaatgggggcatttatgcagcgttagtgggagtagaaatcctttttggatgagtttgttattactaaaatttgaaatgacccaacaattacaactttggaactaaaaatattttaatgaaaagaacaagaaaatgtgtaacgtacaggaaaaaattctgtgtattaggatatttgttgtgccattatttgcagcggtgaaaattggaaacaatccaaatgtccaacagtagagatggttgcatatatttggtccgccattttgtcccatgggagagttgaaattaataaatgtgcgtatgggtgtcttgacatgagtagagagctctcatacaccattggaaaggttgtaaaaaccattttaaaactttgaagtaaaatactgatattgtaaacctgtttatgttaagaaaaacccagcgtgtttacttacattataggcacttacaacttatttgtgtatataagtgcctagaatgaaaagtagaaagatgtatgccaactgttggcattagttgcctgtgtaataaaagcgagtattgaaaaggccctttctctgcatagttttttactgtttaggtactggagagatggaagattcacagtggccttgatttcagtgcctactctgtgcattgtattgatagttccattacatatattagcacagttcatttgtaaagctgatttgcaaatgaggaaattgggatgttatgttaaaaaaacttgcccaaggttatatcttgtgttgcttcgtgcatagatatttttaagtaaaaaggggttatagtgtatttaagagctttaactgctttttatttatcataagactgtagtgaagacatctttttatgtcgataaaggtagacctgtatcttcatttttaatgaccacatcatatctcatagaggtaccatagtagattcagccatttccctgttaatgaacatgtagagtgtttgcagtttcaggctatcacaagtaagctgtagtaagtatacacatatatttgtgtgtatacttgatactatccttaggatattattccagatgtgtgattgcagagtccaagaggatacaaatttccaatgttgacatatgttttgacattaacttccaggaaattcataccaattcacatccttgccaatatcccatattggcctttgtttaaatgtgtgctaaatccctcatttgccctatcgtgattattacacattgcatacctgtatcagaatagttcatgcaatccacaaatatatacacctactatatacctaaaaaaatgaaaaggtaaatactaaatcaataaatgtgtgataagctgatgaacaataacgttttcattggcatctttatatgattttgaaatattttatttgcaaaacagaaatgagcagccttccgctatgcacgtcatttagtcattaaagtgaatgacagtgatactttaattgacccagtgtgtttcattttttttatgctcaagatgtgaaattttgtaattgtaacaattacaaatgaagagcttgaatatcgattatatattattcttatttacacagctaatatttcaagaatgtttctagtctcatgttttgtacagaaaatctccatattttttagtcattttctcatatgcactgtttataatagaatggtagtatagagaaccctaaatttcatacaatgaaagaccacttatgtttggaatgagttatattgagaatgtaataattgaatatagttgtatttgactttcaggtaatattttttcactaaatcagtgactaatgcaatctcaaccaggaagtagccagaaagctccttatttccttcctttccttacttgtcagtgatggaaatggataataaaatgtctcataaggtgatcccaccagggcacagccattctctctctgcgtaagcttgaacttgtctggctcacactccccttgggaagaagagaattaagctggggcgtaatgaagtggttctgtccagagaaacattcctagtggctgaattatgaggaggaggaagtacacattcctgtgtcccttttattccatgttggacttcgtacaacgtggagccacagccaagagatgggaataggaagtcctagaactttttgcaaaaagtctgtgctctctagctttcactactgaaagcttcaagatctgatgtggccatatcctcctgggcagctgaaaattgagtctgtgccaccagttgactgggttgccctccctgctgtgttgagatccagctctgggaaagtagcctcacatgcaggaagccagcatctttcactgccccttatctctgtgccagacagacaatgcagccttcttgacagacctattactaacaagggaggtggcccgtaggctagtcattaattcatctgatgcatattgtatgcctactgggtctcatgctccgtgctggggattcagaagtgaacctgcctaatatagtccctgccgtcatggcacttacggtccagtggtagactgataatgaccacactagactgataatgacattagtaatcaattaagtctgagacatgctacaacagcaaaccatgtggtagtgctgtgagcgggtgtaacaggggtcctaactcagcccaccctttgctgagcagagcatggcaaagagcacattccgcctgggaggccaccctagggagcaccaggcacaaaccctgcatggtccagacacgcagaaaactgatgggattgcatgcatggccttttgagggtagactctctgggcctgtggttgcttcatggctgaagtccagctccttgtgggaatggccatcccactggcactgtcgctgaccactacctgtgtttgggctggttcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttggtgagtgtttccaactcggaagcttcagggagtggacggtcctcgttcttcgttaccagaaaaagaaaggttttcttccttttatcagtgagtgtaatgaggatacagaaaaagtttccacacacacatttcttccccgacaagcatgtttgcctaactgcttcctaatgttctcatagtcatatatgacgtgcttatgcctggctgcaacaaaaacatgtgaaatttatttcaggagctttccaccatccttgccaatcctgatctctgcttctgcctgggctggggaggagtcacccccctgcagtcacttggtgacttttaaaaaatgtaccttctatgcctgcctgaaattgagggcaaatcacctttccaaggaacagaaggaagtggctctgcttccatgaacaggaagataaagttaaaattggcacatttctggcaccagcctggcttattatttaatttggggccttagatttgggttttgtattataaaagcaaatctctgcctcaatcagtcttgcttttctagttcccctttgagtagttgtggtgctttctgtaaagcttccatggaacaccatttccttttttagtgctttttctaattggcatgctagtcttcttttcttcttcgtctttctggtataataacaacctttcctgttaacttttttttttttttttttttttctgagacagtctggctctgttgcccaggctggagtgcaatggcacgatctcagctcactgcagcccctgcctcccggattcaagcgattctcctgcctccgcctcctgagtagctgagattacaggcgcacgccaccacgcccagttaatttttgtatttttagtagagatggggtttcaccaggttgtccaggctggtctcgaactcctgacctcaggtgatccacccaacttggcctcccaaaatgctgggattacaggcatgagccaccacacctggccttttccagttaacttaaactccacatattccataggtgttttgtttgcttgcatttttgtatataagtgcatgggtgtggacacaggcctctaagatagccattactccaaatttaagtttactttcccatatactgaatctcctacaataatggaacttaaaatgcacactggtgattggtaagcagttgtgaacagagagaggcaaagtcatattttattaatttcaagggcttagggtataatttgaattctttttcaaagtgtccggattgtttttcagctgcttttgaagaaatgaatctaactcatctcagaagtcttgtcaagtaaattcaatagatcaacgtatgtcgcagcctatggaatacttagtataaaaattgaagagaaaaccctcaggttgctataaaagtgctgctttattaaaattaccaaaatctcactatttctatctaaactgacatactacagtttctgtctaaatacattgctctgtattttattaatttgtatggcaataaatatgtgtcaggaacagttttaaaacttaatcctcaaatactgcttccttaaatctatttatttatttttatttatttattttgtttttgagatggagtttcgctcttgttgcccaggctggagtacaatgccgtgatcttggctcactgcaacctctgcctcccagattcaagtgattctcctgcctcagcctcccaagtagctgggattatgggtgcccactgccacacccggctaatttttgtatttttagtagagatggggtttcaccattttggccaggctggtctcgaactcctcaggtgatctgcccacctcgacctcccaaagtgctgggattgcaggcatgagccaccacacccagcccttaaatgtatttttgtgtgagtgtatgataaaaatcttggatctggaacaaacccaaagattactctttttagttacctttttaaataaactctttatttatctttttaataaactctttttagttatcttttgtgtttcttgtttgcaaaaagtaactaatttattaaattgtgcttcatccagtgggagctattgagagttggccacccatagaaaattgagggaggattttaggaactgctgaaggtttctgccacatgcatgattctgatataccctggaagaatccatctgagccttccccacatggacacagagtgtggaatgctagcagcacacagagggtggcagagcttgccctgcacgtgacagcacaggcgctgagatgtgtcccagaaaaatgagcaggtagaagcctacctgagacatccaacagaaacatccctcttaacttccttcctcctttagtgttttgaatcagtttatttggttgggaagtgtaagcaaggatagtgtacagagaagtaggaaaactactcctcttcttccacctgctctgcattagcacaacaggacaactctcactgagccttcctgtcctgaagatttcttttttcttttcttttctttttttttttttttttttgagatggagtcttgctctattgcccaggctggaatgcaatggtgcaatctaagctcactgcaacctccaactcccaggttcaagtgattctcctgcctcagcctctcgagttgctgggatgacaggcacctgccaccatgcctggctaatttttgtatttttagtagagatggggttttgctatgttggccaggctggtctcgaactcctgaccccaggtgatccacccgccttggcctcccaacgtgttgggattacaggtgtgtgccaccatgcccagcctgtcctgcagctttcaaagtgaaccatcttcgtgtatgtataatgagtgggttgcattcatatcatgtgtgttttatacactgaggtagattccagttacgtaggaatatagttagtaatagtgtattcctgaaaattgctaagagtggttataaagtattctcaccaccaaaatgataactgtgaggtaatgcatatgttaattaactaggtttaatcattccacagcatatacttcaaaacatcatgttatacacaataaatacatacagttttatctgtcaatttgaagttaaggaagaaaatagattggattttcttacaccttttaaatgattaaatattataaaaatagaaaccaatcacatgagagaaacatttactactgttgttgataaaagtacggggagaatgtaacgcactttagagtgaggaagattctctggattctaccactgcatctgttagcgccatggcatactgtggtaaaatggcactgttttccgatgctatgtacagcaagggatagcgccctgttttccccccctagagctaccgttacaagcatttgcttatgttatagccttccaataactaatatgttgaaaacaccaagacaccacttaaggtctttacaaagtgagaaggaattgggaaaaaaagaaacaaaggccgggcacggtggctcacgcctgtaatgctagcactttgagaggccgaggcaggcagatcatgaagtcaggagttcgcgaccagcctggccaatatggtgaaaccccatctctgctaaaaatacaaaaaaaattagccgtgtgtggtggtgcatgcctgtagtcccagctactggggaggctgaggcagaagaatcgcttgaaccctggaggcagaggttgcagtgagcctccagcctgggcaacagagagagattccgttctcaaaaaaagaaagaaaagaatgtgaatattgacatcacattaaaaaataataacaaactttagccttgtggcctttttttggcacatgttttccgctagttctcatgcatcatccctattctctctcttctctgtcttttcttcatccaggaacagagaaagaggacttagaaggaactcaacccagtacttcctaggattggaaggaagctgccttatttcatgtataagtggcaccagcttgactgtaggaagagagatagcgtgaagcctttcacatctaaactagaaagcttttaaacgtggtagtttgttgagttattctctctctgtggaatgaatgatgtagagatggtgagaaatcagagtgggtgattttagacatttccctttaccctacttcattcctgctctgtacagagccttgtttctgttcttcaccttatttctttgagcaagagtaaagcctctgattatgaaaatacactgtgcataaatagccagaaaacacattttcttgcaatgaaagatttgttttatggaaaatctcataaacaccatcaaggaaggttttggaagaaggtcaaatgtccttcaaaatgctattaccccatcaccattcacatcttagtgtgactgacatccgttctcagctctggtggggagaggtggacagagacagcagcactgtcccctgtggcccagggttgcctgtggggacgcccacccaagaagcaggctggagagaagtgccaaggggttaaccattgcctggatgatattttgtcaggaatctaatgtttttctctctcctgtagggggtgacaggtgctttgacagttttgatgaaagatgcaataaaaccaaacctgatgcagaccctggaagtaagtggttttcttcttatagtaattgtttgcattaactggattgccacacaatgtgaacatttttagccaatatgaggcaggcatagagcatgcctggggcagcagtgtgctttgcaatctcaggcagaaagagtgaggatctggttaggaacctgtattagtccattttgacattgctacaaggaactacctgagactgggtaatttatgaagaagcatcagaataacttcttggccaaccaaaaaaaaaaatttttaagtgtattcatagcttctttaatataagtcatgtcttggcttaattgacccgagtagaaacttagaaagtcaatgtctgaggccaggcgcggcggctcatgcctgtaatcccagcactttgtgaggccgaggtgggcggattatgaggtcaggagttcaagaccggcctgaccaatatggtgaaaccccatctctactaaaaatacaaaaaaattagccgggcattgtggcacacacctgtagtcccagctatttgggaggctgaggcaggagaatcgcttgaacccgggaggcagaggttgcagtgagctgagatcgcaccaccgcactccagcctgggcgacagagcgagactccgtctgaaaaaaaaaaaaagagaaagtcaatgtctaacatttcaataggttgtatggccatgtttacaatttattttctgtgttcccttaatctctcataatcattgagttgtggattttttggtttgcttttttattgttgtttgtttgtttccaagcaaaatacaataaatgccaagactttccaggaaagcatttgccaaaggcaagtcaataaacacacagcatgttagttggtggtaaggtctggagaagaaaaatcagaggtcatgaggggcagagtgatgtggggtatgtgtgtctgtgcctgcccgcctgttaaagcagtaccagcacagagctgagtaaaccaagggggtgagccatgcacgtgtcttgaagaacatttggacagagggttacctttagtgcaggggccttgggcagcaaggtgttttgcaatttcagacagcaagagcgaggatctggttaggaacctgtattagtttgttctcgcattgccgtaaggaactacctgagactgggtaatttaagaagaaaattggtttaattggctcacagttctgcaggctgtacaggaagcatggctggggaggcctcaggaaacttatcatggtggaaggcgaaggggaagcagacaagtcttcacatggcagaacaggagagagagggcgaaggaggaagtgctacacacttttaaacaactagatctcatgaggactcactcacaatcatgagaacagcaagggggaaattcactcccagaatccagtcacctctccccaggcccctcctccaacattgaaggttataattcgacatgagatgtgggtggggacacagagccaaaccatatcagaaccaatatgacagaaatggggggattggccaggcacggtggctcaagcctgtaatcccagcactttgggaggccaaggcgggcagatcccttgaggtcaggaacctcgagaccagcctggccaacatagtgaatcccatgtctactaaaaatacaaaataaattagctgggcatggtggcacgtgcctgaaatcccagctccttgggaggctgaggcaggagaatcacttgaacaggaggcgaagattacagtgaactgagattgcaccactgcactccagcctgggcgacagagtgagcctcttatcttttaaaaaaagggaatagaaaaaaatggggggaccatttctgaaggtgcccagtgaggatgcagactgcaggtgtcccctgagctgaggaagggaggactgaacgcctttgaacaggtgtctgcagccccgggggaggggtgcaggatgcacaggtgccaaggccacacccttctgcggcaggttgtccttcccgtctttcctctcccctgatcattctgccagcatgcacgtatcctcagaggtaggccatcttaaaaagcaaacaaaaacatttcaaaaacctcctgcccccacctgcatcctcatctagcttctgcccagctcttgtctgtcactggggtctccatgttaactgacctcgggttccacctctcctgactgcccttgtccaggtcacttttcccttggagacaccaagtctttgttgctgtgccctcctcagagaagctcagcagagtttgacacagctgcccttgtcttccttcaggagcacctggttcctctggcgtctggggtccccccctccccaggcctgctcgctgctcctcctccgctttgctggcttctctgatgacccctcaccttttttgccccgttctcctccagaattagccaggtgatgactcccaaactcttgtttggaatatcatgcacctggaatttcagacttgcaggtatagttaccaggagccacgtgggtggggaaaagccatttcaaactgatacataaaccaggacccacctcctacctacttccttccagctcgctgcttccctgaaaccttcccagtcattcaaggcagaaacccgaggatgatcctagaggcctgttttcccttcccctcttcctgtgtccatccctgcagagttgtccttggttacatgactctgccctgtccacgatgctcaatgcctccctccttcctgctttagctgccagcacgccccacctgcacgagtgcagcagcctcccaaccagtctctctgctgctactcttttcttccaaaatactctctcctcagcagccatagagactgaaacctaatgaagccctgttgccttcctacttagagttcttccatgatttacccatgtttccaccccggtctgaaaagccctagggatctggctctcaccccttcccgctccttgtcccttatcctcatctctcatcctctgggggacctttgcacggctaacaccactacctgggccacttcctgatattctcatgtccagctccttcgcctccctctgttctcatgtcatgtaagcatcagctgctcagagaagccacaggaatgtgcagcccccgtccctctgctgtcattgcagtacatggcacagaatgctgagagcttcctatttccttatctgttttctgtatttctcctcccaccgagatgacagcaagaccttttccatcctgttcaccaccgtatctccagcttctagaaagtgcccgacacctattagaggttcagtaaagacttgttgaataattaagtgaatgtttattatttttactacattctcctaaaaatacacatttattaataaataactgaataagagaaaaaatacgaagtgatgtgatattccttcataacacttctccctcaaagatgaatacttattattagggataatcattttctttattgttgttgtttgttttgttttgttttgttttgtttttttgagacggagtctctccctgtcgcccagcctggagtgcaatggtgggatctcggctcactgcaacctctgcctcccaggttcaagcgattctcttgcctcagcctcccaggtagctgggattataggcgcctgccaccacacccggctaatttttgtattttttttttaagtagagatggggtttcaccacgttggccaggctggtctcaaactcctgacctcaggtgatctgcccgcctgagcccccaaagtgctggaattacaggcgtgagccaccatgccccagccaggataatcattttcttgttttaaataattctttttttttttttttttttgaaacggagttttgctcttgttgcccaggctggagtgcaatggtgtgatcttggctcactgcaacctctgccttccggtttcaagcgattctcctgcctcagcctcctgagcatctgggattacaggcgcccgctaccatgcctggctaatttttgtatttttagtagagacagggttttaccatgttggccaggctggtctcgaactcctgacctcatgatccacccacctcggcctcccaaagtgctgggattacaggcgtgggccaccacgcccagcaaatttttgtatttttagtagaggcagggtttcaccatgttggccaggccagtctcaaactcctgacctcaggtgatccgtctgcctctgcctctcaaagtactgggattataggtgtgagccaccgtgcccggcctgagcactttttaaaacataatctaaacctgttatttctttgctgcctaataaatcagagattcagaacccttaaaaagcaaataaaagtaagggcaataagacctgctgaggctgaggcaggagaatagcttgaaccggggaggtggaggttgcagtgagcagagatcatgccactgcactccagcctgggcgacagattgagacataaaatagactgagaccctgcctcaaaaaaaaaaaaaaagagtcctcaaactgttcatatacaggactgggcttgctagggaaagaagggggaattcttcagactactttacaaggacacaagaactcctcaacctaaacaaagtatgaaggtacatagacaagtttcttgtaagtcggaaaacagagaaatccacagtaactataatacatcccttaaaggataagcatgcatttgtaggaagcaaacaaagctttccatagagaaaccacttccaccagatgattatatggacttgggttttgtttctgcatctgtcacttggcaaatgaagataccatcttcaggatgttccgtgtcatcgatttcatttaaggcataggctgttttaagattactttaaaagatatggacctttttacaaaataaaacactgcattcacttaaaatatttgcagacgtgaactcttgtaccctgatcctatgttgtcactctgggttttatgtatctaatcattgactaggaatctatctcagcagataatccaaaaatctagtttgactagttggtagattatgctttcccgctcacatctgaacacacctggttgttagtctggtaggaggtcatcaagggccacatccttacaggttgccaggagaccagtagttcttaatcctgactgcacttgagaagctcctgggaaggtttaagaatattgattgattgatgccgggctccccatcagacccagtgaacgtaatgtctgaggataaggcttgggtatcatgtattgccagactgaggaagacttaagacaagaaaacagtgagagctgttaacattttcccacaggttagccgtgtgtggtgttgatggaaacttcacatgcgagagcacactgtccaatatggcggccactggacatgtggccatttcaatctaaattacctaaacttcaataaaatttggaattcagttcttcagtcattttagccacatttccatttatgcatttatttgtttatattttactgttcatatttaagtgcttagaactctggtaagctaacaattacttgaaattacttgaaatattaatcttatgaaatgtttgaaagggccattatggagaatattcatagcaagatagttcctgccttattttcctgagtgttctgcatgtaaaataaaacccagaactcaagataaatgtgtgtatgcctttgagttagtcatagaattttttaagcaacatgtttaatttgatgtactgtatcttatagctatatccatgtttgagtgtgcaagtgtgtgtgtacctgtgtttggaagtctaacaatgacattccaatatttttttctcaccaactccatactgggagttttaaaaccagagccctaatcttgacttaattattaatttcctccgtggccctgaagaattcccttagcctctctgggccttaaatttctggataaagaagttggctgcttcgtgctctcaacattatctgattctgtgatttctagctaaagctacatttatacaaaaatataaagtgcttttgcaaagtaaagagtagaatagtggttatcagaggcagtgggggatggagaagttgaccaaataatacaaaattccagttagacaccacctgtgtattcataaacatgtgtccctaggttttatttatttatttttatttattatttttttcatttttgagtcagagtcggtctgtcacccacactggagtgcagtggtgcgatctcagctcactgcaacctccacctcccaggttcaagctgttcttgtgcttcagcctcccgagtagctgagctgggtttacaggagcacaccaccacaccctgctaaattttgtatttttagtagagacgggtttcactgttggccaggccagtcttgaactcctgacctcaggcgatccgcccatcttggcctcccaaagtacggggattacaggcgtgagtcactgtgcccagccaattgtaatgatttttatggttaccttttcttgaatggaatcatttcttaattaaaaaaataaatataccttttataccatcagggtttaatttcattcttttaaaaaaatatagtgcatggcaacataaaataaggtaaataatttatttcatggtcattgaggcaactaacaaaatggtttaacaatattttggaaggaagtgactgtattctcacagttttgtctctcaggttcagcattaaatgtagaataacatttttctagaatccggagggaatttggtcctttgattgagtcagggtgttttgactgtctttgaaatattttatgcattaaatatgcagtattcataaaagctttcctaccccatttgccccaaattgatcttggtttccatgcttctgtttgtcttttgggattttgatttgctttttcacttctctaggggacacctgtgttcgtgcatgcgggcccttttgctaacattgctcacggcaactcttcagtgttggctgataaaattgccctgaaactggttggtgaagaaggatttgtaggtaagttatttcttttaaatttagttgttgtagaatattgaagaaatctaaaagctgatgactggaatggagtgatatccatcctgacatgaaacatattctttcaggcaccctctttcatagagggtctcaataatggaaaagccctaaggtctggtctatactcgtgaaattatgcttgtgcttgaatcatagagtctggtatcaagtacatatgggtttgagtataaactctgactcttgcaaactgagtgacattggacacattttaattactactgagcttcggttttcttgtgtgtaaaatagtgataacaatactgtatcaaaccttttagggttgttatgaaaactgaatgagatattttagtcattcagcaaatgttttttgagaacctaccacttagaaggcatgttagctagggatccagtggtaagcaaaacagataggcgcagtggcacatgcctcgctactcaggaagccgaggcaggaggattgctcgagcccaggagtttgtgtccagcctgggcagcatagaagaccctgcctctgtgaaaaaattaaaattaaaacaaccagccttagcccctgctcctgtggagcgtactgtctaatggtaattgaataagagaaagtgctcattgactgtcagccattactacccttactatgtagtactgataacttgaagtcgtgggtttatttccatgtacagtttctccttgttttttgtgagctaatataggagagattcccaaccagtagacttagaaatgttaattggtagtactgcacaccttttgctgctgtcaagttctttgcagaacctgttcctctttggcttttcttgcatattccagctagaaagaaggggcaactctcatagagtttactaagtcagtgccagccccagtctcacccacaatactaaggcagcaaggaaacaaaagacaaaaccaaaacacaggcattcatggaggagtcccttaatctgacatatgagggactgcattggcagatttcccatgctaacaggtaattcccattaaccacacgtatacctataatcggagacagcaatctcttctttcactcttatcatcagctttggatcaaactcaaaagagttattttattagaagagagtgtgctggacaaaagaacttggcactgcattttatgctcagacatcacaaagttcattcagtgttattgagactcttttaagaattccttgtggactggcagtcaggatcagatgaggcttggtggagctccactcctccatgatctgttttctgcagctctcatgtactttgctccttcggtagcaaatccactgcaagagtggctagacatactgtctaagtggatttgctcaattgatcgctgcctaattgtagagctaatggacgaggaggctgggtcagggcgggcactggaaagttgggtgcttaagtgaagtggtggttctgatgcatcagctctgcaaataaagtagcttctagaaggaagcactctattttatgctgacagagatctctgcccataccagttcttactttgtcaaacacatatttataaaatacatgttatcatggcagaatactttcaaagatataaactgatgatgtatgcaaagcaaacgagccctctgtgtgaccttgaacaagccattagcctctctgggtgtgtcccctgtagacattctcatctgaaaaatgagaagttggaccagatgaggagttggatgtggatgtgtagccgtggactcagagttagacactgtggaattggagccctgactggtagtgtgttttcatttctctagggctcaattttttatttaataaaaagaatacttctgtattttaatgaataggatcaagtgagaaactgctttgtaaaatatgaactatgttcaggtcagcaattatactaattctttctatgatctcatctagtctaagatgccgtaagtgggggggtttttcatgaggatgaaatctgtccgttgccagatggttcaaagggcaagccctaagtcagaggttttacctcaactgctttcaagtcacagataaccttgggcacatgaacccttctcttccttggtttccctacctgtaaaatagggctttggatagggcttccctctcgaaaggacttggtaggtttgaaatgaggcatcaatgagatcatggggttgagtcctggcacctgacacatggtaagactcaatccttcttggccactcctggctgtcattgttacccccactattgatacactactgatgaaggttacattttcttttttctttggatctttttattttttggatgattttatttatagttgttataaaatacacgtaacatgaaagttaccatcttcaccatttttgagtgtacgttcattagtgaagtacaccttcattgttgtgcaaccaagctgcagaaccgaagtcccatgcccattaaatattcctcattctccagcccctggcagtgcccttctactttctgtctcaatgaagttgactcctggataccccatgtgagtggaatcatgtagtatttgtccttctgtgactgacttatttcacttagcataatgtcctcaaggttcatccatgttgcagcaggcgtcagaattctcttccttttttttttttttttttttattttttgtgagatggagtttcgctcttgttgcccaggctggagcgcaatggcacaatctcagctcactgcaacctccgcctcccaggttcaagcgatcctcctacctcagcctcccgagtagctgggattacaaacatgcaccaccacgcccagctaatttttgtattttttagtagagatggggtttctccatgttggtcagtctggtctcaaactcctgacctcaggtgatccacccatatcagcctcccaaagtgctgggattacaggtgtgagccaccacacccggctagaattctcttcctttttaaggcggaataatattccatcgtatggatagaccatactttgtttatccactcatcctacattggacatttgacttgtttccacctttggctcttatgaataatgctgctatgaacatagatgtacaaatatattttaatgtctaaaaatcgtgctctatgatgtctaaatatgtgatggcaatgacttatattcacaaatacgtaccacggaactctagccctgtaatgttgaactctcccgaaggtggtgtgtccatgctgtggctctgttggaatgctggtggcaaagccagtgtattgcacagtgggaacggggtgtggtcaggagacagtgttccttgcccattgcttggtcaagcctgcactgtggggctcgttcattccttgcccttggatgaagtttataatagttccctctcattctcagttaatatctagtccctctaacacatatattttttaattcctctggtcactttcaatcataagaatagcccctaaaattaaaaatgcatatccagttgtatatcaaaaccaaaaactccaaatgtcactcagacttgagctcctctcctcccctgtctgggcctcctctggctgacagtgggaaggggaaggtggctgcttgcttctctgccacccttgtcttgcacttgggctcgccctggcccctcctaggttgaagctttggcatgaaatggtgcccatgtagcctctaccagcagacgtcctcacacttttggcagaagccccctgagcagtacctcatttagactttcctacctctgattccacacctggtctcgggtaccacagacctctgacctctggctggggacacgccctgagccttgccaactggtcttctggtcctcacttgtggcttaagggggaagcggggacgccaaggcgggtggatcacctgaggtcaggtgttcaaaaccagcctggccaacatggtgaaaccccgtctctactaaaaatacaaaaaaatttagcggggcttggtggcgcatgatgtaatatcagctactcaggaggctgaggcaggagaatcgcttgaaccccaggaggcagaggttgcagtgagctgagatcacaccattgcactccagcctaggcaacagagacagactctgtctcaaaaaataaaaataagggggaagcagcttcgcatgctcttcactgggagctgggaggggagctggatgtggcacactgataactttctttgaagaaattctttcccaggttctaacccgtcaacccttttgaagcctcaatgggctaaggcatacaaaatctatttcaaactgctttgcaaaccctcccaggtcagccagcaccatcctttggcatgtgagcaaattgacaccaatttgaggcccgaaacaaaagtgagacaaaaagacgttcatttcaacatccttctacagaagttaaatagagtaggcacatctgaggtgtatctgaagtctgagcaggaattcatgttcttcaaaaagttgtcgtttatagtagactatctttatgacctcataatagggaaggatctcttaaaatatgaaaagctcaaaccatagagaaaaatgtcgataatttggcctgcattaagaagtaaactgtatgtgataaaagatacaaggataaaaaacaagtgacagattggaaagaaacgtttgcaaagatagtagacaatgattagcattgagaatatgtaaaacactaaagactaaagactgataagagaaagacaaataatccaatacaaaaatagagaatttgaaaaggtgattcgcagcaaatgagcaatttggtggaatttctaggtagaactgaaaatgaacaaatgatttagcaatttcacttctatgtatactctggaaaagaagtagtcaaaaatatatttaagtcctttgaaataattgacttcagtacccctttaatgagcatttattaagcttctgctatatgtcaagtactatctgctaggagctgggaatcaaatatgaataagacaggtttcttgccctccagtaattgatgatgtgctgtgagagacaagaacttcaatggtaagtacaatgcacttgattaagtactatattagttaaggttcttaactaagaatttcaagggatgatgggcatctcttagatagaactgtctccatattactggttttgctgatttagtctaatttttgttctaacaaaaagcatacacaaggaaggaattattttgtctattctgaataattagtctaagataatagaatcagtagtccatttagacttaaaacagagtgacatttattttaaaaaagcatgaatttgcaaaacactttatgagaatttttcaaaaactgctgtgatcactgttgtggctgtttcttccgttagtcagcagtcctcatgggagttcacctaacttccatttacatgctgtaaaggcaaacagatatttggcatcgaattctaatcatgtattacatttaaaaaataaagcaaaaggaaagaaagaaaggaaaaagcagtattgagttcctggattttaaaaacattattatctcatctttaaactatttgtaggaatttcaaacttacccattaacttaggattttttaatttgttttctgctctctcagttggttttgattccagttttcagataaagatcttgtctttgcagaggagtgcagaatgcaattgtgtatccttataggcaggtgtcattaactgagggtcaccagccactggtggactcctggatagacttcgatctacaactctgtcccataattaaatataggttcgtgcatatggagacatatatatatacaccttttttttttttttttgagatggagtcccactctgtcttccaggctggagtgcagtggcgtgacctcagctcacggtgacctccacctcccaggttcaagcgattctcctacctcagcctcttgagtagcttggattacaggcgcatgccaccacactcggctaatttttgtattttcagtagagacctggtttcaccatgttagccaggctggtctcgaactgacctcaggtgttccacccgcctcggcctcccaaagtgctaggattacaggtgtgagctgccgcacctggccaccttttttttttaacctggagaaaattacacaattcttggattctcacaggggaccatgacataagagagagaaagaactgttggtgcatatctcaaagcctagctctacttttgacggtagctttcgatgtcccatacacatttggcatttattatccttatccagaggtgcttgtcaagaagctacctaattgattgcaactctgctgcttgctctctgtagagaatcacacagacctggctgtgttccccaggtgcttcctgggtacatgagcataaacactcatgcagcagaggagaaatatgagacaagtgcccaattaaaacacagggtgatctttgcctcagacatttcaggattaggatttagaaatcagaatgaatcgacttagcagttccaagacaaattgaatgggattgggaaacaaagccttgttaatattttcattaaaaacgcccccgtttctgagccattcctgagcattagaccggtgctgagactatcatataccttctcactcaatccttaaaaccgtctgtgggatcagtgttactatcctcatcttacagatgatgtaacagaagcttagcaagatgatgatacatgtccacgatcaatcagagagtaagtgacagaggacgtgacctgagggctcctcctcgccaaagcttgtgggtgatcaggcggctattgtgctcagtgtttttctcaatgctctttacctggttgccaccctctcccattaaaaaataattttagctgggcgcagtggctcactcctgtaatcctagcactttgggaggccgaggtgggtggatcacttgaggtcaggagttcgagactagcctgaccaacatggtgaaaccctgtctctgctgaaaatacaaaattagccgagcgtggttgtgggccctgtaatcccagctacttgggagggtgaggcaggagaatcgcttgaacctgggaggcagaggctgcagtgagctgagattgtgccatcgcactccagcctgggcaacaagagcaaaactctgtctcaaaaaaataagaagaattttgggtgagctgtctacagcagatggtcacagttacaggaagtaccaatataactatattgtaccaatatatcgtaatgtgcgccaacagtggtggtcctttttggtcctttttttcttttctgtgttctactttaacatttcttcctcccaagtaggttactgattgaagatgaccttatcgagtcccactgtttccttgctctacctctcaacctgtatttttgggggacagttttttaatttttttattttccttttttgagacggagtctcactctgtctcctaggcttgagttcagtggcacgatcttggctcactgcaacctccgcctcccgggttcaagcgattctactgccttagcctcccaagtagctgggattacaggcacgcaccaccatgcccggctagttttgtatttttagtagagatggagtttctccatgttagccaggctagtctcaaattcctgacctcaggcgatccactcacccctgcctcccaaagtgtagagattatagctgtgcaccactgcacccagcctaggggacagttttataatcagtcttcttggccttcagaggactctgctggtggctatacccagctagtggcttgttctctctttccacttttattgccctgaaattctaaatattccatcattttggtagaagaaaaccagaccaaactaaacattctcatgatttcatccacctttaaaaaaaaaaaaaaatctgacgtcaagtgatcctgcagctctaagctgtaattctcccagaccttgccctgtttacattatttaaaaacactgatctcagcctgggctccacttttgttattatgatgcttccaggttttttgtctttagtaaatttattcataattaaatcaaggttgagaagtgctggcttattagagactctggctgaaggtcatgtgcgaactcaggaaactgctaatcacaggtcgtgtttttcagcccctgtcttcaggaaggcttaactctaagggagggttgttttgtgtcatctccagagctctcatttctcctgtgtggcttggtgccgaagctcattcgtcccctcgctgtctgttcggcccttgtcctacctcccctttctctttccacgcttttgtgtaaagtagccctctttcaagctgctcctctgtcctttgaaaacaaatgaaaaagcaaaatgttcttcatatacactaaacaggaaagtatgcaaagtaatgttacaaacacccatgttcccaccactctgtttcatcaaaatcttaacatgtcgctgtgtgtcctttagtttttttgtttttttaaagagatacgtttagctgggcatggtggcgcatgcctatagtcctagctacttgggagtctgaggcaggaggatcaattatgcccagcagtttaattctcctgggcaacagagtgagaccctgtctctaaaaaaaaaaaaaaaagaaagaaagaaaagaaaagagagaagagaagaaatcagatattagagacacagttgaagttcccgtggaccctcctgatcccgttcttttttctgcttctctcctgatttgagtgattatcgtttccgggtgtgtgtttctactttgaccacacacatatatgtacactagagatctgtagcggaggttctcagactttctctgctcgtgaccattaatggcccagcaatttttttcatggtaccgcccgggcaagagaaatacctaacatgtccatttattaaataggtccaaacaacttaatgagtatttatgtccttacaactaagtggccacctgaaaaaaaaatacatatgaattcgaaggaaaaaataacatcatttcatttttaaattaccaccatatgttatgaatgagatgtgtgtccttgtcaggcaccagacaacttctgaccctttgtaaccagttgacacccgcacctcatttcctgttccacgttgattttcacacgatttttgcattttgctgcggtacctgccaaaaactttgctttgcaaatatatgatgtcatggaaagggatgtagagcactattgttgaagcagtgaaaaacctcacatgagtagtatttgcagtgtccaacggatgtcctgtattaccgcgtttccgtcaaaaatttaaaataccccacggtgcctctgagtttgctgcaatgcctcacggcacctcattgcacattagaatcacagatgtgcggcttttcttggtattttttatgtgttttcaaattttatatattaatagatattaactgactgcattgttctctaatgaggtcactgcactttttctgtaaatggcaagatcataaatagtttgggtcacagagtctctgtcccaagtactcaatttagaaagcagccataggtaaagcatgaattcataaactagtccatgtttaggaatgagtctggctgtgttccaacagatgttattattggttcctaacatttgaatttcatataattttcacgtgtaataatactcttctgatattgttggcaacattttaaaaggtggccaggcacagtggctcatgcctgtaattccactgcttttggaggccaaggtgggaggattgcttgagcccaggggttcaagaccagactgggcaacatagcaagatcccatctctataaaaaaaatttttaattagccaggtttggtggcacatgcctgtagttccagctactcgggaggctgaggtgggaagatcacttgagtccaaaagtttaaggctgcagcaagctatgatcacacctagctacttggtaagctactatggacaacatggtgaaaccctgtcttgaaagaaagagagagagagagggagagggggagagagagagataatactttttaaaagagaaagaaagaaaagaaagaaagagaacactttttaaaaggataaataatttttaaaaacttaataatttaacatgtaaaaaaaaaaagatgtagaccatatacaaaacccagaggcacctggatttgtcctgctagccatactggccaacccctgctctataacttgatatttttgtgcaacataacagttttgcatttctctatgtcactgtgatccaaaaagcctcattttgcctgcagtttagccttctgtgcgtgcatgtagcacgtgcatttgtgcattatttgtcaaggggctttcagattgcttccagtgttctgctgttacaaataatgctacgggggacattcttgtccatgtctctgagatttagtctaaaaggtcttctagggactatatacaggagtgagatttggggggttaaaagtacgcttagcaacaacttaatagataaagccaaattgttctgcaacgtaataccaatttatatcactaccaattgtgtgtgtgagatttctgacctctccacgtttgtcctgacacttcttttttttttttttcttgagacagagtctctctctgttgcccaggctggcgtgcagtggcatgatctcagctcattgcaacctccacctcccaggttcaagcaattctcctgcctcagcctcccaagtagctgggcttacaggtgcacaccatcacacgtggctaagttttgtatttttagtagagatggggtttcgccaagttgaccaggttggtttcaaactcctgacctcaggtgatccacccaccttggcctcccaaagtactgggattacaggcatgagccactatgaccggctgaacgcttctattgttagatttttttagctcttgctaatctgatggtagttcattatagttgtgagatttagcatctttatggctgtttctgggcatttgtgaattgtctattttgtattgtgctatttacctttttcttactaattaatggaaatcctttatagattccgaatacgaatactttgccattatgagttacaaatatcttctcccctgtatggcttatcttttaaatatgcttgttgtaccttttcttgtccacccttttctttatgatttctgcttttggaggttataaagataatcatttgtattgccttataactgttgtctcttgcattgaggcctttaatcatcttagaatttgtttgtgtaatggtgtcttttttccttaactcttacagtttgtgagacttttctgccctggtgatatgtgcatcagtggttgttagcccagccctatgaaaagggccagctggcctccatagatctaaggcagccgagagtgctgtcccctttgtcccaggctctgcagcatccaaggcgagtgcagatggggccagctgttcttccaaaaccatcatctcttctttacctgctccttctgagcttcacctgacatggctgtgcagtccccaggaaaaagaaagtctctcttgtcttcctacttcctaagtcaatcctaggaactgttacgttcaattccaagcagttgtcataaaagaagtttccttggaactttgaaaacaaaagaaagggtttaattttcttcttttcgttttgttttgttttgtttttaattttttgagacagagtctcgttctatcccccaggctaacagctcactgcaacctctacctcctgggctcgagcgatcctcccacctctgcctcctgagtagctgagactgcaggcacaatccactacacccagccaattgttcaatttttttctggagatgaggtctcactacgttgcccaggctggtcttaaactcctgagctcaagtgatcgcctgcctcagcctcccaaaatgctgggattacaggcatgaaccactgcgcccatccaaaaggatttaattttatggtcaaattctacattgtctattgactttaatatttttataaaattctttaaataaaatgtctttacctggaataccttcaatgtacttactggattagaggcaggtaggtcctgtttgtatggctagtatgttcattaaatatgaaagtaatggaaagatgtttatgacataaggagagaggaaccttcgcctgtcaggataatagaaattgaaagatttttatgacctggctcagcagaaaaaggagtatatgatgttagcaattttttagaattgatttttcagaagaaacatgcaaaacaaatgagaattaagtagctagaaagcctttttcccccctttattcagataaagtaactgaagacttttaatgagaagcctggtttctgtctttctacacggtgcactgggaatagtaagctgttagaagtcagtgcttagaagtacctaccatcctaaacacaggaaccaaaaacaagggaaaaaaaaaaaaaaaggaagataaataaagtaaaagtaaaaaagtacctaccgtcccaaattttgtatatgatgatgttcacgtttttgaacttacacatattcttctgtataagtaaaatatttcataaaattaaaaatgttttataaaattaggaacagaatttcttaaagatcaacatggtactaatacatcttacaatctgtctttcaaagtttcaatagacttaacttagagtcattttttaaattgcattttgatgccaatataattcatgtgtcattttccgctataatacaatgaaaatccagataatggagatggattttcttctgagtagccacgcatattaggtttcaggctccaattgcctggttttgaattgctctttgccatgtgctgtctgtgaccttgggtgggtcacttcacctcccccaaatctaggtttctccaatacctacctccaggcttgttctaggcatgaagtgcagtgatgatggagaaggcatggactgtggcacaaatagaagagtcaggggttggcagctcctattcccactgtacgatgccaaggatctttacctataggataagccttcagaaacataatttggtctttcaagtgctgaatacctctgtgagtatacttttttccatcttttttcttttggtaaatgaaactcactgagaaatttgacttctgataatgggaaacagtgctgcttatgtgttctccttgtacaaaggtgtctgggaccattatacttagaggtgatctgagaaatcggaggggctctgattgttttgaaaactctcctttgaggtcgggcacagtggctcatgcctgtaatcccagcactttgggaggccgaggcgggtggatcacttgagaccagcttggccaacatgatgaaacctgtctctactaaaaatacaaaaattagccgggcttggtagcatgcatttgtaatcccagctacttggggggctgaggaaagagaattgcttgaacctggaaggtggaggttgcggtgagccaagatcacaccattgcactccagcctgggtgacagagtgagactctgtctcaaaaaaaaaaaaaaaaaaaaagaaagaaagaaaaagaaaactctcctttgaattaaggtaatccttcttgaaaggcttgtttaaaatgtttccttgttacctgggagagagcaggaagcactgggaaatagcacgtcactggtgcctcgtgccatttccgtgcctttccctgtcttgcctcagccttgcactgtggaatgcaaaagagtagaagaaactccaacgtgaaaattgtcgacaaacaatgcagagaatcttcggtggcattaaacattaaaattaaagacacatggtcttaaattcagctgatatacttgacacctcagatatactcttggtgccaaaagggatgttaagcaaaatttgagggatttgactccttatttgggaaagaccatgactaccaaggggagagaaaccagaggcaaaccttattgaaaaatggagtagctaagtcattttgtatatgttacttttacccagccaagtacagtctgtagttttacacagtgaatttgatctttactctaaattcttttcctttaatgaaagtgctagtcagtaatgcagaacttgggcaagttttataaatatgtttgctttacaaccagtcttattaagtcagggtatcatctaagggcccaatcaaggacttttcatttaaaaaagaaaaactctaaattgcattgtgatataacccttaaattccaactgtcatggggaatcccaagacctacatctgtatgtatgtgctgtgttctaaacactgctccccaacctttttggcaccagggaccggtgtcttggaagacaacatttccgtggttttgggattaaacggttccacctcagatcataaggcgtgggtcctagatcccttacatgcgcagttcacagtagcattcacactcctatgagaatctaatgccactgctgatctgacaggaggtggagctcaggcagtaatgctcacttgcccgctgctcacctcctgctgtgcgacccagttccttacaggggctgcagaccagggggttaggggtctctgtttttgtttttttggagatcaagtctcactctgtcgcccaggctgaagtgcagtggcacaatatcggctcaccacactcttcacctcccaggttcaagtgattctcctgtttcagcctcccaagtagctgggactacaggcatctaccatgcccagttaatttttgtcattttagtagagactgagtttcaccatgttggccaggctggtctcgaactcctgacctcaagtgatctgcccccctcagcctctcaaagtgctgggattacagacgtgagccaccgcgcctggctggggacctctgttctaatatgcttaccatgccaaatgcattatgaagaaaaacagaaacaaggcttttaatgttaaagtcttattttctcgctactgaaataggcaaaatgtttcaattttgcaaaaataatatagtattgtgtataggatcttccctaacctgctttttacatttaattaggcttctacgagtcattcgggtagttgcatctagcaggctatttatccattctttatagaccctttagaggtttgagacccctttatagaggtttgagagccctttcttgccccagttctcttgtctgtaaagctgtaggaaataatatgacctaacatacaaggcagtgtgaggacagcagaagtgacttctgtaatgcatatggtgctgttccaggcatggataaatctttgctaacagtcgtaagagtttacctcctgtgaggacctggctacgtgctgagcaccctgcttggtgctttgtacattgtgactcattcagttgctcaaacaacaccatgagtagtttaccagaattacccccatcttgcaggtgagaaaactgagcatccgagtgagttagtagtttgctcaaaggcaggcagctagcgcaagggggagcaggaatttgaacctgagtgtcggccccacagcctttgcttttaccaccgtgctttgccacctctgaatgttcactttcattccatagcagcatcatacagccctgtgcataacaggaagtgcacgtttgttaaatgagaaactagtaacacttctggtagctgaatgacttaactactggtaaacctgtctgcatggccactaggctttttatggtgaacacaggcatattttccatgtgctgtgttgaagcagcaattaaataaatcaggtaaaagagtaattaaatttaaaaggtaaaacgttttggaaggagttttgaggtttagggctgtctaacctgaccttgactgtttctctatgtgctgtaagatgcagattgattttcaatgagatattcagcccatccctgcttatgatttatatatattctaagtaatatgcttagaatgtagttctgcttaccatcataaaatgtggagttaaaataagatccttgtcaaaacattgtcatgcagagattagtgctatgaaagttaacattaaatgattttaaaatgtgatccagaggttaaactgaagttttgaaattcataaaatgcataagctttttgagaatttttaaaaatatccgttacataataactttaaaattacgttatatgattgctatcttaccccatcttagccaagagcattcagcctgaggatactcaaaaagagtcaaattaccccttccttgtataagctatagtttaggatattgcaattatatgaggtcgttttaaagtttttagcaacgtttggtataattacaatattgtgctgttcttacacaaagaaaacataacagaattttgagctaggaatattgggaaaccagccattgctaaaggaagatgcatttagtgtatctttctatgtacctcttaacatcttttgtggggtgtagaaaaacagattattagggctttctttttttgtggggggggcgggagcggggatggagtttcactcttgttgcccaggctggagtgcaatgatgtaatctcggctcaccacaacctcctcctcccaggtttaagtgattcttctgcctcagcctcccaagtagctgggattacaggcatgtgccaccacacccggctaattttgtatttttagtagaggtggggtttctccatgttggtcaggctggtctcgaactcctgacctcaggtgatctgcccaccttggcctcccaaagcgctgggattacaggcatgtgccaccatacccagctaattttgtatttttagtagagatggggtttctccatgttggtcaggctggtgtcgaactcctgacctcaggtgatctgcccacctcagcttcccaaagtgctgggattacaggcgtgagccaccacgcctggcctattagggatctctaaaagccgcaagcctcttgctagccatagctgtgaatgttgtcttaaccattaatgcttcagtataaataatatcaatttaaaagctgcctaagatttaaaagtactatgcaaattacaaactgcttgggtatctagatcaaaataaagcagagcaaagaagtaactttaggaatgaaagggtatctaagtggaatgataaaggaagacttcatgcaacagaagaatttaagtaaaactgaaaaactgaaactaatgtgatcatggcattaaatagtgtaaccctgaagacgcatccagtatataaggaacaccacagcagtgcctatactcaccgttattattcatcattattctgaagcatgaataagaacaatttcaaaaattataaatattggaaaggaagagacacattttattatttatgtacagaataattatataactagaaaattcaagagaggcaactgacaacttattttaagtaataaaagttttagtttgctagtggatgcaatgtaaatatgtaaatgtcaatagttttctttttttgttagccataaatacatactgtaatagagaaaatgtcctacttatacatgtcccccaaaggatagaatacttaggaaataagtttagcaagaaatgagcacatagaataaaactataaaactttattgaaagacaaacaacaagacctgaataaatggtaagacacatgacatactcttagatgggaataactggtattaatcatccttcctctgtcaaactaacacctaaattactataaaattactatactatatcatgccacactatactatactgtatttactgtaaaaactgcagaggaaaatgaacttcgtggttaaattaatcacagcatttgtctagattctgcaagaatgaattcatgaggatggatttaaaagctttttcaaggccgggcgcagtggctcacgcctgtaatctcagcactttgggaggccaaggtgggcagatcacttgaggtcaggagttcgagaccagcttggccaacatggtgaaaccctgtctctactaaaaatacaaaaattagccaggtgaggtggtgcgtgcctgtagtcccagctacttgggaggctgaggcaggagaatcgcttgaaccagggaggcagaggttgcagtgagcctagattgtaccactgcactccagcccggcgacggagtgagattctgtctcaaaaaaaaaaaaggctttttcaagaaccatgatggatgattaaactaattgtaagtatcagaacaagataaccctatagcaaaacagttaatagcagaggaataccctggagtgtcctgagatagatttcttccagtagtaatttgataagatgacattttatttttatttttatttttttcttttcttttatttttttgagacagagtttcactcttcttgcccaggctggagtgcaatggcgtgatcttagctcactgcaacctccacctcccaggttcaagtgattctcctgcctcagcctcccgagtagccgggattacaggcatgcgccaccatgcccagctatttttttgtattttttagtagagacagggcttcaccaggttggccagcctggtcttgaactcccaacctcaggtgatccatctgccttggccttccaacgtgctgggattacaggcatgagccactgcacctggccagatgacattttaaattagtggtgaatggatgggatactgattaaatgatgttggaacatttgactaataattttaaaacataaaccatagagtttgttgttgttgttgtttgaaatgtagtctcgctctgtcacccaggctggagcgcagtggtgcgatctcagctcactgcaacctccgcctcctgcgttcaagtgattttcctgcctcagcctccctgagtagctgggattacaggcacatgccaccatgcctggctaatttttgtatttttagtagagacggagtttcgccatgttgtccaggctgctcttgaactcgtgacctcaggtgatccatctgcctctgcttcccaaagtgctgggattacaggcatgagctgccatgccctgccaaaatataaaccatagagctttgtatcacaatatattcaaaataaagatagagtgactttttactttttagtgtgcaaattaaacataaagcttccaggaaaaagcaaaaaaaaaaaattattgttggtatcctatcaaggctagtaaaaagaatagataaatgtatacatggaacatgggaaaacattcacaaaatataaagttaaaaaaatcaggttgtaaaataatatatctccaatttgtatgagatttatatctatatatggaatgaagagatatagaagtatatcaaatgattatttttgtttgcctggaggtaatggaatcatggtgattttcacttcacactttgtgatttggcattctcaaatttttacaattactgtgtattacttttgtagtagttttttttataaaaggaaaaaatgacttgaaaaatcaagtaatttgacatgtagacacagggaaattacattcgaggcagagagcaaacgacaggcatgtgactgtagctgacaagtgtcagcagattgtgggcatagtttagagtctaagacatctgggggagatgagtttcatcattagatgaagtcatattctggaggggaataaatgctaatctgaaatactatgctttcaattgccagtgaggagaaattgacagttttgaaatagtggtttcaggaaggctctcctgagaagatggcactgaggcgagccttgaagaaggtgagaggggagaaagattggcctgtgttcaaggaatcaaaatagttcgctagttcagagacagggtaaagcaaatagactggagtctcattcaatgtctttaaaagtcatggagaagagttagtatagtttctaatccatgaggacttcctgaatgattttgccaggactgtactttaagatactgtttctttccaaccccccatcagataagtcataccacttttctgaagtcgaataagtgaagggaaagagtggacaaattgttatctaacagggctccctccccaggaaaggactccttcgtcagtaagagatgtgcacgtggtataaccaacaatgctacttctgggtatgtccacactgctggagctcagaaatgcacaatgaaaaaacaaaacgggttgtggaagtgtgtatacaatctgttacatttttgaaaaacacataacacaatgctatattctgtttatgcatgtgtgcttatgtagaaaaagtctgaaaacctgatctgcataagctctgagttcataggagttatgaccatgggaagaagtagaggggtgggatgagcgcatgggatactgaactcagctatgctgctttacttctctgaaagaggaacaatcttaagtaatcatggtaaaatgttaatgtttgtccatttcagggtggggaaggaaatttaggtctgtaatttaggagagaggttgaggccagagccaagattggcagttgtgatgagtatgtggttacatcttcactttttttagaactaaatctggatgtcaatggccatgtttagtgggccaggggccttacattactttcttgcagcactgatggcttttgtttgaggctgcacaaattcctgcatttcccttgggttgaatggtagggatgcgggcagttggtgactgggtgaaccacctgacttgagcagggctacgactctctctgcaaacgaaacccagagacatgaacagtgctgagatttctcagtggtttcccatgtaggctgctttccaagggcagcaagcatggcttcatcactcacccagtgcttctgattcagcactgtgatgctcggttaagttttaatgaggttttaaattttttcgtatgtttgagtgtttatgcaaacaaagatgctgaattgtaaacaccagcaatctgagtaccttcttttgatttctctctccatattgtttagtccctttttctttgtttgttttatgaaattgcatagatgttttggttgagagtagattgtttttacttttcagggacaggcaacaatttcatgatataacttctaaaaatattttaaacaagtatgaaaatagttttttcttccaaaaaaccatttcttcatttggcacatacacaaacaaatgagcagaatttagagtaatttagagacagaatttagataatttgggtgggtttttttttggacagtcttgccctgttgtccaggctggagtgcagtgatgtgatctcggcgcaccacagcctcctcctcccaggctcaagcgattcttgtgccttagcctctcaagctacaggcacacaccaccacgtccagctaatttttgtatttttattagagacgagtttttgccatgttgcccaggctggtcttgaactcctggccttaagtgatcctcctgcctcggcctccttaagggctgggattacaggcatgagccaccacagccggcctagtgtgaaagcagtttttaaggacagttgaacaggaaagctcctggattcctgcacatagatcttgtgcccctccaaagtgccgtaagtaccgatttctgctgtcttgatttaactcagtgtctggagcttacgatccttcctctctgtttccttcagtggcgtagcttgggggtgtcaattaaagagttattgcaagatctcagcctctgaaagtttagcttattcatcagcaaaactttaagcaagtctcacctcttctaaattagaattgtaaccttgactttagtctcagagttaacattgtgcagaaaaagaaaacactgcgcagtgttgaagcagtttgcaaactgaaatgatacaaatgaaaaatgctatgatgtttctcagtagtctctgtatttgcaaatgagtcagttaggattagttttacccacaaataacaacaacagtaaaaaaaaaaaaaaaagaaagaaagaaagaaagtgacccagcactataatacaagtttatttctctctcacatcaaggaagttcagggtagccagtctgggctggtttagcaactccttgatcatcatgggttctgtgctacctggtagtccaggatggttgcacaagctccagccattgcatctgtatcccaatcagcaagaaaaaggaagaaaggcatacccccttttcaggaggcttcctggaaatcacatacaacatacctggttacatctcatcagtgaccttagtcacacagccatacttagctgcaagacaagcgaagacattcagattctacctcttcttcttgaaatagaaaggtgagttgccaatccactgtcagcgtgacgacagttcaagaggttttcctagacacagagttgagttaatcccgtcatctgtgtcatcgtctctattttgacagcatctgtcaggtggtcaaccagagtttaggcaagaagacctatgacttctctacacagacatgattaggattatcttctaaatcaaccaaactgaccagcccaccctttcattcttctgtgcatcacagatcatttttgaaaaagagtttaggacacatccaatagtaagagtgtagttttataaatcaggactcagtcttacagtggaagattatatggtagttagtgtcatggagaaaagcttcatattagattagttgaatcgattgggatacagaaccgtctttagagcatggcatcgttacattgcagataaagcatgtaggtagagaatgatatctttgttggggagagccccaaactgctcttcaggaacctttctccgagatttgcaagccaattaggcataatgaaaccttgtttttaatgcatatcttttgccagtataataaacataataattaaatgtttatatatctttcgtattttcctgtataatacaactaatcatatttttgtcaggctgaggacatctcaagaggagggaaaggtggcaaattgagggtctgttcttcttttataccagatggcaattataacaaattacttctggacttagggatgggggaggggtggggagatgggaacatgagaattattcctgatttttgttactttttgtcctgtaaaatatgcttaccaggccgggcacggtggctcacgcctgtatcccagcactttgggaggccgaggcaggcagatcgcctgaggtcgggagttcgagaccagcctgaccaacatggagaaacactgtctctactaaaaatacaaaattagccaggcgtggtggcacatgcctgtaatcccagctactaggaagggtgaggcaggagaatcacttgaacctgggaggcggaggtggcggtgagctgagatcacgccattgcattccagcctgggcaacaagagcgaaactccgtctcaaaaaaaaaaaaaaaaatgcttaccgggacatctcaaggacatcattcctttgtcaacggtacaaagataacctgagacataaagtgaaaatgatttatggttttttgttttcttccttacattaaattttccaataacatatcgctaataacatatttcttttgttttgagacggagttttgctcttgttgcccaggctggagtgcagtggtgcaatctcgactcaccgcaacctccgcctcccaggttcaagtgatttctcctgcctcagcctcccaagtagctgggattacctgccaccacatcaggctaattttttgtatttttagtagagacggggtttcaccatgttggccaggctggttttgaactcctgactttgtgatccacctgccttggcctcccaaagtgctgggattacaggcgtgagccacggtgcctggccaacatatttctaataatatattaatttgataaacagaagttattttggaaataagccaaaacaacaaaaaatgctcatccctgcttttcaaggctattatctgtagtttgaggttttatcaaatgtagatatgaactgcgggcctcttcaggatgtcctcattgcttctgttaatgcttttaccatccagtaccactgaacaggcagcagggtgccttcttgggcacaccggaaggacccaggaaaaggaagatagtgtggcctgttcttgtctccatgccccaaaatggaccactacaccagtggggtaggaaatagcaggtgtgttatgggttgagtttggagaccttgacttgatcaaccatctgctcacccaggtcatctttcctttttttgcagaggtgaggtctcactatcttgcccaggctggtctcctgggctcaagtgatcttaccgcctttacctcccaaagtgctggtattacaggtgtgagccaccatgcctggttcttgtcaccattcttaacatcagcagcagcagaaaaaccccctgtttagccttcaatgttaatttcctccttgatctatgtgttctacacaaaccactcccttgttgtcccccatatattacatttgtggactcttctcaaactctgcagctcagccctggttcctgctgagcctacagccccaggcctgagcagccggctgggccaagttaccctcagtctcaagatgacttcctcacaaggcaaaacatttctccagctgggttggagacctaagctggggaactgggctctcacattccaagatagaggtttgcctatggacccctgaaagtaggcgtgtagaagcaggttcctctgatggcagaggccctctgtttatctctgaaagatcctgaatgctatgcttctttcatcccctctgccttgaattcgcctgctttctaggtgcggtggagaaagctgggaaaagagccacctctgctcccaggggccactgagagggtagaacactgaccgaatcccagactcactacctcaggggctgagatgggtccaaaggggcccttaacctctcacttgatcacctgactcttaccgctgtcattgatctgacatgttctcctgggcgctgtcccagctctgtcccagcttctcagcactgtgtcctggtcagccctgagggctcatttcctttatccatactgaggaccaagacctgtctttcctgtagggcagtgagggccacgggctagtgcctgagccgatgagtgcactgctggtactgtgctgagccctggacaagggtgtaggttgctctaaaaaacaacttcccaatattctacaaaataacgttcaaactgaacagagcttgactgaagattcttcttacttcatttgttttcatgctacatttttgctgtccggctccaagtctgtgacaatgggtcacgggatcagtgcgagtaacagtgaagatgtttttcttcatctttgggctatgattgtgctttgtgatcctaagtataaatacattgaggctgggcacggtgtctcacacctgtaatcccagcactttgggaggccaaggcaggtggatgcctcgagcccaggagttcgagaccagcctgggcaacatgtcaaaaccccatctctacaaaaaaaatacaaaaattagccaggtgtggtggtgtgcacctgtggtcccagctgctcaggaggctgaggtgggaggatcacctgagccctggagatcaaggctgaagtgagttatgatcgtaccactgcactccagcctgtctcaaaaaacaaaacaaaaaaaatacatacactgactaataacaccagcaatattgtttcatgggagctgcctctgctgtttgtaccaaaactgagcagattctttaggccaggcccgagtaatcattaaatcgatctgcttgtgagaaaccggtaggtctaggcatgagcacaaagtggcaggtccgtctcttcccttcttaaataaggaatcaccagaggtagactctgtgcctgtgactcttgaatgtttaactgaaatccagagcagcaattgcattttatatgacaccatgtgtgtgcaaaaactgaatcaaaatcttgtgaaacagtgctactttcacttactatatatgatgtagtctaataattttctatcctattttatttcctttttttaaatgctggttgaaattctgtaaatttatataatgacaaactactgggactctatcttggttcaaaagtccatgatcagcctgcttgtattgagttactacattgtacgatcttataattgtaaagtttaagatattttccttctgtctgtcttaatttattctgtaatctaagttgtcctgccaggaatgctggcatatttactttgtttttgaattcaataatcatagtttctcttgctaagttacattaatggtaccaaaaaaaagttactgcatggtttttgaaactgttctttcctaggaagttttaaagtaaaatgtttttaccttttattgtttacacaggttaagcatccctaattcaaaaatccaaaatccaaagaagtgctcaaaaatccaaagttttttgagtgacaacatgatgccaccagtggaaaattccacacctgatctcgtgtggcgggttgcagtcagcatgcagttaaatctttcatatatgcacaaaattattaaaactattgtccagggccaggcacagtggctcacacctgtaatcccagcattttgggaggccagggcaggcagatcacttgagctcaggagttcgagaccagcctaggcaaggtgatgaaaccctgtctcctctaaaaatacaaaaaaaaaaaaaaaacattagctgggcacggtggcacacacctgtagtcccagctatttgggaggctgaggtgggagaatcacttgaactgggtggcagaggttgcagtgagccaagatcatgtcactgcactccagcctgggcaaacagagggagaccctgtcttaaaaaaatatatatacatatatatatatagtttaggctatgtctataaggagtatatgaaatataaatgaatttcatgtttagacaggggtcccaaccccaagatatctcgttatgtatatgcaaatattacaaaatctgaaaaaatttaaaagccaaaaatcacttcagtctggtgccaaccatttttgcataattgcattttccatgttgcattttgcaaccattttgcataattctgtacttctttcccttttgggtttgttttcataactgctcagtaaaaagtgttctgtgtcatctttccattattttgggctaaatcatgttaatggccaagcctgtcagaattcatttgttttgagttaacttcctggtgtccagttctcaggagttgcaagaatagagctcttccctcatgcaatcatccaaaatcccaggcctctaaccaggattggggaacaccactgttggccaagagcagaaggcttaaagctctggtcatagtcatggcactgtacaaactgttcttgttccctacaagaacatgggaactatttggataatggatttatgaatttaattctgatggatttttataaaggagctaaaaataagcctatataatttattacatgtataatcatataattttaaatgtgtataatttataatattcatcgaaacatttctttttggaaattaaatttcactttggtcaaaatcatcttacaaaacaagatgactcatgatggttctaaataatgtaaaccggtgtctgtaactaattaatgctctggaggaaggaaattctgagttctgacacaaaagcacgtctaagtggtattggtattttcaaagcttttactacaaccaaaaatatgttcacgtgtacctgtctcctctttacactgcttactttctctatcgcttttcccaaatacgtccccagtaacttcctcatgttctgtgcaccacctccaatcttcccctaatgtgtatgaacttggtcatcaccaaagaggtggaaaggaagaagggcatgtgctaatattaatattgaggtttgggctgggtgtggtggctcatgcctgtaatcccagaattttgggaagccgaggcaggtggatcacgaggtcaagacattgagaccatcctggccacatggtgaaaccccgtctctactaaaaatacaaaaattagctgagtgtgatggtgcacaactgtagtcccagctactcgggaggctgaggcaggagaattgcttgaaccagggaggtggaggttgcagtgagccgagatcgtgccactgcactccagcctggcaacagggagagactctgtctcaaaaaaaaaaaaaaaaagaaaaaaattgaggtttgtgccagtttctttttcctttaggtctcctgatatgtgtctagttagttctatatacttcctggaaattcgactccaagatatttaataaaactaaacagggttatatgttgaatagacaaatcctaaagagcagaaaggatttagtggttagtgaaatttcattgacttaagatgagttggatcctcaaaattaatatattctaaacaaagttctatttttaagctgcagtaataatgccgaatttctcttatagttaattgaatgatttatcctggtgttgtctcctggtagtcactgaaaaagtcattacaatcctcactttctcccctttaattcaagttcagaattcatgtgttgctgtgactttttttgagtttatctgcagacagctgccattgaataaacatgtttatatagggcagaaaaaggcagcctgaagattctactttctatttcttttagcactgtttggcagttaacaccaacagcgcttcagaatgaggtactgtccagcatacaccttgcttgttcctctacaaagcttctatttttgtttttgatttgttgtgaggaagcaaagtgtagcctttacttgaatgaaagctacagttttatttttctttcttatttacaagaaattcttttgatgattaagttagccagatacgccccgtgcgctcatatttcttaacctattttgagctgagctagttgcaaggactagttcttctgtgaaacctctggcagtccataaattcaagttcgtgtccagacgtaatggtgaactcaatatgttgtatatttgatatatgtttgttgcacacatggagagaaaagttgctaccattgtgaagtagccatgaaatccgacagttctaatttctttatcttctgagtacccatggaataaaggacctcttagtgccatagcaaggcagaagtttaatttgcaattctggtggcaacatccaggtatttcaagtagaaattaagaaaactttacggaaaaactatctcagcacttcagtttaactatttttcaaagtccaaggagggttttccccagtgtaaaagcagaaatgagaatttcagatctaaagcggttcttgccttttcttttccctccatgcacatgtgctgacaacagaaagtaaaatttgaaaagaaaacccaggctagagcattggggtcactcatttcccatccagcgaagggagagctggtgcctggctgggggaggttaggaaggcaagtcttgggatctgatcactcggctgggagtgggtaaaatacctggacctcaggaggccggattgcagcgccagtgttctctacctgtgtggcctgttcctgcctggggttgggtaccaagtccaggtggaagtggtccctggagcatcctctctctgaagtgtttctttgtcaaacagaatactccctgctgctgccccagaactcatcactgttgacacatggaccaagaactagcagaggaggtgatttataatctctaaatgaattgctctaaaagagacaacaagcactctgacttaagtaaaggaagggagggtgggtggaaaggaaggaggatcataaagaacattctagattgcatactttggtaatcacagcagggccttattgcagttagaacaaaagcctggacacacttacctctcagttcaggaaaataatttagagctacttgttaaatgctggagtattattgaagtaccaagtgttaagattttcactgaaagcaaaactgaccaagcagctcagctagggaaatgctatgtgatcagttgattgtttgatgaggagtatggagcagggactttggcagaggttgctagcagacaggccttggttttagtccaagctctatcgcttaatagctgtgtgaccttggggaaaattataaaattttccagtccttagtatcataaactgtaaatggaggagaaagatgcctcacagatgttgaaggtgaagtgagacaggacacctagtacattgcctggctacatagaaaatgtttcacaaatgttaacttgaggccctctccccatgcctcggtctcttagaatggtttttccccatcgtgtgcacattgagcggtaaggcggacagctgccgccgcccatgctgccccatgttgagagcatttctgttgaccttcccttcttccctgtgaagctggttcagcagtcacctcatcactgtttttcttctccagagagtgctgggttgtagcgaccatactgttgacgcaacacatcccaaccacgctggacggaatttttactgcgataattcatattccaggatcttacagtgcacagggttacaacgattagcataatgatcttgcacaatctttctgcctagcatgtagtgcattcgtaatattctcagaggaggcgtctagaaagcgccaggctccttcctcctgcgtgagccactgcaagctgtcggcgcctcagtgctatggagaccttgggtggattattccttgttggcggggggagggtcccagctgtcctgtgcattataggatatttagcagcatccttgctagatgccatttacaacaatcaaaaatgtctccaggcattgctaagtgtccaggtggggagcggaataggcagaaccgcctccagtcgagaagggctgaactgtacttaggatttgtgattctgcagaaatgggttctgtgaatgcactaaagcatgagaacatccaaaaatcagtgtggcacagaactgaattcaaatttacctggatccaggtaaataagcacaattttgaaagtaccaaacagaattcaagaaaaacaacaacaacaacaaaaaacacattaaaaacagaaaagttggccgggcgccgtggctcacgcctgtaatcccaacactttgggaggccgaggtgggcggatcacctgaggtcagaagttcgagaccagcccgaccaacatggtgaaaccctgactctacaaaaaatacaaaaattagccgagcgtggtggtgggtgcctgtagtcccacctactcgggaggctgaggcaggagaatcgctcgaacctggagggcggaggttgcagtaagccgagatcgcaccattgcattccagcctgggcaaaaagagtgaaactccatatccaaaaaaaaaggggggaaaggtcagaaagacgttctttttcactaggtgatgaattaatctttcccatctttgtcatgttaaaaatgtgcctgtggctgtttctccactaaatgaagacactggcacacagatgattgtgtgtaaacactaggcaagacactaggcacaatcgtaggggttcagtaattattgaatgagaagaaagaaaggttgttcttgaattctgtgatgtgagtgtttaatgatgtttttgaggagaatgccatatgtagcagacagaaccctgggctgggcatcagagggaccgggggcaccacactgggctttgtgtcattatctccagaaagtaactggcctggtgcacaggagaaagttagagtacattgtccatacagttcccacatagctgtagggttttatgaacccatattttaaagggccttctaatgaagtgaggatgttaatgcttttttttaaaaaaaaaaaaaaaaaaagagagagagagattggtgattactttaaaatctgagtcctggccaggactcacgcctgtaatcccagcactttgggaggctgagacgggcagatcatttgaggtcaggagttcgagaccagcctggccaacatggtgaaatcctgtctctactaaatacaaaaatcacgctcctgtaatcccagttacttgggaggctgaggcagaagaatcacttgaacgtgggaggcggaggttgcagtgagccaagatcacaccactgcactccagcctgggcaacagaatgagactccatctcaaaacaaacaaaaaaatccaagtcctaattatcgctgcagctttctttaatgtgtgcagtaaggtggggacatacagaataacttaagatgtagaaatcgtctctccctccctgaagaatatcatggatactacatttgcctgccaggaatgttgtgttgttctggtgttctcgtttctgccgttatcattgtttctgcttaatttttacaacacaactctggccgcacccgtggatgatcatggaaaggcagctgcctggctttccagaattgttttgactctccatctgaacccagagctctgtttcctgtacaggttgctagcagtatttacccaaattgtcccttcccaactcagacccactgacccttcctttctcagctgattacgggtttaagtttgaatcaaaccatgctatagaatcactatctagcagcttctgtgcttgcacaataagagtattagtcagcgtttcctgttttcattcatattgtaagttgaatagctgtaacaaaagggaaagagattgccaagacaaataattcttatggcttgtgcaaacaatttattacaagccttattaaatatgcagctttcagaagtctacgtgatatgcctttcagcaaagctaaatcctactatgtggacttgcttcatgacttaagaacaagtctatattgaatttaacattaaataattatttggcctgtatctcttttaagctttgttaagaactgcaaatatgataagggaataaattgctcatttcaagtcactaagaaaacctaacctataggttatatatgttggcagttcccaagaagtacctaggaaatggaaccttcctataagagtggtttgtccccttctcacgagatgggtcttcatatcaaggccccctaaggcacagatacacagcactccacagtgtccaagttcgtagtaattggtggcaccttattaaagtagtttttactttcataattactgattacacatcagcataccttttccatgttctgtttccttggcagcctgatatttgaatacaaacgacataaaagtgattacatgcagcatttcaggacagttttcaaactgagagaatttggcactttcttttattttcttcccattcttcgtctatttcctttgcatttggaagccaaactcctcgaacctttacttctgcatgttgttttcgtcccctagctagagttctctttattactacttttttgtttccaattggtctctttttaaaaataaaacatggtgaaaccccatcaatacaaaaattagccgggcatgatggcgggtgcctgtgatcccagctactcgggagactgaggtgggagaatcaattgaacccaggagacggaggttgcagtgagctgtgatcgtgccattgcactccagcctgggcgacaagagtgaaactccgtttcaaaaataaatgaataagtaaattaaaatatgaaattaagcttagctagcctgtgtagatgttttagatggtcatatctttatcggatatgacatttatgcctttcagtaaaaccattgtagtattgtaagaaaaaaagggaagtatgatagggaggactaagaacatatttgtacttctatgtaatgctattttatgtgtctatttccattgaagtgtggccttgacatcactggctcccaagtcccatcctgttttttcattgacctgcttgtgccaggtactgcgttaggaagtggagctaccagatgaataaggcgtggtcccgccctccatgtgggagacggcacgtcagtgtacttaggatgctgcatgtggtgacagatgagggccctgcaagggagcacaccacagggccgggagggtgggatgggcgggaggagtagccaactttgcccgaaagcatcaggacaagcttccaggaaatggcacatccaagctgagtcttggacagcgggttaaagaggcagagaggggagagaggaatgttccacatgggaaaagaggtctggaggtgacaacaagtaacatagagtatgtgggctgtgccggaagcttgatattacagaggcacgaagtctgaggcagggagtgtgaaggaagatgaaggtaggggaaggaagtttacacaagggtggccttgacttttatattaaggcactttagggaagcaggaaccactgaagacaggagaacatggtgactacacgggcgcattgaaggggggaggagctaggtttttgaagggaatttgagcttgcaatttttcaagggcattcaatggttataaatgaaacttttcattaatatatttgtgtccaagtgtttttagatgtgcttttctgctactctctttttatttggtttggagatagatggtgactttccttcagtgccttctatgtgtcttgacatgttaatgtctcaaacacatggtccgtatcatcatggagcttgcaatctaacagggtagtttaacacataaatatgcatccagttggaaagaacttagagatcacttgatcagcccccgttatgtaaaatgtatgcaacaatctacctccaactatagggcgacattaaacagtttttcaaaataccatggcattgaaaaaaatgcgtaacatttgggttacttcagtcccactccccggtactaatcaggccagtgaaccagtcttgctggtgaaataatgacttctccagtcatgatggatgatttcccttcatcatgaccatttcttccctggctctgcctttacctatgaatctcttctttcctccctctccttcctcctcttggtctctgcctgccatacccaactccacatttctctgcttggaaaaatcctacttgattctcagagcctgactccatcaccccctctctccaaccctcccaggcaaactccgtccctcccagtgtgccgccctccagctctctctagttgaatagcagatgttctctctcccacttccctgcagggcttcagggtagtgaccctaagagtgagcttctaccagtgagaaaaacgcctggatggagcaggaattcccacaaatgcttaggaattcaatatgatttttagcaagtgggagaattatccttttggttacaaagatgtgaactatttttgtgagttctcagtatgcaccaagaaaaaccccagtgactcagtaatgtacctgtgccgtctcacttaacccttccaacaaggaacttgccaaggtgcacagctgggagggatccggggtcccgtccgtgtgctaacctgcaggacagcgccgcataatccagtactggggccttattgtccagccttccacctccaggagcccactcagtgatgacttttgacaaaagtcacccggattatccctcttttggggtccatgatgccaccaacggctaaagttaacaaatgcattaccaggaggtaccactgaggtaaggattgttactgtaagtgattttctctgattttgaccactacaagtaaaatcacaagatttgtcccaaatactatataaagaggaatgtcttttatttctcgaaattgttctgccactttgtttgttcaaataacacataataaaggataaatggcttgtagctatatttatccaaattgaacatttttgatgtaatttttttaatttgtcaaaagcatatcaatggtcataaaaattttttatgtcctctggccctattaccttacccttgggaatttattccaagaacgtaatttgaaagagattaaagcacataggcacaaatattttcagtgcagtattgtttatattggaaacaacccaaatgttcagtaacagggggaacaattttgtaaatcttgctacagcaacttaacaaaattataagctgccacttataattgtaaattttgaaagtttgtagcacagcaaggaaactgatcatgttaaatgtttctgatatcttagttaatttttctcccgccagttccgatcggtgtcctggtcataccgtcagcatataagtatgtatttcataaacatttactttgtattaactcagtagtattcccttcctagagtggtttgcttcccagattgtaatggacaatcatctcacctggggatcttgtaacaatgtgattctgattctgtaaactttgtggggagcccaagattccacatgtcttagaggctctcagatactgctgatgctgttgatcacgaatcacgcattgagcagcaaggtcctagagctctttgtgtatgaagaagatactactgacccagtgcctcgctatcttgaaaggcagctgtgacctttctagcaactgagggggtggggactagaaacgagtgttttctggtgtttctctaataaagctgctgtcttgtatccagattgaccatcagtatccttatgcccttcaactaacttgaaatttgtcagttaacagaaattactgggtggcactaaaataaattattcttaatataaagggtaagaaagggtcgggtgtggtggctcatgcctgtaatcccagcactttgggaggccaaggtgggcagatcacctgagatcaggactttgagaccagcctggccaacatggcaaaaacccgtctctactaacaataaaaaaaaaaaattagccgggtgtggtggtgggttcctgtaatcccagctacttgggaagctgaggcaggagaatcgcttgaacccgggaggcggaggttgcagtgagctgagattgtgccattgcactccagcctgggggacaagagcgaaactccatctcaaaaaaaaaaaaaaaaaaaagagtaagaaaggatcttccattgtaatcatactatcattgccttttgaaacaatttggaacctgattacaaagttgaaaatccccatctgtatgaagaaaagcttcactggctggtcaccttggctcaacgcctgtaatcccagcactttgtgaggctgaggcgggtggatcacaaggtcaggagtttgagaccagtctggccaacatggtgaaaccccatctctactaaaaatacaaaaataaaaaattagccaggtgtggtggcaaacacctgtagctactcaggaggctgagtcaggagaatcgcttgtgcccgggaggcagaggttgcagtgagccgagatcatgccgctgtactccagcctgtgcgacagggcaagacaccatctccaaaaaaaaaagcttcactgtgagttatgatatgggaagaaaagtcttggcctggccaccacaaggaatccctcaggcctggcggtgggaagcagaggagggcgcagtctctttagggcagaaagtgaagaacatttctatgacaatggggaaatcagttcacctttgtgttggtaaacaaaaggaatgtaagctgtcctttgagctcgaatcatagtggtgattgccaaaacctacctttgtttttagaagataatagcacatattccacttgcttccccacagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaagtgcccacaccgccttcctaataccaaagaaatttcattatgttaaaacagaattgagcatttgaaaaattcctgcccatttaatgactatagttttctagagtatttttcttaaaactttttttttcctgtagacctccctcgtggacatctaaaacgttttttgttttgtgttgttttttgttttttcccaacaccaccatagggcactttgagtttagtaagttcgagtaaacagtaacacccacagttctttctaaacaatattttggaaaggagcataatgcaaccactttttagtctcaagcttcacatctgatactcaggccaagattgtataaccatatggtaatgggaggttagaggctcttgtccctgaacgaagaacaagaggattagagtgagttctttgatgacagagatttttcattgtttgtacagatagtttttcggttcactgatgctgcaactcatcagatttcatctaaaactattttccttctctttctgtttattatgatttctcctcacaactctgttataatactggattgtttctaagagctttgcttggaaaacacaaattcgattttaacttctttaaagactttttatatttacctatcctaatatatatagaaattacagacattataaaggaaatatattcctttccacagaaaacctgtgcatagatttttgggggtttttttgttgttgtttgcttgtttgttgtttttttgtttcatttttaggaatttccaagtggagaataagacattttatactgattaatcattttgaaataaaataaaatttctctatcataatattcacatatgagacgaactgccaaatctgatttcttaattggtatactgtactgtgtatgtgacaaaagtcatatattcaatgattattgcatagtcaaaacaagtagcaggtttgccatcatgaaacgctgtaaagcaattctttctcctgggagaggtggacatgatttttataccattttacagataaggaagctgagttttgataggcttagggaatatggacaatgtcagcaggccagcagagagccgagaacttcagatctaaatctcctactatgtccaccatgcagagctggatgttaatgaagggcagaagttttctaaatccaaatccactcctaatacccgacacttaagcacttcatttttgcctaaagcttcatcatcatttcaaatgcaagaatgatataatacagattaaaagtagtaaatcataaagaattctgacttcactcaaaacaccccttgttgctacagtccttcctggattttagacattgaatctgtataacaacttctatttttaaaaactacttccgcccatgtaggatgcatttggaattctccctccctgccctgccaccctgaaaattatagaaagggcttagagattgtctgatctcattcagtctttataaagagaaaatctctgaggcacagggagacgcagtgacttgagtggtgtcacacatctatttcagggactgatcagatctacagtcctggtctcttgacatcagtcccatagttttccagactctggtctctgtcctgtaaaaattctctacatggtttacaatcctatttcattcatcttaacatatgtgctctgttattcagtggttgcactttcgtgccacattaatcctttgtgtctcttccactgctgcttaatgtcatggttctcagccagtgatcatggtaacatggaacagggttagtaggcacagatatgggtggaggataagaaaaggtggggaccagccaggcgtggtggctcatgcctgtaatcccagcactttggaggctgaggcaggtggatcacctgaggagttcaagaccagtggtggcgggcgcctgtaattcccactactcaggaggctgaggcaagagaatcgcttgaacttgggaggcagaggttgcagtgatctgagattgcaccattgcactccagcctgggtgacaagaacaaaagtccatctcaacaacaacaacaacaacaaaaaaaaaaaaaaaaaaaaaaaaaaaaaaaaccagcagggaccaggaagccctgtgaagctaggcatccctctcctgggctccagtagtaccttctgcctcacattgtttcatgaatgccttgttctgtgtctccctatgtaattctcaattccttgagtttagggactgtgtcttattaattggtatggtccaagtgtctggcatggtctatatgcagggagtgttttcaataatggcaagataaatgaactttcatcctcttaatcctctattccatagtgctcatctcggtgtccttccttcatattgaatagctctgtatttttgaaccatgattattcatttctacttctgttttcttttttcttttttgctacaaatactgcgctgggatcgacttccttttgatcattacacaaataaccatggctgcctcttatgtttattcagcttgttttttttccataatttgtacagtggaaaatcttgtggcccttgaatttgcccattttaaatttgccctcagtcattttaaactcacatcctgtcccccagagtgctcggccattcccagtgcaatccaataactaatattgtgctatgctttgggatccacagattctttcacaattagatctttaaactaaccattgtatgaatcagcattcttcacacatagaaccaataaggatgtgtgtatatatagagaaagatatttattgtaaggaattgggtcacatgattacagaagctggcaagtccaaaatctgcactgtgggctggcaagctgaagacccaggagaggcagtggtgctaatgcagtctgaaggcagcagtctgctggagaattctcctgctctcaggggaggccagtctttttgttgtactcaaaaaggcctttgactggtcagttgagacccacccacattatgtaggacaacttgcctactcagaggctgctgatttccatatcaatttcatcatagacaccctcacagaaacacgcaaaataatgtttgaacaaatactggacaccctatggccccagcaaagttgacacataagattaaccacaaggccaggcacagtgtttcaccctgtaatgccagcactttgagaggccgaggtgggaggactgcttgagcccaagagttcgagaccagcctggggaagatagcaagacctcgtctctacaaaataataaaaaattatctgggtgtggtggtacacacctgtattcctagctactggggaggctgaggcaggaggatcacttgagcccaggagtttgagaccgcagtgagctgtgattgtgccactgccctccagcctggacaacagaactttatggcaattaccgtaaaatgatttcgaatggtgatgtactctgtataaatcaagtattaaacatattattagttttatgttctaatttgaaccaatgtttgagaagtttcatactgttccattggctcaaattagaatcatccagggagattttaaacattactgatcccaggttcccctcccagaacttctgctttcattggtctgggtggagcccagggatcagtgttttctaaaagcttcccgcaggagtttaggtttagccagtgctgccagctactgttttaaaagcacaaaacatagaggtacatttctaaaaattgaatgtgattatgttgttctttctttcagatcggttgtgtaagcatttttataggattattcttcatgttttctctccttatttcaggtaacggctggtgttcctcttaagaaagaatatacagaggaggtaagaggagctgtttagatgcttatgtgaagaatctcttaaatccagtgactcgttggctttcagtgaatgagccctccttcagtggcctcttagaaaagtgctgttctgtccgggcgcagtgactcacacctgtaatttcagcactttgggaggccaaggcgaccggatcacatgaggccaggagttcaagaccagccaggcaaaacccatggccaacatggcaaaacctcatctctactaaaaatacaaaaattagctgggcatggtggctcacgcctgtagtcccagcatgagaatcgcttgaacctgggaggcagaggttgcagtgagctgcgatcgcaccactgtactccagcctggacgacagagtgagactctgtctcaaaaaaaagaaaagaaaagtgccgttctaagaatccgagaggaaatggatgggatgaaaggataaaattcattcagttaactcttaaatatcaagaaaagatggatataggctttgtctactattgtgtactcccagggtagccatcagagcaggaactcaaggtctccaggtcagaaacaaatatgaagcttacacttctgtattcttttgtcatggaaggtctatatacagttggctttatgatttacaggagtggcttactcttttctgtaaatagactttgatttgctggcagcagtacctcttagctcctacaggtggcgccagggatctgagccaggaatacctggtcagagctcctcacccacctggggccttgtgcctgtcaggcctcaacctgcagagcatgggcgcattgcatagaccctgcagcctgtcctcagcagggtgagctgccaggcttcagacccacccatatgccattggatccagaatcattttagaaattattttgaagacgaacctctttattcttgcagccatctttcttggaggaaaaagtgaaaaaagatgtagcaaatcctgccagagaggtgctggcagtttagcttggcaggtttggtgggagacaatacacaggggtctgggttttgcttttttcttttttacagaacatccagctggtggcagacggctgctgtaacctccagaagcaaattcagatcactcagctctttggggttcccgttgtggtggctctgaatgtcttcaagtaagtccagcctcctcctttaaatgtgggcattatcactaggccaccctgtgaacgatatttgtgtcttggggtatttggtctttctgtgcttcatctaaaagtatacagaaatacccagttctttctgtttgtttatttggtttggtttcattttagcaaatgtgttctcacaatgttattaaggaagtgaaatttatatatagtgagttactatctccttggcttttttttttttttttttttttaattctacccagcatttttgtctgaaacaaactgtgaatgatcaaagggatatgttatggaattttcttgataacacccttaacgacttgaaatatttgagtcactttagagaggactttttttttccatgctttaagtctgatttatttaaacacgatgtgaccacttttgatgtttaaaatgtattcagtgttagggagcgaagttctgtataaatggtgagtctttctttgaaaacatagctaaatggatacagatgcaaaaccacaaacattttcttcactaggaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggtaagatctagtaaaaacaatggctcacatttcttacaccttagcatgggttgtcccattctgttgtcaccacaaccctacagataagaaaactaaagatagaagagtttaggcccggtgcagtggctcacgcctgtaatcccaacactttgggaggctagggcgggcagatcacttgaggtcaggagttcgagaccagcctggccaacatagagaaaccccatctctactaaaaatacaaaaattaggtgggcatggtggcgtgcacctatagtcccagctactcgggaggctgaggtgggagaattgcttgaacccaggaggtggaggctgcagtgagccaagatcgagatcacaccactgcactccagcctgggcgacagagtgagaccctgtctcaaacaaacaaacaaaaaggtagaagagtttaagccatatgacaaagtcacatttccaagtacagaccctagctccttgtcccaaagcctgtgcttttgaagactcccaaatcgcagtcctaagtgaggaggtactttagcgaacaggatttgacagctgacgctttcaggagttgcacaggaacaagagcaatttcgtgaggattgggaaaccatgggaggtattttccttgttcatttctcttttttttttttgagacagtctctgttgctcaggctggagtacagtggtgcaatctcggcttactgcaacctctgcctcccaggttcaagcacttctctgcctcagcctcctgactagctgggattacaggcacctgccaacacgtctggctaagtttttgtatttttagtagagacggggtttcaccatcttgggcaggctggtctcaaactcctgatctcatggttcacccacctcggcctcccaaagtgctgggattataggcatgagccaccacacctggcctctgcttgttcatttctgttatggttcttttctcttgtggttttattgaactatgtctagtgtatgtgtgtgtatatatacatacataatatatttatttattttcattgtggtaaatatatatataacaaaatttactatcttagccttttttttttttttttttttttgagacagagccttgctctgttgcccaggctggagtgcaatggcgtgatctcggctcactgcaacctccacctcccgggttcaagcaattcttctgcctcagcctcccaagtagctgggactacaggcgcaagcaagcgtgcctggctaatttcttttttattttagtagagtcggggtttcaccgtgttgcccgggctggtctcgaactcctgagctccggcagtccacccgcctcggcctcccagagtgctagggttgcaggcgtgagccaccacacctggcccatcttaaccatttttaagtgcacgtcagtagtgttaagtacattcacattgtcatgcagccaatctccagaacgcttttcatcttgcaaaactgaaactgtacccactgaacaactccccatgcccctccctacagtccctgccagctaccattctccttcatttccatgaatgtaacaactccagggacctcatgtaagtagcatcatactgtggctggcttatttcacttagcataatgtgcgtgcatgttgtagagtgtcagaatttcccttcttttttttttttgagatggagtttcgcttttgttgcccgggctggagtgcagaggcaccatctcagctcaccgcaaccttctgctctcgggttcaagcaattctcctgcctcaggctcccgagtagctgggattacaggcgtgcaccaccacgcccagctaatttttgtatttttagcagagacagggtttcaccatgttcgtcaggctggtctcaaactcctgaccttgtgatccacccacctcggcttcccaaagtgctgggattacaggtgtgagccaccgcgcccggccagaatttcctttatttttcgggctgaatacgctcccattctttggatatcccacattttgtttctttgtccatctgtggatggacacttgagctccccctcacagctattgtaagtaatgctgtatgagcatgcgtgtttatggcatatggcatatgtacaagtatcccttcaagaccgtgttttcttttttttttttttttttttttgagacggagtcttgctctgtcgcccaggctggagtgcagtggcgcaatctcggctcactgcaagctccgcctcccgggttcatgccatgttttcaattcttttggaaatgtattcccagaagtgggattgctgggtcctctaggatatttttaagcacatgtcgatggttcagtcagaagacctgagcttcccagggctcactctcctcctcagatcgtctgtctttgcacccgtctgacatctccattctgaattttgtggttccgattctggctgatggatttgtcttcaggggtagtgcatgattgtggagtgcccaggcttcaagctgattgctgcttctcctgttccttcatccctcacatattctattgttgagtcactcagatgtcacagacactcttctttcctgttcagtggcataaatcaatagcataagtgaagaagaaatccgtgaagcaagagcttagcagcgttgttgataagcctggagtcacagtggtgagagaacggggctgatgtattaatatttaatattaccacagctctcgcttttaaggagttgtttgtgagctgggtatatgggcgctttgcacatgttcacctctttggtcctaacatccctcttaggtggaaactggtgatatcttcccattttacagacaagaaaactaaagcacgaagagactaagtcaactgctcagtgtcccatagctaggaagaggcagagctgggagaaagaatatccagatggttgaggtcatcaccctgctctgttcttcagagctaagtactgtgctcaaaagtgtgtgtgtattggaggtctggggggagacatagttaaaggggacagtgactgagtgacccccctgaagagaaagggtgacagtgatgggcataggcacagattccatgccacacaggggacatcatcgctggcacgcagtcagtgtttacggaaggaaggacacagggaattaattggaggctagctcataaaaggtttttcatttttatgaggccattttgtgaatgaggaactagaatattctggactacagaggcggtagagatcaattgagggagaagattttggatgagtgaaaagaaaaatgttccagttggaagctttgagttctcagacctagaggtgttcagcgcaaaatagatgtagccctgctgtgggcaagtcagaggcattgaagccaactcagatggcaggtggccaaggagaccctgggttcctgttctttggtcctgggtaaggcttgccagggtacctacaacccttggcacatgccagagcctttctacataaaccactgtagggagagtcacccccagatcctgctgtgagtgtgcctctgatcatgccatctgatcatgccatcttgccgtctgatcatgaaccaccccactctgcatagcaaaggcagttattttcatgaatgatttcacaaagtgcggctcttttcaaggaaaacatcccaggtgaaaaagaggtcagtaatcagaagaaatgcttctgagttatgctgtctcagacatgcactaaccctaacatgaacccttttcctttccactgatatttcaatttttttttctgaattcccattcttcatgcagataatgctgctaaaatgtcagctctcttctgaaaggaggaaaatgtttaataataatgtggtctaaagtcctctattgataggcgacctcaaggccaggatccctgcctcctttgccaacacacttctcgcttttcttgtaacagaaattcgatttgagctgcataattgtttgttagataatcagcctcccagcctactgcagcatgacagttcatgaaaagagctgctgctgctgctggctctctttgtactgtctgcctgttagctgtgttcctcacaccagcaagatttagatcatctaagaccatttacagtcttgtcttgtcaccatgtaaaaatctgaattcattggtgcagtcagtaatagagctcaagccttctttgccccggatttcttgcattgattggtgctggtaaaactttagtaacttaagtaatggttttctggaagccctttttacctcccctacaaccccacaccctcacaaccaacccttgggtgctgggcagtgagaaagatatggcattgctctataggagaaagaagttataaatgctttgcatatgacactctcccacctttgcttctcaaagcaaactgggtttctgtgtgccccttggtgtctccccagactttatatccccaagaatgtattcagtacaagactaatggcatcttgtgtgctattctttctccaccccagtcttgtggaaggaaaacaccggagatgatttagggtaatgggaaatagtgctagagcccagggcatgactgcatttgaatgtgaagtagaaattgtctcggaaccccactggagagtgattcagctggagagagtggggcacctggctctcagaggcactgtgcggccagacagcagtgtgctggacttcctaatggcgagctcacaggttaagtgagaaacaggctgcacttctgacttgggagtctctgctgaactttatagaaaactgacttcagcagcaactgctgtctagagaacaatttggcatctctttttgccagagtaacttctaactcaagagtaggcaacttttaattatggtaccggatggaggcagcaatgaataatttagaataaagattgaaaaatatggaataaggtgtagtagactaattgctcagaagaagttttattgtgtgaaaatgaatgtgtttaaacttgaaatacagaggatcatttcctctctacccttgagggtgattgcagtcccttttaagaagctgttaaaagtccccctcaagatcatcttctctttgaattttcctttctaatgtgacttttgacaattatatctttatcgttcactaagagaatatctccatgtctgcagggatgcagggaaatatgatggctgaaagaaacgctaatctacatgcgcactttattagctaagaaatccctcctccatacgttcttccaggcatgcctccgcacatcccatctgctatgtgggctcaactctgcattatagatgggaaggtgatggacttgtccataagaaatggacgcttgataggagaaggaacatattacatagagctaacaggctaaagctttgggatcatgcaaattaagtttaaaccttgagtaggcctcctactgtggacacaatttggggaagctgactaatctctcgagcctcagcatcctcatttgtacaatggtgtctgacagtgacaccaacttcaccaagttgctgtgagacccaaatgaaatgccccagagtaaaatgctggaacatagaaagcaggcaatgaaggccaggagtggtggctctcgcctgtaatcccagcaccttgggaggctgaggcaggtggatcacctgaggccaggagttcgagaccagcctgggaaacatggtgaaaccccatctctactaaaaatacaaaaactagacaggtgtggtgtcacgcacctgtagtcccagctactcgggaggctgaggcaggagaatcgcttgaacctgggaggtagaggttgcagtgagctgagatcacaccactgcactccagcctgggcaacagagttagactctgtctcaaaaagaaaaaaatggaggaaagtagtcaatcaatgctggttcttcctcctgtcatgttcacttggaaagagagtgggcctcctgaattcaccttcaagaattctcctgtaactcaaggtaactttgtcaaactccaagattggtttattttgctctgggttaaaaccaggaattagaagtcaagtctcctaaagcactactgaactaaaccaagacactgacgtttttccttctccgtgagaattgggagcccttagtgatatcataaaacatcagtcatttttgcaaagaaggaggtatgacccggagaagtcagcttgacattcagtcggaatattgtttgttaaatgaggagttaaggttgaaaatcatctctgtatccttcctctagccttgcaaacattttaaggtgtagccttgacagcaagacaggatagtgtttgtttttattaaaaggtctttcctgttccttgcgtgaagccattctcttgatcccagtgggggctggatgaaggaagagcaaaacaaaccacgaagacagcctggagccgcagccagctctgctgacttctgaacttcacgctctcactgcccagatggccaggggtgtttcctcctctgctggtcttttttaaggcaggatgtttgttgttattgttgttgtttttctggttggttcttaagaaattattttctacatcttgaaaatgccagctggaacctacaccagttgttggtggggtgtgagaactatcctttacatggacttggagcatttgcaactagagcctccacattgaaataaacatttaaaaatgcatatctatggatatacagtgggggatcttccattgtggtaaaaatatgtataacatacaatttcccctttaatcgcttttacatgtatagtctgtggcattaagtacattcacattgtacatacagggtttaattaataggatcttaaaacttaaaagggtattgatgcacatctctgttgccttttacatttcacagtaattagaagggaaaaaacacactctaggttgaaaggctgtcctttcttttggttgtccttgtccctggaaaagctgtcttccccctcagggcctttgacctcccccggctctccctcccatcttcagacacgcccagggccagcctgagtcagtagccctttcttcagcgctccctcttctcctgttgtgcattagaatgtttggagtgttctgtggaaagctggtccttacattttccagtcagttatgcatctcactcataaacctgtttcttcccccatgctctttaatattctgctttcttaattatggttgagctgcctttaaacagtcttagattgttcaatgtgagtggcttcaacaagcctcccataagcctcttatcccctggccccctttccatgatccaaccccaaatctccagataccccctgctttttttatgtttttttgtttgttggttggttggttggtttttgggttttttttttttttttgaggcagagtctcgctctgtcacccaggctggagtgcattggcacgatctcggctcactgcaacctccacctcccggtttcaagcaattcttctgcctcagcctcctgagtagctgggattacaggtgtgggccactatgcccagcaaatttttgtatttttagtaaaggcagagtttcaccatgttggctgggctggtctcgaactcctgacctcaagtgatctgtcctcctcagcctcccaaagtgccgggattacaggcatgagccactgcaccaagccccggatacctcctgcttgaccagaccttctgcaaacacaccttagatccctctcaaatctagatgcttctccaacactggcttctaggttctttatgaaacctctgctggccggcagtatataacccaccacccagcctgccaggcacgtcattcagctgtgttagacagtttcgagggatctgcacctgtcatgagcactggcccaaccttctcaaagcatcccactcatccctgtgattctggcaaagcttgccccagctttctttcctcgatggttgaaatagcacccaatgagaaaaaaacagtggcctgtatttattatacttacacatgtcacaagaatccctgtagtgtcattgaaagctttcttctagcatgcaaaatgattgtcactatgatgtaagtttctagaaatgccttatttcatctaaaattatgagagaaggtaaaatgatgaactatcaaagtcacactacatgttggccggctgccttctaccactcactccatccctccccaggctttctgacttaaatttagatcacatgagaccattgcagtggagagagtgtccactttctcaatctaaaagcaagctcgtgaagaccattaaatatgatcacaggaacaaacattaaaggtaccacacgtaatggaccacttaagacagaaaactacgatcttagggtttaggggaaaaaaacactcaaacagcacaggcttccagtctccccagtctctgagaggttgggatttttttttttaataaagtacaagggctccttgaacatgaacacggaacgagcgttgcacctgtattcattcatttcgctcttgtaacacattgatgttcctaagtcagatttgtagaagaggaacgagcagatgcatcatgagaacactgtgcttggccaggcgcggcggctcatgcctgtaatcctagcacttagggaggccaaggtaggaggatcgctagaatcgaggagttcaagactaacctgggtgacatggcagatcctgtctctactaaaaatattttaaaaattagccaggcatagtggcacatgcactgtagtctcagctactcaggaggctgaggtgggaggattgcttgagcttgggaggcagaggttgcagtgagccaagatcaccccactgcattccagcctaagcaacagagccaagctcaaaaaaaaaaggccaggcacgatggctccctcctataatctcaaccctttgggagactgaggcgggcagatcacttgaagtcaggagttggagaccagcctggccaacatggcaaaaccccatctgtactaaaaatacaaaaatgagccgggcatcgtggtgcgtgcctgtaattccagctactctggaggctaaggcccaagaatcacttgaacctgggaagtggaggttgcggtgagccaagaacatgccactacacaccatcatgcccggcctgttttttttgtgtgtgtttgttttgggttttttttgagcctgggcaacagaacaagactctgtctcaaagaaaacaaaacagaacactgtacatgagtgttcctgggcccagcagagtgctcgaaccagtcagcactttgccctcttttgggtgagatgagatctttaaaatcacttattcccatatattccgttttttggcattgctacactattctatttgagagtaataaaagattacccatgtggatttcttactatttcatgtggagaaatgcagcttttctagcggcgagcctttcttccatttcccagagtccggttaccctcaccgcaccccaggtttgccgtagaaggatgagattccctacatgtaggcgtcttcagagtgaacctgttgctcagggcccgcgagcccacagggctccatgcccactgagcaggctcgtggacgtcggcacgtagctcagatgtgctgatttccagccaaggacatgctttgtgtcaacgatacaggggcctgttgttctcagtaacaagggcagagccgctcccgggactccagttggtattggtaatgcaagcccttgcacctagtgtggtgtggtcagtataaattaatatcgacagcttcatgttgtactttaatttgaagtacaggaaaggctgcttgccaaactgtatttgtagatcatttaaaatttatgcttcatttaaaatgcaaaatacgaatggaaataattactgtgtatccggaaatgtctattcaacttacaagtttattaattgatccttctctttacatgttttacgggacttggaatacactttgctaatatcacagcataggaagatttaacccatatgaattcaactctgtagccttggtgaaagaaaagaaccatgtatttgtcattcactgtggcccccgatgtatgccaacgacttcatttggtgcagggctgaagaaatggcagtgtgttccaatacttcacaacagtggggcctcattaagagatgctagggtattgagagtggagtgttacatagtgtttttcataggtcttctaaaagatttttcagagttgctgacttaagaatttggcctctgagtaagatgagacgcccctactacgttataaagccttcatggatctttatttctaacagttcatttttaaacttttgttccatttcattttattttgtccattttttgtcatcaaaaaattattttaaaatgtaacagctcttctagaatgtacagatcaattttattccactaaaaaacaggacttcaataatttaattgaagaattctagtgagcatttccagagcctttccaagaaagctatactgtttaactttgagtgactcagcttctaggaccctggtccaccacacctacaaaatgaatttaataaagcatgaaggtcaccaaatcctctactatttcttcgtggagtcattcagctagtgtttatgttgtgcctgctctgtgcgagagactgtgccaccaatataaccactggtcacagttattttctagagccatactgcctgatatcccatgtggctaagattgacagttcagtttctggattgttccagtcccatttccagtgcttttaatagccacatgaggccagtgaacacacgatacatcttccattgtgatagaaagtggcagtggacagctttgttctagagtatttccgtttctgaaatacatgtttaagaagtttggaaaggaattagtgtagagtatgagaagggttacatttttggtgaatatgaagatttaacataatgttagttcaaaaatgaccaaagacacaagtgtagacaccaggcttttgaagtagctaatatgttaagcagctgtgcattatatagacagaatattcactatgtcccactcagccctgtgtttgacaccatttcaccttggcttctgcctttctttcccttctttgcctattgagatttttcctgtcctttctatcctttttttttttttttttttttttttttgaggcagagtcttgctgtgtcaccaggctggagtccagtggcacgatctcagctcactgcagtctccacctcccgggttcaagtgattctcctgcctcaccctcccaagtagctttgactacaggaatgcgccaccactcccagctaatttttgtattatttaaatagagatggggtttcaccatgttggccaggatggtctcgatctcttaacctcatgatccgcccaccttggcctcccaaagtgctgggattacaggtgtgagccaccgcaccaggcctcctgtcctttctttaatgcactattccagctttttttttaatatcttgccagcttttgctgattttcatgcctccctctgcaacctgtgatctcttgactttaatagtaatgtttatacagagtcttgactgcacactctcttctgtcatcgttgtttgttgtgtctcattgtccccaatccatcagaagttcttggtacacaaagtccctgaagctgtatgaacaatgccctgacgtcttgaaaggacttgccataggtggttatttgatcacttagcagatgcctttgggatcctactttgtgcaggccactctccaaggcacaatgtggcaagtaaatatattagtcaatatttacagaaccaagagaaagccagcaatgattaatgcataaacagtcataaattggccattttatttgtttataaaagctatcatttactacagagaagtacaagtgaatatcaagctcagatcaagacctttggactgagcttggctttttttttttttttctttaaagattacacttctcccccaaatcaagcagattaaccataggaagttccttgcctgctaacagaatataaatagattgcatgcaaggggaaggaccttatcagggcagattttagtatttacactaaacccaaaagattatttccttaattgtacttgtgagtgaaaaacaaaaattgtagcaggagtcccaagagcactctggccatgggcttttgagctgtgagttgaagcactttattcagcatgtggctgcagggttgtagctcaggttgtagacagtgcattctcttcaggtcccaggaaacagtgtcatacctgtggaagccaccagaatgcaccttcatcttctccagtggtggcgaggttgaggccaagcatcagaagtgctgagtgctgggaaactgtggggctggatagatggcagtgcctgctgggaagcacacagccctgggttgaggcagggaagcagggccgcccagttgggattcattcgtactactggcccctcacagtaccgtcatgtgtgggtggtcgcgcttgtcctacaggaagtaaaccacaactactcatctcacacagtcagcccggcacctccttggaattcccaaaacactttccaataaacattggaaaggaagaaagtttagttggtaacaaaaaaatgtatgttgccttacgcccaaaagcattgaaagcagggactcaagcaggtactcatgcagccctgttgatagcagcattgttcccagtagctgaaaggtgggaacccccttgtctgtcagcggggatcagctaaatatggcacacacatactatggaacattattcagccttgggaaggacacctcctatcacacggatgaaccttgagaacattatgctaaatgaaatacaccagacacggaaggacagatactgcttgattccacttgtaggggcctgtagagccgtcacattcatagacaggaagtagaatggtggttgtcaggggccaaggggaggggcatggaaagttgctgcttaatgggtacagtttcagttttgctaaatacagagagttctggaggttggttgcccgacaccataaatggacttaacgctactgaactgtacacttagaaatggttaaaatggtaaattaggccaggcatggtagcttgcggctgtaatcccagcactttggaagtctgaggcaggcagatcacttgagcccaggagttcaagaccagcctggacaacatagcaagacccccatctctacaacaattttagaaattagctggtggcttacacctgtagtcatagctacacagtatgctgaggtaagaggatcacttgagcccaggaagttgaggctgcagtgagccgtgatcacatcaccgaactccagaatgagaccctgggtcacaaaaaaagaaaagaagatggtaaattatatgttatgtgtacgttaccaaaattaaagttcttaaaaatatatattttaggccagacacagtggctcacacctgaaatcccagcactttgggaggccgaggcaggcagatcacctgaggtcaggagttcaagaccagcctggccaacatagtgaaaccccatctctactaaaaatacaaaaattagccaggcgtggtggcgggagcctgtaatcccagctgttcgggaggctgaggcagaaagaattgcttgacccagaaggcagaggttaccgtgagccaagatcgcgccactacactaccagcctgggtaacagagtgagactctgtctcaaataaataaataaataatatatatatacatattatatagatagatagatagatttcttacaaaacattttcgtgtttaaaaataacaaatcaggccaggcacagtggctcacgcctgtaatcccagcactttgggaggccgaggcaagcggatcacctgaggtcaggagtttgagaccagcctgaccaacatggtgaaaccctgtctctactaaaaatacaaaattagccgggcgtggtggcacatgcctgtaatcccagctacttgggaggctgaggcaggagaatcacttgaacccaggaggcagaggttgcagtcagccaagatctcgccattccactccaccctgggtgacagagtgagtctctgtataaaaaaaatttttttaaataacaactcagccatccactcgcatcaatttattcactagtcattcgattgctattactttgctcccatgtgagttttttaaattattaacagaaaaatcacactctttatttttgaattatgatcttgagttcagtaaagaatgcattctgttgattaaatgtgttatgagtaacagtatcttgttttgctgtacttccaagcaaaatgtaattctttcagtcctccctaccgttctcactccataataatatgacttaaggtttgtatagcatgacgtttacaacgtgcttgcgttttacactgactcaacgtgtgcagtacagtgatgtatagtgaagtattcacatcctcatcttagaaatgaggaaataaattcagggaggttacatgatttaaccacacataaggaggggctgcattctctctgagcccttctacctcacacagccaccaagctcctttgtgcagagcccatggagggttggagtggccacactggggtaggtgcaggccagagactggatgcaacaggaacattgcctgcttcccaaaaccactgttctactgcccggagaacacacccttctgggagctgacttctaacaaagcaaggtccttggacttgccctgcggcttctttcctgcaagaagtatcttccagcatcctaccaacttttatttcttaaaaaaggttgttccttgccaggcattggttgatcagcagaggagctcgcattagtttcagtgcagtgttgggagcaagcacttgagtgcccagcaacataggctgctcatgatctaagattcatggaaaaagtcttctgcgctgttgcctgcagcacatcaacacctgaattttcttatcatcttgtgtggctattgaaccacagggaacccaagcttagtcaataggaaatatagaaatattcattggttcaactgtatagggagggccttgtatatattccaggggctgtatcctatcttgcctctaggtaaataagagatggtcccgaggctcaaagagtttatcaaccattctttattcttcagctaatatgaacattgaatcttttacattagaagttgcccatgcagggcacgcctgtaatcccagcaacctgggaggccaatgcaggaaaatcacttgaggccgggagtttgagaccagcctgggcaacatggtgagacctcatctctaccaaaaataaattttaaaaaaagttacccttaaatttctttctctaacccagcctcaactttgtactcaggcagtaactctttgtacaacattcctggcaccatattcagcttatacagaaccctccaggcaaggacaggtcactgctaagtgagagagctctggttattatagttcttccttaaacactgcactcaaaacgacttccttctaacgtttgtcccttggttcacattctgccctcctttcgattttttgtatggcatggccctccaagagatttcagtgtcagtgtggtgctgccaagtctgtgtgactgttcacacactcgggctccattcacacaccccaagattgcatgagcttttgctgcagccactcacagtcaggccccagtgaatccctgtcctctgaagctgcaggtaggagcgccccaagggcatctagatgtcaaagaagaggatgctcacatgtgcctaaggttcatccatgaaggcttcgtggaggaggtggcttttgggatagatcttagaaagctcagagagttttaacaaagattggtccttgaagattactaatcttttgactttataaatacttgcatatatcttcttccagtctgtctcttattttttgaccttatttataatgtcttcttaaaacaagttttaaattttgctgtagtgaaatctatatatcatttcctttatgggttattctattgttacctcatttaagaaatccttctctacttcagaataatagagttcccactgttttcttccaatatgtagagttataattttcaagtttatgcctttgttccatattgggtttatttggaggcctggtatgtggtaggaatataattttatttctctccagccaaaagtcagatggtagtcagcctttctctgttgatttgtgtcacctctgttatatactatcctgcacatgctgagtgtctttgtgggttctttcttcttttccgttgattaatttgtctatacttgtgccagtacccatggaatttattagcatagttttgtggtatgattgatagctagtagaaaagtcctctttctttgttcttttggttttgttttatttttaaagttatctgactatttatgccattaccctgtgttagttcactctcgagttgctataaaggcatccctgagactggttaatggataaagaaaagtagtttattttggctcatggttctgaaggctgtgcaagcatggcaccaacatctgctgggcttctggtgagggcctcaggaagcttccactcagggcagaaggtgaaggcggggggagccagtgcatcacatggcaagagcgggagcaagagatggggtgggaggtgccaacaagcagacctcctgagaactcagagtgagaactcactcattatcgtgaggacagtaccaagccattcatgagggatccgcccccgtgatccaaacacctcccacctggccccacctccaacattgaggattacatttcaccatgagatttggaggggaccaccatccaaaccacatcaaccctttattgtaagtttcagaactaattggccaagtaaccaaaaatgagcttgggatttttattggacttgcattgaactgagtaagtttcagagaagtgacgtctgtacagtgttaagtctcctcatccatgagcaaactattttcctccattgactcagactctttttatgtccctcagtgaaaggttataaggcttgcaccttcatttctttttatttgttagaatattcaatatttatgttccagaccacagaacacctctacagtaataaaaactgtagtaatgaaaaacacgttttaaagcagttttgggttctatcagggttgggaggggaagagtgctagcttttatttattttctcttgggtaactcttgtatcaatagtatttcatacaaatgtgacactagctgttgccaagcaaagtccttgaggcacatcacgggagacttgtgccccttggttgacatctgttccatcagcatttggttcagcagttgttcaccaaacagtaaatccactaattgcatcatgcatatgctttctttttttttttttttgagacagagtcttgctctgtcacccaggcttgaagtgcagtggcgcgatcttggctcactgcaacctctgcctcccagggtcaagcgattctcctgcctcagcctcctgagtagctgggattacagaagtgcgctgccacacccagctgatttttgtacttttagcagagacggggtttcaccatgttggccacgctgatcttgaacacctgacctcaagtgatccacccacctcagcctcccaaagtgctgggattacaggtgtgagccactgcacctggccacatatgcatctttacccacaggaggattgtagataattttgccaaatgtgtttcttaaatttagaattactttatctgtggaatattattttcctaatgaatcattcttgtttctgaagatcccttgccgtatgctatcaatagtctgtgtcctggttttcaatctaacattatggaaatcttctcctccaacacacttatttgcctgtatctagtcttctcacatttcttccatgccacatgacttctcataatttgcttaagtgacagtaggttcaacctctgattttccaatatagtgtttgatcacatcagcatttatgttaaaatctcaatccattactgctcatgaaaaaatacttgtttttaatactatgaacccgtattcagacccacttaaaaaccagcactcacaatttcgttgggagactcctgtcctgacatatatgattatttgaaaattatagtaaacaggccaggcgtgatggctcatgcctgtaatcccagtactttgggaggccgaggtggacagtttgcttgagcccaggagttcaagaccaacctgggcaacgtggtgaaacccagtctctacaaaaaatgcagaaaaaaaattagcttggagtcatggtgcacccctgtagtcgcagctactcaggaggctgagatgggaggatcacttgagcctgggaggttgaggctgcagtgggctgagattgtgccactgcacgacagagtgatactgtcttaaaaaaaaaaaagaaattatagtaaactatatttttttaatgctacaatggataaaaatggttacaactagataagaagcctctaaattgcctgaacacctaagacttatttgctagttgacatctgatctatttctgacactgaaaatttcagtgctttagggtgctaaaaggaaaaaagagggtttgctaggaatcctgcagttgctgagggggtactctgataagggaattttaagcaattacagaacatctcactaaagtttttaaaaaatctttaaccagattaaacttatacaattttgttataatttgtgtttctccaggttccaattgtggacaagataaggaccattgctcaggctgtctatggagccaaagatattgaactctctcctgaggcacaagccaaaatagatcgttacactcaacaggtaaaagttctacttttaggggaaaagaaaaaattcaccttaggctctcagaatactcagcttgacttgaggatttgtacatatcgcaccagctaacctttgcttaatctattgtatggttaacaaagatgaaggtaatatcctcgggtagagtgtagactatatttagaactttatggtgaggcatatatcctctgatccatgcatcatttacttctgtgactataaatgtgtctgatatgggtggtatccctgtttttaggtgatgtgtgatctttcatccctcccactcagccctgaatgttgaagctatcctttggagtagagctgcggagtcagatttagatgaattgcaatgcttcctcttccttacaggcctcttacttactaccttaaaaatgctagcgtggtgccagggtaggcagataggagtgcagcctataaagatgggaatgtttgctgttcttcttatgcaagcggttcactggctttttactgagcttgtccgctgagattgaaggctccatcatcttctacctctagccactgacaaaggcaagtaggcaaacagctgggaaggtggctgtgatctgacagcatgcatcaccatctagtccagtgacagtcatgatcaatcaactccactacaggaggctcagccaccttcaccaaaaggaccgtatgcctcgagtgtccctcctactttggtgtagtcggatagatagcagtcagaacactttaagagcctgctggctaaagaacttcatgatgggtagcgttgaccttttctttaaaaaaaatctccaactccttattcttttttgtaaacccatttgaaattttgttaaatgctgccgttgccagccagggtatttgttctcctaggtttggtaaaatagtcagcaactcaggaagttctaaattcttagaattttccctgtatgttcttggcttatcctttacaaaaaggattcccaagcactgctctgtgcacaggcattgtggtgaaattttcattcatgtgcaatgaaccaagtaaaataaggtcattctcataaggttggtttgtttttttttccgtgagtttttaataatgatatttaagactatcatttattctaatattaagtcttttctcctttcagtgttaaaatggtatttcttttatgaagtaatctggtgagagtatatggcatattggttggtttttttctttttaatatgcctactgacaaaatttttacattagcaaacctgtattagttcatagaaattacttcaatatttaaccatgtctgaaatttaaaattctggcaccatttctgaaagacagttgtgattgtcactcagcaaaattcttatcggtatagaagagtggagatttcaaaaagaaaatggccccaagtccaagtcctccctgagttgataagactctaagatcttccaaatagttttaggctaagtcttatgaaaatttaactaaagatttcattccctttatctctatcaaggaaatattccttaaaagtgatgtcaaccgggcacggtgctcacacctgtaatcccagcactttgtggggtcaaggcagaggatcagttgaagccaggagtttgagaccactctgggcaacatagcaaaacctccatctctatttttattttttttttaaagttagtgtcaagtatgtggttgcaatgaattagcaaagcctctaaaggaacactgtgtgccatttaatcagaaccaggctttgaggacactgtgctttttgtgagacaccacatgtgacttcctgctctttcacctttggaactctgggtcagacatagactttggtccttaaaaacaagaagcttaaatagtgacctcatcttagttcttataatgtaattgcagatcaaatagccatgattcataaaccaacacaaaggaaccctttgcttcctgactgactccagaatgagtgaacaacatgagtaagagcctcgtcgcagagcctttctccagactaccttgctgggtcccggatattaatagtcttggaaagtggtttctacagctgctgctttgcctgaaaatagccatgctttccccaaacatgcacataacactgccttctcttaaagagagcctccaaaataaacaatagtcacccttgacctgctaaacagtcatcacatggagatgagtttttatcctcaccttcttgcttcttcagtgaacaagtagtaacaagcagctcctgcgtgtgcctcgatctgagccggcataccattgctgccgagactgtataaagtgcaaattgaaaagcacaggagactaacatctgtatcagtgaacacattttctttcctttctcacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacggtgagtgagtcacattttccaaaaaccctccccattctgcattgctgtggtgcctcaaatcgttatgctccgcccgctctttaaaaatcatggattagggaaaattgggagtaattaatagtacagtattcgctatttttctaaacactgtgtctcacctacttttgccattgtggtttggatttttctttttttagatcatgtgttcagggtccttagagtcataatactaatttccttcctaaggtgagtaagaacataacttgggagaattcagtctgttatttaaatggtagaatggcttaagacagtggttgtcaacctttatcacacatagcacccaaaatgatgtcatcacggtggggttgactgctcacaccagacaggatctgcccagtcaccccaagggctggggaaagcagtcctcaccctctctcacttccccagcacgtcaggtgggaagctctggcttaggaaattactgaatcataggagttctcatttttgatgttgttgtgatgggatcatgttgctattggatgattattctgttattttgtgttatctatgggggtaaaggagatgggcagataaataaaagcttatcaaagtgcttaaaatccatgaagatgggcttcatttggtacagctacacagtgatagccttccgttggtaccgtcagtggcctaaatttgacttcttgtctttgggagtgctcctaaatttggtttagaacaaaaaagaattcttacaacctagcagatcccatggcaagcaaagaaaaaaatattctaacccatcattatcgtcatcattagtgcaaagtgatctgagcttaaacagcatacattatcataattttttataataaaccatgttgctttattgtgcaaacaagcaatagatagataaaaagtgcagattcttgccttgatatttacatacttcatctaatattggacacaatgttttttcaatcagcattttttgaattcttcctgcatgtgaggcacagagattttaggatgagcaggtgtgagacgcatgggtttgaatagcacagaggtatctggagagcactgtgttggtattctgaatgccctcagagcccagggggataacagctcattatgcctggggtagaacttacccaggatgtggaagaagaggggattcttcaaaaagagctcagcctctgaactggcaaaacagtgagttttgactcaaaggcaccaaagtactaatacatgacatcctctcctggggtgatccgatgtggctggagttggatgagggggggtggctggggatgggaatgggaatgggattgggatagcaggacagggtcacatggccaaggatcttgaagaccatctcatggaacttgaatctgatctctacacactggggagccacggtagggtgggttttttgtttgtttgtttcttggttttttgtttttttggttttaaataaggaggagaagaatgtggtctgatgtgtattttagaaaaatagctctggcagcaatatggagaatgtttagtgaaaagagaaccaggcccagagaggtgggttaattcagctcgggccagaggcaatcaaggtccgcactttggccacagaagtagatacagagagtgggggtgaattgcagacatactctaaaagtatcctcctaccgtgggggccgggggaagggaccgttctagcttggtgactctggctagtgatgccatcggtcatggaaaggacacgggagaaggcagattggcagagccagaaatgagcctggcttgaacagagagagctcagagggttaataggatctaaggaatagtctgtgtctccactggaaatacagacacagtgcttcaaagaaagaggcaggaaggtcaccctggtgggtttaaggatatgggtgaaggcagtcgttaaacaagagacacagggatagctggaaatcagtgagaagacagtgaaggaagacacccctgaaacacccacgttaatgcagccgactcctagcaggggtgccttccaggaggcgggaaggaaggagcagcggcatggcagagaacgtccagaaaaatcccacagacaccgctcgtagcagtgttggcacagggagaagggcctggatgaaatgggttctgaatgacattttcaggtctacagttcagatcagtggttgccaggagttgggggaggggaagcgtttgactgcagaggggcaggagggaactttttgggataatgcaaataccctatgttttgacgtggtagtgattccatggctatatacattcttccagactcatagacctattcacgtgtgttgcccaggctggactcaaactcctgggctcaagcaatcctcccacctcagcttcccaagtagctgtgactacaggctcatgccactgtgccaggcctgtgtataatttaattatacctcagttaacaaaaatgggtgctgaagagcttgctttatattcgttagaatggcctcagtcagccgggtgcggtggctcacgcctgtaatcccagcactttgggaggccgaggcgggcggatcacaaggtcaggagttcgagacctgcctggccaaaatggtgaaaccccatcactactaaaaatacaaaaatttgccgggcggggtggtgggcacctataatcccagctgctcaggaggctgaggcaggagaatcgcttgaacccgggaggcagaagttgcagtaagccaagattgcgccattgcacttcagcctgggtgacagagcaagacttcatctctaaatacatacatacatacatacatacatacatgcatacatgcatacatgcatacatagaatggcctcagtgatggccactttactcctgagctttagctggtgaaagccttggcttagggataagagggcggctggacagtgcaggcccagagagactggaccatcaggggaggtgaggggtgacggaggtgcccaaacagagcatgaaatggtagagtagctgagaaggttagcctcagtcacgatctgtcctgtcctaccctctgaggactctaaaccccgcagtagttcacccaacaaattcattcactcggccaatgctgcataaggcactcagctcggggctacagggagccccaactttaagaagctttctctgcttcaggtagtttacaggtggtagacgcagatagaagtgaattagtaaagagaatagtttggtgtaaaaattgtgcatttaactgaaaccttaattcactactgagcatttaatagccattaaataaaaaccagggcccgcacagtggctcacacttacaatccgagcacttttggaagccaaggtagaaggattgcttcaggccaggagtttgagacgcctgggcaacatagccagactttgtctctacttaaacaaaaattagccaggagtcatggcacgcacctggagtcccagctactcaggaggctgaaatgggaggattacttgagcccaggagtttgaggctacagtgagctatgatcatatcattgcactccagcctgggagatagagtgagatctctgtctctaaaaaaatgaaataaaataataaaaaacacaatataatttaaaatctttggagtcactaaacaaatatacaatgtgaatctcctctcactccagctaacgccaccatatccaacactaggtaaagaccaaagccgttctggaaaatcagaatctgttgccatggctcatgcctggacaccaggctgtccgctcctgacgtcactctttcacttacgacttgttagaaaatgaatgtgtggaatggccctggatagctgctgcagctccctggtttcctgaagtgagccctctgtgtcattatctggtcttctcagccctcagccgagttcctcctgtggccacacacggggtcgcagtgagcgtcagtgcacagtgatgaaatctcctggaacagtcgggtgtggggcatgaggaagggagtggtgcctgactacagaagttcctggaggtcaggaaactctcactggaggcggtggccctagagggctgctttctatgacagagcaggaagctgcatgtgtagtgggacacacgcaccagaggggccaggatctcctaataaggactggtatttatttttacttgaccccattctgggccttgccacagtctgctgaaatgccttgaacattcatcacccgtgtgggagacaggatagtaatttcctgctgagatgactgaggggacggggaatggggacaccagggggactggctcctgcaggtgggaaaattctagcaaaatgaatcactcttctgcttagtcacccaatgtgcacttattagggtgctgctgaaatacatattcatctatccactccagaaagatagtccaaactgagacctcaggatcagaaagcctcccattctcctgcagggttcattcatttactcagtgaattattaaatgcctacagcacgcagggccatcagccccacagctatgagaaagattcagtccttccctcacaggccttatgatagactccagtaaataaaaccatacaggcacagaatgcggcgggctttataacaaaggcagaaagcccctcttgttgtgtcctcaagggaggcagagaagctcccctctggctctagttggagaatcccaacccaagcaagtccatccttaaacaataaacatctccagcattgctggctttggaagaccccatggtgagatgctggagcttttttccgctccagatttcgcttctaaatatttacttttactttccatgttcacttataggccagggtttttttttcctaccattgaattatttcgtcatgttctatttaattattgctttaattggcattggtgaccacaaataataataaatactattaactggtgtaacagcttcactagtctatttcactgccccatgctgttgtaactgaagcccccagcacaagcattcccagctcgtggtcatctaagacctttgaggtcattcttacatgcattgctagtgttttccatattccttgatggtagccaatttttccttcttaaaataactttcttcattcctagtaagcttcatatgtattttatgtattcttccctcttttttatgacatgatacatattattgaaagctaggaaataatgcaagattcttgaacgacataataccacttagtacatctttttgtaagagatagtttttctaatacaaatctttgatatgggaagaaacaagcaagttgttttttaaggttttccaaccctatattctactacaaattaccctgttatggtatgcttccaaaattctttcaaggattatggtttatagagttcaataaacctaatagtttataaaacttctcaaaaaataatctcatgccaaaaataatttagtagtaggtggtctttgtcttgtggtcacatggttttgatattgtctttaagtttctataatttacaagggctgtttaatcagttggcataaatttcatgacaaaaatactaatatgtaagcaaagtatatgaaacaatattattgagaagtaaattacattccatgtagaaaaagactagaaagacaacaccaaaaccttaaattagacagtgttattatgagtagctttttttcttctctttttccatatagatcaaattactacattgggcgtatatcacttttataacatgaaaatacagtaaatagggcgatgataaactgcaagtgcttggggagaatgcttaactcaggccagttgcaagagagtgagaacacacacgcagcctgtgggagcgggctccatgccatcacctggccggtcctggctgtgttgctgtgttttcgcacctcaaaagttgggacagcaaagaaaggccataagagctagaacgtttccataagaagtgtattcagtatgatttgtctagctctgactaatgtgtgcaaaccccacattccactaagcaaatgcaagattgtttttccctgttcatttgttcctgggcccttcttgcttactgtgttgggagttggagaggggataattgacttctttcttctcacagtgttttctcttttttttttttttttttttttttgagacagagtattgctctgtcgcccaggctggagtgcagtagcatgatctcggctcactgcaacctccgccttccaggttcaagtgatactcctgcctcagcctcccaagtagctgggactacaggtatatgccaccacatctggctcattttttgtatttttcaaagagactggggtctcaccatgttggccaggctggtctcaaactcctgacctcaagtaagccactgcgcccggccatctctcacagtgttttttaaaacaacaatgcattttcataacagttggcctggagaggtgtccgaccaagttggaattcatagtagaatccattggaagttaatttttgatgtatttgactgttttccattgacttcgcattgaggcagtgagagagacttgaagaacttagaatacgcacccttttgtcactggcaaacatgggacatagaggcgtgtcttgacagcaatttgtggcaacactctgggctggaatctaggggttagacagcctggccggttttgtaaattagatagccaggccaccctcagagtcagtttgagggttgagtgggaagcctgaataaaaagagaagttaaacttttaagaaaagggtcaagctttaaaactggaattgggttttcaaatttaatgaggaaaaagaaaccccaaaactggaattgtaattgtggagaaatacaactgataatatttggaatatcatctacaaggaatgaaactatccagaagcatttagatggtagtcagtgccatgtagggcacctctgggggcagggtggctcctggcactgtggagaaagacgactggtgcttccttctcccaatcggaggaaagggatacactgtggaggtcccagcagcttagggcctgccccccatgtggttatctctgtgccgtttccttccctctgtcttcctgtaactccttcactttggcccctctgccctttctgggcagagggtgacaggaggcaccgcatgggtacattctttttttttttttttcttttttttgagacagagtctcactctgtcacctgggctggagtgcagtggcgcaatctcgactcactgcaacctccatctccgggtttcaagcgattctcctgcctcagcctcccgagtagctgggattacaggtggccgccactacgccccgctagttttttgtatttttaatagagatggcatttcactatgttgttcaggctggtctcaaactcctgacctcgtgattcacctgcctcagcctcccaaagtgctgggattacaggagtgagccactgcgcccggccaactacatgcttttttcctcctgtcgggattggcctgggctgtacctatctcatggtggaaacctgcccagggaccaggccctagaagaccagcagtttatttaactgggttggcctttgtccccactccctgtgacccggccctgccacatctttacccaggtgcaccactgacatcatcgcttggctggactctggaaagcaggaaactgctggagcgtgtttggggcatcagtgatgtcacccgctacaaatgctgggtggggttactggactgagggccatgaaaaaagaaagctgcggccccggcccgtggactcactgccattctgctctttctcacgtttcagttcagctcggtttgttttccgtccccctccctctactgtaaaagtatgtactcagtgtttcgtttcctgctggatctgattcaggtcagtgatgaagttatttgtgaactcagtggggaggtgtttcctcccctttgtaccggccctacttagggatgcacggttggttatacgcttgcttcactcggttaggcatggaggagaattcattcagccctcataggtttaaatcaaatgcatgacccttcacattttccagagatttacggccagttacaatgagacaattaaacattcacccccccgccaagctgcacttggagatgtgtaagcagtaatgtagtcatgcgctccccatgatgtgagagcgtgcagaacgccactccccccagcaggtccgccaggacctccgcagggagcatcttgcctgcaaaatcacacatccctttttccccctctctccactttccctactacttttccactcccacacccacaaataaacaaagaaaccttgagcttattttacaaaagtctttgaaatggccctcgtctctccaatgctcctgggtcctggtttggccccatctgtgcaatctctctgatgagtgtgaaataagccaggtttggctcatgctctgccggtgagcttgccctccccatgagcctgtcctctccatctggcctcactttgtttgtgtccctgtgtcctttgtctcccatcctgggatcctggtggtttcctcctcccctcccagcatgagtccttttccccagggttcttccctatctctacatcagaatttcctgctttctcccaaatatgcatttccctggcccaggcatccactgcttcctctcatcgtgaggtccctgccgcaggctgctgatggtattgtggccgtgccttcctccacaacccagggaaagctacgtgtgtgtctgtcccatagggaaggagtcatccctgtctcctcagtgtggtgtgttcaggaggaaggaaagtaaccagcgtcgttctcaatttccagaaactgtttatcatattgacaagaagaagaaagctttgtgactcatgagaatgatgttttcctctctggtacataaggttatctaggtccaatccatttgtgtagaggatcttctctcccctagtgtgatatgcacttatttttagcacaagtataaaactactttaaatgaaatcagcctcagccagggaaatatgctgagtaataatgttgccaggtactataccactgagttgagtttgtaattcactgctattaatccctgtgtattagttctgattttttactctttgcatacatagaaaaatggtgtttctcttcagagtcaaggagggaaaaaaagaaaagataaaagatgcttataacacttttgtgtccacccctaaaatcagcatattgatctattattttttctaggtattgatgagatgttgactcatatactttcatacaactggtaatatatatatatatataatatgtgtgtgtgtatatatatatatatatatatatatatatatatatatatatatagactcatttttcttccactttcatctacagcctacttgttttcttccccccatttttcgtatggattcatagcataaattgacaacaaagatacatctcaatttagagcttccaaaaggcacccataaaagtatctggtgctcatggaattgctctttcttctatgtctcttagttacacttttctcttattacacttttctatcccagccatggctaagaggcgtataatcagaagcagctaagcaatatatgcaagggaaataaaatgaatgcaaaccaagataccggttttgtaaattagatagccaggccaccctcagagtcagtttgagggtatagtgggaagcctgaataaaaagagaagttaaacttttaagaaaagggtcaagctttaaaactggaattgggttttcaaatctaatgagtaaaaagaaaccccaaaactggaattgtaattgtggagaaatataacggataatatctggaactcgcggcagtttacaggcttaactatgtatgtgttccttaaattatccacccgcagatatcagattacaataagtcctcacttaatgtcattgataggttcttggaaactaccactttaagcaaaaagacatgatgcatatgaaaccagttttcccatagtctaattgataggaaaaagagttaagttatgcagccacacagtacctcgtttggcttaaagtcactgtttccaagaacctatccacaatgttaagtaaggacttaccgtatatgaaaatatttgcagtaaattgcttttgagagaattggttatcacactcttctctgggtatcattgaaaattcagaatgtttaattacatcaggctatactcactggtataaaatcagggagcaagtataaagtaggtgtagggaaataatttatgttggattaaatgatccaatgaagggattttattaagcccctagaagtcccagaatgaaaatgtataactgcatgactaacccctaagaatttgctggggtttctgcattaagtacgcttcccaggccatttgtaatgaaggtaccgtgatctgttaaggaagagacctacagctgggaacaaaaagagccaattccatcctagacatcagtctcctgtttgactcattccaaccccaagaatatgttgtagagtgtaggacccatgaaagttacttactgtgcttccctgtaccttccgtcatccagttcccagacatatctgtgtttcttctctgaatgcctagttacttgggatcccatgctgtattggtctgttctcacactgctgtaaagaactacctgagactggatagtttataaagaaaagaggtttaattgactcagttttacaggctatacgggaagcatggctggggaggcctcaggaaacttacaatcatggtggaaggcaaaggggaagcaagcacatcttcacatggcggcaggaaagagagagagtgaaggggcagtgccacacacttttaaacaaccagatctcatgagaactcactatcacgagaacaacaagggggaaattcacccccatgatccagtcacctcccaccaggcccctcctccaacactgaagatcataattcatcatgagatttggctggggatacagcgccaaaccatagcacatgcctttcccaggactggtgatggaggaacggtgcccttgtcacacctaccagaatatactcacccacctccagacactccatttctctttcaagcacacctcttcacttgtgccgccagctaaggtttactgcagttacttcctttgtgtgtcctcttaccttaccaagtcgcctcacccaccatctactgttaattaaattaccacctcccccacttcccacctccagagtagagactgtgtcttcagttctcttggccttcccacaatgggaagtccagtgtagaacataccctaggagccaactaaatgtgctagtggcctgccaaccctgcagagggctagggaatcttcaaggagtctgctgccagtgaaactcaccagtactagaatcccaggctccaaagaagtctagaaaagtacatcttttaaggaggtaataagaggctcaagtgcccacaaatcctatctgctcttggcctagttcttttgggatcaatgtgctagtctctcttgtcgaaccagttactgaccagcaagactaaaaaaccaggcccaaacacattctattcatgtgcttagatatggacctacggatcaaatatcccactgtaaagcaaaacagcaaactgtttttcccttgtactttcacactcaacaatagcacgcttctgtggctggctgtgtgggggcttttccttacacaccaaatatttctcacaaacaccaaccaggtgtcctcttattcaattcaatcctgacactgtctacctggagatggtgtcggatcccacagattgacggctcagtcccatgagaccagccccacttcaggcactaattgcaaatccaggccatgcatacttctctgactgcctggctaaaaaccgcattcacagccgggcacggtggctcatgcctgtaatgccaacactttgggagaccaaggtaggtggatcacttgaggtcggaggttcgagaccagcctggccaacatggtgaaaccccatctctattaaaaatacaaagattaggccgggcacagtggctgacgccagtaatcccggcactttgggaggccgaggcaggcagatcacgaggtcaggagattgagaccatcctggctaacacagtgaaaccctgtctctactaaaaatacaaaaaaattagccaggtgtggtggcagacgcctgtagtcccagctactcaggaggctgaggcaggagaatggcgtgaacccgggaggcggagcttgcagtgagcggagatcgcgccactgcactccagcctgggcaagacagcgagactccgtctcaaaaaaaaaaaaaaaaaaaaattagctgggtgtggtggcgggctcctgtaagccaagctactagggaggctgaggcaggagaatcgcttgaacccaggaggcggaagttgcagtgagttgagatcctgccactgcactccagcctgggagacagagtgagactccatctcaaaaaaaaaaaaaaaaaatgggttcgcatgagccccctccttgggttcaattaagttcctaggatggctcacagaactgagagaaacacttatttacagaggtgttatgatatatattgattttcgtccatggttcctggttcctgaatcccataaaccttcttacagccttttgttataatgttgggggtgtcacgcctcaggggcaggcctctgaccttccctgccctccttgcactgtaatgtttcccccatttctgattgtgagtcttaagaccctcccatgagagggtcccaccctacaccttgtgggaaggaatgtggatgtcatgaagtgtccataaaaacccaagaggacagggttcaaggggattccagatagccagacatgtggagcttcctggaaggcagggcacccaggtcgggcatggaagttctgcacctcttcccccatacctcgccctacacacctcttcatatgtgtcctttgcaatatctttttgttgttgttgtttgtttgagacagagtctcgctctgctgcccaggctggaatacaatggcatgatcttggctccctgctacctccgcctcctgggttcaagcgactctcccacctcagcctcctgagtagctgggattacaggcatccaccatcatgcctggctagtttttgtatttttgtagagacggggtttcaccatgttggccaggctggtcttgaactcctgaccttaggtgacccgcccgccttggcctcccaaagtgctgggattacaggcgtgagccaccgtgcctggcctgtagtatcctttataataaactggaaatgttaagcatgtgtttcctttagttctgttagctgctccagcaaattaatcaaacccaaagaggggagtcctaggaactccaatttgaaaccagttggtcagaagttccagaggcccagacttgcgactggtatggtggggggcactcggccctgtgggatctgacactatctctgggtagacagggtcggaactgaactggaagccaccccacctggtgtctgctgcttggtgtatggggaaaccccatacacatttggtcacagaagtcttctatgttgatgactgttgtggtgcgacagcagaggaaaacacggtttgaggagagcttttcccaacacgcttatgtgtgccagtttattatagaagacacagatgaacaccagatgaagagatgcatagggcatggtctgtggagttggggttcacctccctcctggcacaaggatgccttcaccaacccagaaactcatcaagtcttgttcaaggatttttgtagagcttaatctccactccccgccctccacccttcctggaggttgatgggtggggctgaaagttccagccctccaatcttctacttacttggtctttccatcctgaggctagctggaggcccaccccgtcactccattaccttaagctcaggtgttattgaaggagctccttatgaatagagcaaaatcacccctatcagaaatttcaagagttttaggaaacctgtgactggaaccaaggacaaagatgaaatatattttgtatgatagcacacccaccagattggatcgtggggccatatggcctttagtgtggaagctgcttgaccacattttccgcccatgcactgccattctcatttcaggctgcgtcatcatcatcatcaccatcacctgttcttagcaaaggtcgcacaccttccaaatgctttgtatagattagctcatcactccccatactcaccctgggagcatagtcagggataagaggtagagttctagcgctctgtggctactatggtttatgggatctttgcgcaggaataactggactttaaacatcttggcttttcttttcagtaggtcagtcggcatgtactcacagggccgtgcatgctgagcattgagacacatcacaagggagtgaaaacctgctgccatacccccccagaggcagcaggatgtttggataaataaggcataaacacctggagaattaaagcaagtacaattagtgcagcctttgccaagagaaaggtgtaagtgctaaatgcagtagatgttcaaatacggcagagaccacagtgggcagggtaggccaagaatgctgcctaaggagtggggcttggggtgaaactggggcatttgagacactgcaggcccatcaccctggctgcgccctcctgagggaggcagggactgaggcgggaggcctggagaggtctgtgcgtgagcctgggggctcattgataaggagcttccagtgggggcaataacattggaagtggagaggatggcatgtgtgccgggagacgcagtggagtggaagtcgccggaactgacaagggatgggatgtgagcaaggagtccaggtgagtcctggggacctgaaaggatggacccagagagataaacgacttcaaaccggcacggcagtgaagtgactgacccgcgagtgccctgcaccgaggctgacatttgacttcctgccaagttggccatcagacagttagaaatcaattttggagttcaggagagaggccagagctgaaaattggggagttgtttacattgggagtgatatacagtctctacatttccatccagttcaaaacattcttgcgtgtctgctatgcactgtgcactgaggttaccaagactggaaagacccaatccctgtcctggaagcttagtgttggcaggaggcagacaagctgatacatgcaaacaaagggctcacaggtgccaggatgccaagggatacagaagaaggatggttgcttctctacccaggagtgccctgaggtgtcttaaaaagaggagcatttatgactcaggcagggtggcacattccagacggcagtgggcaggagcctgactccagagcgccttagaggctgccgctgggagttgagctggaccctgaaggcagtagggtaagccataaattagggttaaggaaccaagggaataaggggatcagaccattgcatagctccagcagcaccattactagcagcctgtgtgaatgatggtcccctcttacatgcccaccatgcaagggctctaggccattcttcactctttaatgcagaaaagcaaaacttccagctgttttcccctacccaaaatgtgtgagcctgagcccagccccaggatggatcttgtcctaggtaaccaagaaggccttaagtgtcagaagaggtagctccaggctgaataaagggacaaatgaagcattactgcactgagatcgcccgtcgtggggtgggtctatacccatctagtcattaagcctcaataatttggtttctaaatggactattatttgctacagatcaaaagttgttggaaactatattacacagataaatagaattgtcctgcaaataaaggaagtaatctcttctctgtttgagataccatgcagtatttgtccaacttgtacaaatagttctgatccatgagaatcctccactttcaacttacttgctgctatatcccaactattataaggccatggagaccagtagcctggtttccattatctttgctctgtttttttttatggcatggttgacactacctccagtagcaaagagttaacttgtcatcagagctataaaatcacaatgataagtgaaaagttctcttttgtactttagcatccaagagaagtgtaattcccaactacaatgctcaaaataatagagagtttttactttgggcctgaaaatacttataggtcaggtctcctagttgggtccatgctgttgttggtgttccctcccaagtaaatacatactgaatttagcaaattattcatttgtgatcctctgtgccatctaaaaatatatatagtttaaaacgctggccaggcgcagtggctcatgcctataatctcagcactttgggaggctgaggcaggtggatcacctgaggtcgggaattgaagaccaaactggccaacatggtgaaaccccctctctactaaaaatacaaaaattagctgggcatggtgttggactcctataatcccagctactagggaggctgaggcaggagaatctcttgaacccgggaggtggaggttgcagtgagccgagattgtggcactgtactccagcctgggtgacagagtgagactccatctcaaaaaaaaaaaaaaaaatgcttatcattgcacagatagctgtacagttttttattatttatgataacggtaactgactttttgttaaagctggtttggaatctggaggttattttaattttgataactttatgattttaacttttaattttaactttatgatgtttgtcataaaagagtggaatgtgctcctattttgagatggaaacatttcggcagggagagagaagagagacaccaaaccacctaacagccaggttccaaggggagattcattcagcgtctttgaagcattgttagttttcatttgaggcataaattggaaacttatatctttctttggagtaggaagtatttcagacagaaaaaaaatgattgctacaacaacatcacgaaaaagaacagaaggtttcatgaagagtaataaagttaagtttatgaattagagcttcagatgggaaatcttatttggacagtaaatggttaatggtacagggacaccatgatgggggatctttgcagcattgaaaaaacacgcgtccataaatccttctctagcacttctttgtgatcacagagtcaagctgaggacaatgatggagtgctccagttcatccgaagtgcacgagtcccctttgcagcagactctgacattcccggcccctctccggagtgttatcaacatgcagtcagtgctctctacgtcattactttaaaaacaaaaactcggccagcagcagttcagtacatcttcaaagatcttgacttgtaattttttcccctgcatcttctctattgagcacatgaactgacatctttctacccccaaataatcagttctttccccctaaataaaatgggtaatccaaaaaagacccatcaaaaggaagctaaagatagtaatgcctaggtagtttcgggaccagaatgattgtctctaaatatgtacatgtacagtgattacgtgtttaaaatgtttaatgacttggagaaatagtgtgttgagtggagaaaaatgagatttagtagagcataacgtcaacagtgtaaaaatacatagaaaagcaagcaggaataaaggaatgtttaaataaattacaaagataaaaattaaaaccgtaattcagccgagcctggtgggtcatgcctgtaatcccagcactttgagaggctgaggcaggcagatcacttgaggtcaggattttgagaccagcctggccaacgtggtgaaacctcatttctactaaaaatacaaaaattagccgggcatggtgttgggtgcctgtaatcccagctactcagaaggctgaggcagaagaatcgcttaaacccaggagatggagtttgcagtgagcctagttcgcgccactggactagactaggtgacagagggagactccgtctcaaggaaaaaaaaaaaacttaactagaacatttattgagcacttactaggtgccagctagtgctctgagtgctttgtgtgtattaactcattaatgcccccagcacctcttgaggtagattaaaatctccatctcggttttacatgcaaggaaaccagagcaggaagagcttcaggaacttgccctcctagtaaagatagaaagtagcaaacccaggattcaaccccagaaatattatatactatgtttgtgctgaatcttttttttttttttttgtttttggagatggagttttgctcttgttgcccaggctggagtgcagtggcgcgatctcggctcaccgcaacctccgcctcccaggttcaagtgattctcctgcctcagcctcccaagtagctgggattgcaggtgctcactaccacgccggctaattttgtatttttagtagagacagagtttctccatgttggtcaggctgttctcaagctcccgacctcgggtgatctgcctgcctcggcctcccaaagtgttgggattacaggcgagagccaccgcacctggcctttgtgctgattctatagtcttattttcacatcctatcagttactgtaagtaactcttgattccaagaactgtataataggaaagggtagcttccaattatctactcttgcttgataatgcattaattccacatagcctttaaaagtttagtaaattttaggataaattttcgaactgttatttcctattggctgttagaaaattgtgttgctcaaaggggaacatgtctattgtgccttgtggagattttcctacagcttttctggctgacccgtcacttgcactctggaactctcctaaaccagatacggcccaccacgtggcatggtgtggatcctggactttctgtcatccgttaggttcatattcttgaagcaagtctagaactattttctgagagattccctggctgttgttctgtgtttgggtgggttagtcacctttttaggtgagagacttgatttgggtacacagtttcacaaaagtattgtcaaccctgctggccaagtgactgacgtgctgggcatgggagcacactccatcggcatggcagagtggattcactccatgccattgccagagaataggactttgaaccacagccacccggctttttctgaaaggcctgcttgggcaatgatgcctggagaattatctgaagaatgcagtctgtccattcctctggagatggtctagtttttatccccagaccaagctgaacctcttagagctgtgcatttatattgtgtggaattgccttcagcgacgtgttctataacgtcgtgttcttgtcaccttttgagggacactggtgctgtggggaagatcctcaccaatacgcaacagcagggccctgttctctcacctgccatcccctctggaaagctcacagagagggtttcctgggttgctccttttccaagcaggacttctactgtagacttacagctccagttacaagcctgtgtgcttgtctgtttccccacaaggtgttctgacctgggagggaagggacggaatcctattcatctctgaatcctaaatgccaggcctagcacttggcacacagtgggttccagttgtggaatgaatttttttcagtcctgacaataaatgttggggttctttagtttgtttgttgttattgtctgttttatttgtattttggggttttttgctttttcccccagggaatgaaaatgccttctccatatgaaccagacatatcctggggctggggctgagtgtcctttgttgtttgctctaattataactaatgaacagttcagctctggtaattgtaggcttgctggacccagtgcctgccttctaactgaatcttgactctgctccattatgtattttccatgatcctgatttctgtcaatctaatttttaaatttcattctaaggcaaacctgctcatgttcttcgctgaaatcaacctcccctttctggaatggacatatggaaaattggaggcaaaatataataatggtggtgactcagactgctttaaggcctgagagaccggccaggtactgtggctcacgtctgtaatcccaacattttgggaggctgaggtgggtggattgcttgagcccaggagtttgagaccagcctgggcaacataatgaaaactcatctctacaaaaagttactgggctcagtggtgtgcacctgtagtcccagctactcaggaggctggggtgggaccatcgcttgggcccaggaggtaaaggctgaagtgagctgtgattgcgccactgcactccagcctgggcaacagagtgagaccctgtcttaaaaaaacaaaaagacccatgagacctagactccccctgtcaaaaatactcacacacacacatatacgataagatagtatttctaccttttctttctcaaaacattccacagaacagtcttaccttcgaggagagccgtatgcatgaccttttgtttgtttgtttgagacggagtctggctctgtggcccaggctggagtgcagtggtgccatctcggctcactgcaacctccgcctcccaggctcaagtgattttcctgcctcagcctcccaagtagctgggattacaggcgcgtgccaccatgcccagctaatttttgtatttttagaagagacagtttcaccatattggccagactggtctcaaactcctgaccgcacattatctgcctgccaccacctcccaaagtgctaggatttcaggcataagccaccatgcccagctggaggccttatttttactgctattcagagaacctgtggcttatccatggagggcttaagctttgccttttctcttgctcatttccatacctagcaagagcttaagctggtttattgcactgacattctaatgaaatataaatagcttctcaacagagagataagaaagaggagtatctagtacagcaagaccctctgggtgggtcagggccagctggggccgtgccggggctctgagtggaggaggtggcgtgggagcactgatgctcgggctctgtcacatccgtttttggcatttgtcctggcaaaggctgcatttctgatctttcagaaagctgtgggtacactgtacagaaatgtgttttgcttgctttgaaggatgacctactggctgacagccagccagaattaattccatatacatttgcagattttcagtatgagagacggcaattagcctacagaaacccatttaacccccgaggtggagctgtatggtgaagactgttatttatgggagtctgtgtaatttgcctctgtgacaagggacagccatggctcaggagggcccacgccaccctccttttcaaggactcctgcccctgcctgagtggcttggcctggcctggccatgtgagtcttgtggacacgtgcacatcagtcagggacccctgtggtatggaccaaagggttgttttttactgttttaacttatttaatagcatctcatcagtattacaggcatgtgccgccacgccaggctaattttttttgtatttttaatagagacggggtttcaccatattggccaggctggtcttgaactcctgacctcaggtgatcaccccgtgtcagcttccaaagtgctgggagtacaggcgtgagccaccgcacctggcccacagagcttctaaaggaaatgtgttggttttttaatcaaagttgaggcagtgcctcagtgaggggcaggctggagcagtggtaagcgcgctgaaggagtcgggctctctgggcccaaagtcctgccctggccacagagtggctcccttccccctgaggtgggatgatgttctccagggccttttagctccaggctgctacagttctaaactggtggtggtggtggtggtggtggtggttgtggtggttgttttagatgcagtctcactcttttccccaggctgggatgcagtggcatgatctcggctcactgcaaccttcgcctcctgggttcaagcgattttcctgcctgcgccaccacgcacagctaatttttgtattagtagagttggggttttgccatgttggccaggctgctctcgaactcctgacctcaggtgatccgctcacctcagcctcccaaagtgctgggattacagatacgagccaccgcacctggccatgattgttgtttttataaaatcagaatataaaatttgaaaatgttcttttttggtgagaaatgagaactaccaaaggagtaaaatgctctaaaagccatcaggtccttcccacagtattgaggctctgctcttaccattttgttaaataagttttgttcctaacactctttgtgatatgaagtattcttgctaatcaagctgcccggagactggcgtttcccagagcagtttcgaaagtggaaatgatgctgcatttcctacccacagtctggagggtggctgtgctctctgcacggtgggtctgtgctgctcagttacgggatggtaagggaaggctctaactcggtgtcttacaccatgcactagggagtcgcccgctttatttacgagcgagttgatgctttcagtgggttttggctttgcctggttccagactcaagcccttcctctaatgtagggcgggtacaagagagacttgagcaaggatattgggatttaagggaagggcagtgcaggccaaggtcagcaagaggacatctctaagatgaacagcactgcatttgtgggaagcaaccctgccataaacaactcagttaacgtttacatagtaaataattgcattgccttgggctggaatagggacgccagaaggtataggaccatgtggaattcagaaaagggagccctgaagaatgagattttattgttcttaccaggagagtccaggtgctagagttctctccttgtaagtgactaaccttctcccttttggtacacaatcctcagatgaacggagatgattcattaggccattctagcttaatggatgcatcactgtgcaaccacgcaaatgcctcatttctgattcactcatttaatatttattgaggagtgctgggtactaggccattagaagaacaaacaacaacaacataggcctggaccttgcacttgcagagttcacaggctagagaggcacacaagttaaatatagagacagctgaaagagctgacgtctgggacagagggagccccctgctccaggagccagggagcagatgccatggggggctggcagggatagggaagtcaggccaggaatggggttacctaagccggatcatgaaggacgagaacagactcaccaggggtcgagggacaaggaggcagcaagtccgcagcatgaaggcaggagagaacattgctgtaagcctttaccatggccactgcatggggaggaaacaggagatttggaatgagctgtgacactgggcaggaaagcaagacccaggtcttgtgaggccttgagcgtcaagcttaggagtcaggacctggggattttaagtacagcaatatcataattacattcatgtttcagagagatcactcaggcagcagtctggaaggtggagtggaaaacggagaaattagtcatgaagacctatttagaaagtagtaggcaagaaatacccagggcctaacctgaggtgtaggcaggggatgggaatgagagcaattaccgaactagaatgaactaaactcaatgaacaggagcggggaagagggaatgcagaaatggctctcagatttctgacttgttcgcttaatgactggggttgtcatttgtttagataagcaataaagaacctagaaacaattttaggcggaagatagttgtgttgggagcccctaagaccatgatttattacagcacaaggatacaaagcaaaattagcaaaaggaaacagcacgtggggtcaagtccaggggagctcaggcgcaagcttccagagtactctccccatagagtcacacaagatacacttagttcctccagcattgaactatgacgacacctgaaatattgtctgcagaagaggctcattagagactcagtccccaaggtttttattgggtaatggtcacgtaccaaatttcagtctctcagaacaaaagcaaatgttcagcatagaccattttgtttgtgaaatttaggcacagtgagcccctcttgtcagttagaggatagttgaaaccctcccacaatccaagttctcagactcaggcctgctacattatttctttcctacacagtagtggatttggttactaacatgttggatctgaagcatttgttgtaatttacagtgaagatgtccactgcacagttccgtattgagtctgaggttcactggagacatctgtgctatcaatgaaagtttctggagtcattagcccctcaaagggtcattaaaaccaggtcttctagagagaaagtctaaccctgtattcctttaaaccaccatagagaccatctagttcttcacattataaaaatgagaaaactgagtccccagcgatgtggcttggttgcacatttttctatttcaagtctgttactccttccatcataccagactgcctcacaaaatgacaaagtcaggcattgttcataaaagaacaaaatggcatttaggttataaatcaggcccttgtaagtttggttaatacaacttatttcccaaagatcctggtcctcagaccctcaaaaggagagctgatcacatcaaggcctctacctggaaggaatttctaagcagcctctaagtcaactgttcatgttcagtccaccttgatttacaaagaacagtgaatcattaagacctttctctccaaggccgggtgcggtggctcacgcctgtaatcccagcactttggaaggccgaggcgagcggatcacgaggtcaggagatcgagaccattctagctaatacgatgaaaccccgtctctactaaaaatacaaaaaaaattagccaggcttggtggcgtgcacctgtagtcccagctactcgggaggctgaggtaggagaatggcgtgaatccggggggcagagcttgcagtgagccaagatcgcgccactgcactccagcctggagaacagagactccatctcaaaaaaaaagaccttttgctcctctttgctcttgtgtctgtttaacagatttttatgttaacaggcactctgtttgccactaggaataaaaagataaatgggacaaagtctttgccctcaagttacttatattctagagccaagaaagagatagatgaagaacacatcttatatattaggactgtgttgggggcaggagtaggcagagtaaccctttggatatgggaaatgaaaataaatcaaactcaaaacaagtttattatttgcttgaagctctggtaaaagataaagtgaaacctgcaaactgtaaaatgaagttgctgctacacatttctccagttttggatttcattcttggatggcctttaacttggatagaaggatacaagacagccatatatatatatatatacagctgttgctctttaagatatccacttcaccctgttgtggggtgggaggaggggggagggatagcattaggagatatacctaatgtaaatgtcgagttaatgggtgcagcacaccaacatggcacatgtatacatatgtaacaaacctgcaccttgtgcgcatgtaccctagaacttaaagtacaataaaaaaaaaaattaaagaaaagagatccacttcgctcagcacatgtgatttggctttggtctttggtgttaatttggatgcctaaagaactgactttccttgatgctcactccagcctttttaggactagattggatacatttacatgtttgctggctgttttttctacagtcacacatcctacccataataatattgcaatattctaagttgtcttggaggatatcatcaagtaggtgtcaagtaaaacttaatggtagactgtaaattttaaaacaagttacaggtcatttgtgtagtctctctctctatatatattaaaagaaacaaaacttttccctcttgaatctttattcctatctcagcttcatttattgcctcgtttgtcatctaaatggtctttgttctttcagctttcaaacatgattaattgacattgtgcagcatagcacagggaaaaggctgaatattttgtatgatgagtaatctagttaaacgcccatctttcttttcaactttaccaacaaatgtgtcttatgcagatgtaagggcggtttgcttatttccctgttcaaaattttatgctattagcctagcatagcatgtttcttttccattgagctagccaaaaataatattgacaaattcatgaagccttccatctgatactgttgcaaacttatgcaaatgtattttagactgttaagggaatgtaagaattaaataattaaacatccaaatgtcaagaatgggataggaagaagtaactggcctcatgttggaagttaatgaaatatttgaaaatatacctttaaaatcaaagacatgaatttgtgttttgggtttttttttttcagatttgaataaagcagagtataatattatagttgctgcaggaagttatgagcatttctggaagtgcttattttcagcacatgctacttagaattttaaaggacattcagtgtatctttgtcatgaatctttctactgggaccaggccactcctggatgaactcacagattgagagcttctcaaaatgtaaaatcaaattgtcttttaaaatatgctattttaaagttctggagaatcaatgaactttaaatgaaaatcggccaatacttggcaaaaagtcaatttgaagagttgtctctttataatctctgatttcacttatagagcttgcttccaaaaaaagtactacgtatgtcataaatctgaaatgttttgcttttatgccatttttaagtcctgataaatattcttgaagtgttaaattattattattattattatttgagatggagtcactctgtcgcccaggctggagtacagtggtgtgatcttggctcattgcaacctccgcccccccggattcgagtgattctcctgcctcagcctcccgagtatctgggattacaggtgcctgccactgcatccggctaatgttttgtatttttagtagagacagggttttaccatcttggccaggctgttcttgaactcctgaccttgtgatccgcctgcctcggcctcccaaagtgctggaattataggcatgagccgccgtgcccagccagtgttaaattatttttaacttgttagaaataattgtcccacaacttactgaaggttggtttaatattcactattgttcccaaaaaactcttaaaatattaaaccaactcatagctcataacttttcaaggtagcaagtgtttgctaatcttaaaatgtgttactattctttttttgttttttttttgtttttttgtttttttgttttgagatggagtctccctctgtcacccaggctggagtgcagtggtgtgatcttggatcactgcaacctccacctcctgggttcaagtgattctcctgcctcagcctccccaagtagctgggattacaggcgtgccactacgcccagctaatttgcttgtatttttagtagagatgaggtttcaccatgttggccagactggtctcgaacccttgacctcaggtgatccacccgccttggactcccaaagtgctgggattacaggtgtgagccaccatgcccggccactattcttaagtgaccttctgcacatctctgtagttttatgcctggtgatggcgtttaatttaggagtatctggcatgccactccagtctgacagctaggggcatgttagcaaagggggcatttttcaggtgagtgggtgagcatagccgtgctgaccatctttcctatccagagggaaggcctagcagggactcacgccatcttgacttgcctgccccaggctccctctcactgctcccctggcctcttcctcttctccagacaatggggccttatgctcgctgtgtttgtcagaactctcttgtggttgtggctgcaagtaagagaaactcaactcgagcttattcagaaagaggggatggattgacccagataacagaaaagtgctaggctagatctggccttagccacagctggatccagccttctggcatttgtgctccgttcctcagccctgccccactgggagtgatgccttctgttcacagtgtgatctgcttcatactcaaaactccctatccagaggaagaggaatcttttctctcccaccatctgcacagcagtattcaggaatcccctgccaggctctgttggcctcatgtgccctgtcctaatccaccactgtgcccagccagggtgtggccatacatgcccatcctgtgcatagggcaggagcagacccacctgcaccacatgcggtggccgccatgaccacaagaccaggataggagtgctgatcaggccagaccccaagggctgttgctcagaccatacctggcctgtagagtagaagaactaaatgtctcacacaggcaaagactactcttcaattcctttaattgcaggtgtatgttggagtccatgaaatacaaagttattgagaagcataactaaatttatagtagctcctcattatatattttcatgttgataggattctgcccccatgggaattaattttcttcatcaaaagtgatctccatactcacaaacactgaatagctttgggcttttaaaaacaatgttttggctttaaaagaaccacaggaggctgggcgcggtggcttacgcctgtaatcccagcactttgggaggccgaggcgggcggatcatgaggtcagaagattgagaccatcctagctaacatggtgaaaccctgtctctactaaaaatacaaaaaaatcagcctggcgtggtggcaggcacctgtagtcccagctattcaggaggctgaggcaggggaatggtgtgaacccaggaggcagagcttgcaagtgagctgagatcatgccactgcactccagcctgggcgacagagcaagactccatctcaaaaaaaaaaaaaaaaaaaaaaagaaccatggcaaaagtgtcctttagccgggtgcggtggctcacacctgtaatcccagcactttgggaggccgaggcgggtggatcacgaggtcaggagattgagaccatcctggctgatacagtgaaaccccgtctctactaaacatacaaaaaattagccaggcgtggtggcaggcgcctgttgtcccagctactcaggaggctgaggcaggagaatggcgtgaacccgggaggcggagcttgcagtgagccaagattgcgccattgcattccagcctgggcaatagagcaaaactccgtctcaaaaaaaaaaaaaaaagtgtcctttagtctactgttggttcttccaaagagccatcctttcgctgatgctttaggaactcccaacctgggtcctgtcaaggataagctctcatcttattcccacaaaattcctagagttactcatcattttcctttcatattcagctcattaaagcagtttgtaggtctctgtagtccatattagtaagtgttaaaaatgtatcaatttgattttttttttttttttgagacagagtcttgctctgtagcccaggctggagtgcagtgttgcaatcatggctcactgcaacctctgcctcctgggtttaagggattctcctgcctcagcctcctgagtagctgggattataggcgtgcaccaccacgcctggctaatttttgcatttttagtagaaacggggtttcaccacgttggtcaggctggtcttgaactcctgacctcatgagccaccgctcccggccatcgatttgattattataaaatcaggttatattggtttgaccagttaaaaacatcacaggttatttaatctttttatttatttatttatttattgagacagagtctggctctgtcacccaggctggtgtacagtggtgcaatctcagctcactgcagcttcgacctcctacgtccaagcaattatcgtgcctcagcctcctgtgtagctgggattccaggtgtgcgccaccacacccagctaatttttgtatttttagtagagaccaggcttcaccacgttggccaggctggtctcgaactcctggcctcaagtgatccacccgccttggcctcccaaagtgctgggattacaggtgtgagccactgtggccagctaatcacttttttaaatcacaatttgtgttacgttcatgagtaatgggtgccagaaataatgttgtgtgttaaacataaatgtagatgggtaaccatgtatacaaatgcatatctcctcaacccagagagtgaaatttccccaccccagtgaccctgcctcgctgtatggttcattcttctccaggaattgaaacatggtggcagcctgccagcttggcgttaccattaattcttattctcttcccctgccgatgtcatggggacaccagccaaatgaactctgatgtgtctcacgtaatgcatgtggacttctggtgcatgtaaacagagggtggttattcttgattgcacatttgtgatttttagtgaggctctaagggagaagcaagaggacttgaataacagatttattctcgggcactggtacatgaaagagatgagtaatgccaaacaaataacacaattctgattcacgccattggtaatggaggagacttctgggtaaacaaaccaaagtaacagctagaatgcagatctgatcacagcagtgtgttttgattcagtctaaagatgacaaagaaaagtttctgctggtcctatctgtagcaacaagggcctgcccgcctgaccacactgcagtggaacagccacattgtgattttgcgggcctgaagcctttcgtctggtgaccctttaagaggaacttgagccaagatcttatcagtgatggagatggagacacctcaggattttccagtatcgtttttcactttttgttcttggacatagttaataacgctgccaggtctttcaaatgctgaggcatttcctcatagctccaagtagctgctgcgggtcagattctgcttgaaccgagggttcaattacaacatccgtatgctttccagcccactctctgacctttgttctttttttcagtactttttcaggctcttaatgtttccatccactaatctcaggagactctgtaaatattctgagtatacatagcccaattacttttgaaaagctaatttaatagaaacttcttgatatgaattgaataaattttttaacttaaaaatcatttacttacaacttaagacagttaaacttgagagtatttgaaagctagtaaacttcagagctttcttcagtaggcacgaactttaccatttttctgacactcagcacggtcagcaatgacacattcattggaggactcatcaatatccctaaaaatagtagcagtactcgtgcacagcctgatttcttttgaacttggctcaatttcttggaagcattgatcatgggatcccgctttgattccttttctgtagactagtgccagtttgcccagtttcattacatttttggaaagagctaaaactatggtatcgttttattgcagtcctcacatcaatcataatttggagcagtcttggtgaaagatgaggaattcagactgggatcctgggcaaggcaggtccagggggcaagagggatggaatgcagtgagtacttattttatatcataagtacagccacctcagcctcatgactttttagccacggcttcattccaaagtgaccacagtcataaggcccaaaactatcttctctctctttctctctctctctctctctctctctctctccctccctctctctgtcatagggacctccctaatcctccaggttgtacagccaggaagggtaaggtattgtcaaaaacaagtgaggtacccccttgatagctcagtgggccagagggcctctggatgctggctgatcatggcaaaaactaaatacagaatccatacagtggattctctgtgctttttctcttcacccctccttacccttgaccaaatttctgactgtgttattttcttattgcagtcctccctgctagatatacaactttgactttcatcagaagaaagtgctcccattgcattattagctaaaccatgttgcagtggcaacgctccttcttccagcttgcctcggtgtttctgtagttagcatcaggtgtccttggttctgtttaccagcctgtccagggatcacttccctggtgggatctctctggtgaccctcatctcagagctcagcggtgcctttggggctacttgccagacaactccatgtgacagagggccaggtccaagtgctcgatcaccccagccaccatttcagagttctcggattatagatccctcaacgagtcccagtgagacaccgaacatgccatagaagctatgtttttctatttcagcacacagtaaaacactacctcttagatgtcgatgagtacatgctgcttttatgttgacgcagaggacctgtgttgactcttcatcggcaaggtgtcttttttttaagtttcaattgacacataccacctctggcccaagtggaccacacagttatgcatgccctttggtgcaagatacatcacgtctccaagaactcgggtgtttttctgatcatggagaattagattccacatatagcttgtatttaggatctgcagattaggttttataaattatgtttggcaaatgataatccacaaagtagattctaagttaaaatactataaagtactataatttatgtttaaatgtctttcaacctgagagttactctcccttagaagtccccaaaaatgctgaaaccacaccaggttgatatctgacctttcacttttggaaaatgtgtatattgttgaacctctaatctagattcggacaccatcaccaaccagcttctctctttcagttgccatctgcactttactgtttagtttttgttgtctttagggaaagttgtaaaatacccacattcttctcaagttcttcaagtcttttggtttttagtaaacccttttgtgacattgtctttgagaacagaggtcaacaaacatttccttaatggactagatagtagatatatcaggacttgcagaccacatggtctctgtcctaactactcaactctgccgttatagcacaaaaccagccgtactcaatatataaatgaatgaccctgtggctgtgttccactaaaacttcataaaaataagcagctggccagatttgctgtgtgggtcttagtttgccaacccctgatctagaagaaaagagttttgtgtaatgtttgggtaataaaataaacataccaaaccatctcaggaatccctaaccttttcctcattgggaactattttcccagtatccccaagtactggtgggaatgagataaaaagggccaggcatgccattccctaaagcagatagccaaccctctttctttccctgtggaaatcccctctgcctacagggaggagaagcaactggtttggaagctgccagccagtccgtttatttagaaaattctaagcccagttccagatcactttgcgtcaactctaaaatacagccacaaatgaaataaatgttgtttataatcctaccaagtctagtaggtgtgtatgtgcttgaggttaaacttttgtgtaagctccagacttactttaggtttatagaaaattacatcgcaattgatacaatggttgtgttgggtgatggagatagaaagagggagaagaagtgaaagtgaaattttggtcaaaattggataccaccctaataagccgggagataaggggtgctgcagaactgttttctgtgatacagtgcatctacattgataatttgtgttttatgtacttttaaaatgaggctttattggcttgatttctgtgagaaaaatcactaatgggctgatcgtactgctctacttcaacatgcaagagaattgctcagacgcttgtcagatgcctgaaccacatacttatttgagaatgtgccatcataggaagctttcattcaccaaggtcaccgagagggcagcccagggaagcacgttgaacttcgcatggttctggccactcgtgtcagtagcaaagcaaggaaataaggagctgacttgcccaaaaattacaagttcagagaaaacggacttgttttgtttggaaaaggcagataacggagcagtaactaaagaatcctctttttttattattattgttgttgctcaatttataaacctaaacagaaaatgtgtgttgccttatttcctcttcttttctacagataactttcttttaaaacattctaaatattaagcaacattgtaagtacagattttttttttttttttttttttgagttggagtctcactccgatcatccagactggagtgcaatggcgcgatcttggctcactgcaacctctgcctcctgggttcaagcagttctcctgcctcggcctcctgagtagctgggattccaggcacccaccaccacatttggttaatttttgtatttttagtagagatggggtttccccatgttggccaggctagtctcgaactcctgactcacctcagcctcccaaagtgctgagagtacaggcgtgagccaccacgcccggctagtacagaattttttatggccccttttaaagactgcaaacctttttataccaaaaaaaaattatttttcctgtatttattttacacattagtaaatgaatgaaattttggctctaggtttagaaagcaatttcattttaagctcattttactgtgtcattggactttttattaattttattcttgaactacttagctgaaaatcgaattctgtcattatatgtaatcatataatgcttctcataatgttacactttaattagatgcagttgaataataacctaaaaaatcttcatagtctataaaattcacacttatatttataagacaatattatctcacccattgatacataatgttatgttaaaagtacacaatatggccaggtgtggtggctcacacctggaatcccagtactttgggaggctgaggcggcagatcacttgagcccaggagttcgacatcagcatgagcaacatgttgaaaccccgtctctaccaaaaatacaaaaattagccaggcatggtggcgcacatctgtaatcccagcaacttgggaggctgaggcaggaggatcacttgaacccaggggacagaggttgcagtgaacagaggttgcagtgagcggagattgtgcctcctctgcactccagcctggatgacagagtgatactctgtctcaaaaaataaaaagagtacacaatattatctcacccattgatacataatgttatgttaaaagcacactgcattctagagaaggtagagtaacagggtcttactttaccctcccacttgaaacaagtaaaaaactggacaaagtatatgaaaaatacatcactcagggcattggacaccaggcagcaaaaaacagtggcccctgagaaattggaaacaaagtgagtcctataattgtccttatctagaaaaagtttcctggctactgtgtagagagaaggaacccaggagaaagagctcaactgtctccctgagttgaagacagagctggggatacatcaagggaaaccaaggcagctagtttgcagaggtggaggaccggagaggagagaactgcatagagagagctttgcggatgtacagagtcctccttgagcatgcaagtgcgtactgatcaaagtgtggttgtgagaaaactacccatcaccagagaaaggatcacccgaaagaatgagggaacagtgcctgcctcccacacagtagccaagaagaggtgcctgttgccaacagctagagtgaaaacctctgaatgcaggggcactggttagaatactaagaagggtcttgccagacatccaatccaaaattagcaggcatgcaaagatctaggaaaataccacctaaaatgagaaaagtcaatcaaaactaacccattatacagatgatagaattcatagacacggacattaaagtagttgttgtgactgtagtttgcatgtttaagaaactagaagaaggatttaacatgttaaatagagacaaagaagatataacaaagatataaatcaaactgaagagatgaaaactgcagtgcctgaaatgataaaaaaaaaaaactcttaattaatagcagattagacattgcaaaagaaaagcctagttaacttaaagacatgcagtagaaactatctgaaatgaaacagaaaaaggctgaaaagaagcaagagagcaacattgagctttgggatcattttaagtagccaaaaatatgtaaaactagagtcccacaggagtggaaaaaaggaactgaaaaatatttgaagaaataatgggcaaaacgttttcaaatttgatagaaactataaactcatacattcaaaaaaatgagaacattttaaaaagagaggataaatgacacattatgtagagaggaacaaagataaattggctgatgatttcttgttggaaacaacacaaactagaaggtggtaggtcaatatttttaaagcagtgaaagaaaattcacagcctagagttttttacctggttaaaatatctttccaaaacaaagctgaaataaagactattttagacacgtaaaagctgaaaaaattcatcactagctaacctgaagtacaaaaagtgttacagaaattcctgctggcagaaagaaaatgataccagttggaaacctgaatctacccaaaggaatgaagaacaccaaaaatagtaaccgcatggatagaaagacttgttcttactgtttatcttaaaagctattactgtatacagtaattactgcataaagcaaaaataataaaaatgtagtatagcgttaaaaacatttagaagctaaatatatggcaacaataacacaaagtctaagaggagagaaatagaagcatgcttttgtaaaattcttaggctatatgtgaagtagtataactatatgtggtgtggtagtataattatatgtgaaggtagactgtgcaaagtgaaatgtgtatgtagtcatgtgctgtataataacgttttggtcaaaaacaaaccgtgtatacaacagcagttccatcagattataatactgtattttttactgtaccctttctattgtatgtttgcatgtataaatacttaccattctgttacagccacctactgtattcagaacaataacatgctatgcaggcttgtagccctggtgcagtaggctgtaccatacagccaaggtgtgtaggaggctataccatctaggtttgcaagtacactgtatgatgttcacacagtgacaaaatcacccagtgatgtgtttctcagaatgtacccgtctttaagcaacacaggactgtgctgtaaatgcaaggtaaccatttcagtaattcaacaacgttatagttaaagagttgtaaccttgttatagttaacaaagttaatatatagttatctacaaagtagataaaatgaaatcattaaaaataatccagaggaagcagaaaagggaaaaaggaacaaagaacagataggacaataagaaaaagaatagcaaaatagtagatttaaactcaactatatcgataatcacactagatataaatgtcctaaatacactaattaaaatgcaaagaatgtcagattggctaaaaatgcaagagccgactattactgtcaacaagaaaccctttttaaatctaaagacataagtaggttaaaggtaaaaggatggaaaagcgctaatactaatcaaaagaaaattgaattggtatatcaatatcaaagtagaactagagcaaagagtagtaccaaggatataaaagaggcttgtttcattatgacaaaggggccgtttcacgaacaggacatagcagttctaagtgtttaagcatataataacagagcatcaacataaatgaagaaaaaaaaagataaaattatagggaaaaatagaaaatccacaaatatagtcagaattttttaaacccctctcagaacaagtagagtaaaaatcaataaggatttagaagacttaaacaatgctacaattcagcttgactccacccaacaacagcagattacgcattcttttcaaacgtacacagaacatttgccaaaatagaccatattctgagtcacaaaatgtcttaataaatttgtaagggctcaaatcatacaaaatatgttctctaaccacagtgggattaaattagaaatcaacactgaaagacatctggaaacactccaaatatttggaaataagctacagagtgggagaaaatatttgcaagttatctatttgatataaggatttgtatatggaatactaaaactcaaaactcaatgagaaaataacgcttttaaaagatgactgaaagatttgaacacatatttcacccaagaaaatacatgaaaatatgcttaccatcacaggcattagggaaatggaaatttaaaccacagtgaataccgctgcatagctattagaatgtctacaattaaaaagattgaccagctaagcacagtagctcatgcctgtaatcccaacactttgacaggcagaggcaggaggatggcttgagcccagcctggacaacatagggaggagactctgtgtctacaataaaagaaaaagaaaattagccagttgtggtggcctagctgctcacttgggaggatgaggtgggaggattgcttgagcccaggttgaggctgtagtaagctgtgattgcaccactgcactccagcctgcaagacagagcaagaccctgtcccaaagaaaaaaaagattgggctgggcacggtggctcacagctgtaattgcatcactttgggaggctgaggcaggtggatcacttgaggtcaggagttcaagaccagcctgggcaacatggggaaaccccaactctactaaaaatacaaaaaattaattgggcatggtggcacacgcctgtaatcccagctactcgggaggctgaggcccgagaattgcttgaacccaggaaacagaggttgcagtgagccaagattgtaccactgcactccagcctgggtgacagagtgatactctgtctaaaaaaaaaaaaaaaaaagactgaccataccaaatgttggcaaggatgtggaacaactggaaccctcatacactgctggtaggaatatataacagtaccacccccttggaaatcaatttggggtcgtttcttaaaaagttaaagtgcacctgccatatagtcaagacattctctttctaaatatttacccaagagaaatgcagtatatgtccatgtaaagatccgtgcatgaatgttcgtagcagcttttttgtaataatatacagtaagctttacactttgacatgtgcagtttattgtatgtaatttgcctcaataaaagttttaaataatacaattttatccaaaataaagttgtgaaaagtagaaaaatgaggaaaaagtttcaaaggttagaggggtcagtccaggagacctaacatctaactaatgggaattccaataagacagaagaaaccagaagggaagaaattatcagagaaataatcctcagccttccacccaaaattttctctcctagaactgaaggactcccaaatcaaaagggtcagcaaaataaatgtatagactcacaccaacacacttcatcataatagtaaaaagaacagtagagtcaaaaagaggatactaaaagctttcagagggggaaaaaacaaaacatgcaaataatctggaacccgaatggcatcagacttttcaacggtaatactgggctgggtgcagtggctcacgcctgtaatcccagcactttgggaggccaaggcaggtgaatcacctgaggtcaggaattcaagaccagcctggtcaacctgatgaaaccccatctctattaatagtacaaaaattagcttatttcttaaaagccagcaagggggatggttttttccttgggctggtggcacgcatctgtaatcctagctactcgggaagctgaggcatgagaattgcttgaacttgggaggtagaggttgcagtgagccaagatcgtgccactatactctagcctgggcggcagagtgaaactgtgtcttaaaagaaaaaaataaataaaagttatcaaaaaacaaaaacaaaaccataatactggaggctagattacaatagagcaatatcttcaaaattcaaggaaaatggccaggcgcggtggctcacgcttgtaatcccagcactttggaaggccgaggcgggcggagcacgaggtcaggagatccagaccacggtgaaaccctgtctctactaaaaatacaaaaaattagccgggcgtggtggcaggcgcctgtagccccagctactccggagaggctgaggcaggagaatggcatgaacccaggaggtggagcttgcagtgagccaagatcgcgccactgcactccagcctgggcgacagagcaagactctgtctcaaaaaaaaaaaaaaaaaaaaaatcaaggaaaataatatacccagctaaaccatcatgaagtgtgataagaataatgacgaagccagacattttagaaaaatctacccctagcgccctttttctcaagaagccactagaggagtatttcactcaaatgagcaagcagaggaaggaggattgcttgagcccagcctgggcaatgtacagagaccccatgtctacaaagaaataaaagaagaaaattagccaggtgtggtggcctgtagtcctagctactcactcaggaggatgaggtaggagaattgcaagtaaatgagcaagtaaaccacagaagaatattaattttctcttttttctgctgcataacaaatgagcacacatttagtggcttaaaacagctcacatgtattatcttccatttctctgggtcagcttagctgggttctctgcttcagactgcgaaaattgtctcatctgaggcctgggttcctcatcaaagctcatttggcagaattccattccttgaagttgtgggactgagggcccagctttttgctggctgtcagctggaggccacacccaggtcccagaggccatgtgggtttttgccatgagaccttctccttcgtccattcacagcatggcagcttatttcttgaaagccagcaggggggatgggttttctctggaatctgttagatgaagtgacctcccttcactgtcactcgtgccatattctgctggtgagaagcaagtcacaggcctcacctgcactcagggagggactcactgggagtcgccgccacagtgtggctccaggaatggaaactaccacactgcagaggtgcagggaatccccaggattatggtcaagaaagagcccactaagtgttttgttcagtaggcctgcaggatgaagggtgccaggaggatggctccatgaaagactgagcctatacgtgaacgtactgaaagctgacttacagttcagccagtgtggtggtatgtgattgacagcgccctagcaagatgagcaacaaagatacaagactccagcagaaacaagctgcagaagaacaggagtgtaatcaataaatcagatggccttgctgtgaacggttacatagctctgataaatcctgatctaaccaaaagtcatgacagctcgatatttgggagctggagggggtggggagtaggggtagtaggatatgaaggagctaagtccccattgttgatattagaaatccagtgggtaacatctgaacggcaagaccaggacagcagcgaaaggcaaaaagacaccactgagtgttgacagtggctgcctttcaggagtgggaatgccactgggggcagggcagtggggggcagggaacaggtttttctgtttgttttttgtttgtttgtttgttttgttttgagatggagtttcactcttgttgcccaggctggagtgcgatggcatgatctcggctcacagctggagtgcgatggcgtgatctcggctcaccgcaacctccgccccccggattcaagcaattctcctgcttcagcctctcaagtagctaggattacaggcatgcaccaccacgcccagctaattttgtatttttagtagagacggagtttcaccatgttggtcacgctggtctcaaactcccgacctcatgtgatctgcccacctcggcctcccaaagtgctgggattacaggtgtgagccacttcgcctggccatgggaacagtcatgttgcatagtaagccctaaagagcagtgtgatctcttaagccagcacgtgatttactttggtaaaaattaaattaaaaaaaaagaaattaggccaggcgtggtggctcacacctgtaatcccaggactttggagagccgaggtaggcggttcacctaaggtcaggagttcaagaccagcctggccaacgtggtgaaaccccgtctctacttaaaatacaaaaaaaatagctgggcgtggtagtgcacatccataaatcccagccactcgggaggctgaggcaggagaattgcttgaacctgggaggtggagatttcagtgagccgagattgcgccattgcactccagcctggatgacggagtgagactctggcccaaaaaagaaaaaaataatcctattggtctcatagtgtttctctgtatttttaatatactgtgtatgtgcttatgagaaaccgaaagagaagtgatttgtgaacgatttgaggacttttggtccacgtttttttctcccacttatacttgtggcataatccagaggaagaagggcagctgcggagtcccagcagtgttgcgggtatcagggcagccagtgagaggatggaggagaaacccaggagagggcagaggaggagggacagctgtgcccacctggtcctttcattgttgtctgcctctgcccttgcagttagaaaaagagtgttctgtgtatagaagcctttgcaagtagcatagttaggagtctttcggtccaggaattgaaggtgctaaagcaggaggaaaacatacatagaagaaaggaaatgtccacataagtaagtgtattagtctgctagggctgccgtaacaaaagaccatagactgggtggcttcaacaacagaagtttattttattttctcacagttctggaggcgggaagtccaagatcagggtgctggcagggctggtttctgctgaggcctctcttcttggcttgcagacagctgtcttccctgtatgtcgtcttctctgtacacaaacatccctgtgacctcttcctcttcttttaaggacactcagtcctattggattagggccccatgcttatgacctttttgggttgttttttgtgtttgttttgagatggggtcttgctctgtcacccaggatggagtgcagtggcacgatcatggctccctacagcctcgacttcctgtctccaaatgtagtcgtattgggggattaggatgtcaatataggggttttgaggggatgcagttcagtccattatatacagtaagccacttctagacccagtctgaagtcctgagcattcagctggtatctggagtggatcacctaagaaacattacagaacaatataggcctctggtatttaaaatagtttaattacgtcacagggtagtcctgaattctttcctacttcagccagtcttggccagccgagtttcagggtagtgatgagcactgatgaggtgactcccccttctccaaactcttcctttgccactgtcccaagaaaaccataaaggggaagtttaaatgatggatgtaattttcctgacttgggctgggcgcagtggctcacacctgtaattccagcactttgggaggctgcggtgcgcagatcacctgaggtcaggagttccagaccaggctggccaacatggtgaaacgctgcctctactaaaaatgcaaaaaaaaaaaaaaaaaaaaaaaaatagccaggcatggtggcacacgccagtaatcccagctacttgggaggctgaggcaggagaattacttgaacctgggaggcagaggttgcagtgagctgagatcttgccactgcaccccagcctgggtgacagagactgtctcaaaaataataatgatttccctgtcttatgtttttctactacacagcttattatctctgggcaggagctttcccagggtcggaggggcaagggtctagttgtgagggagagaggtgaaagcaaaagggaaatgctaaatgacatggcacagcaagcaaggtctaggcagctgcgcctttgataacaagctgcttgaagagaaagaccagatcggctgagtgaaagcactgtccatcctccccaccccttccttcctgcttcctcctcttcccatctcctccagcttctccttaaagggactaccgaatgatgatttccttgccagtaggaccttgacataaaacccagcccacaacatcacagttgattttcaagggatgagcttctcagaaaccagaatttaattacttaattttgagtttccaaacaataaaatatattattaaattgatttgttttccacacgtagtggagattttcatggtgtgctacctgtcggtcaaacggctgatgaatgagtatgtcgcaaaaactctaggtgggaatatgacacatgaggaatggaatttgtgcttcagctcttcccagcatcttcttgggctgcacaagagttggtagtctttcatctcctaaggactgaagggccatttagaatcacacctgttttgagtttatagtcacgcttctgaaactttctctcttacagccttatctgacctcaatcaagctacccctgttcatttaaatactttaggtcttggctattggtttagcttaacatttgattgccataaataagaactacagaaagcgtgacttgtaaaattgtagacccagaaaaattagggaacaatctcataatactaatgaaaccttttttcccataaaataaatacataattagatatagaagattttttttttggtttaagctatcttttcctatttctatcttaaataatttacaactctcctttaatccaggcaattatcaattctataataaaataacaacaatgggtactgtgtattaaactctaaactagggtccttcatctcatttgaattttgaaatgactccataatatattgttatactcatgctgtagttatagataaagaacgagggctgacctttgacaatcacaatcaaaaaaaacaaaacaaaagaagtgaaggctgagcgaagtaactcacccagcaagatgcaattcgtatagggtagagtcccctgtctcccgataatgctttgccccacacctgaaagtcttgatctggttcccattacccctcagactttgggtccccagtagaacctttgcacttgcagttctccttcctaatgggctcagggaaactcacatgactgcctggaggctgtttctgcacctgtagatgggaatgggcaagtctctcccgactcacttgtctcatagtgttgttgaaaggctcaggtgtgatcattacagtgaaataaggaaaggcagggaagaatctccatcgttctccaaatacgaagaatgaaatgcaatttttttttttttctttttgagacgaagtctcactcttgtcacccaggctggagtgcagtggtgccatctcggctcactgcaacctctgcctcccaggttcaagcgattctcctgcctcaacctcccgagtagctgagattacaggcacctgccaccatgcccagctaatttgtgtatttttagtagagatggagtttcaccatgttggccaggatggtctcgatttcttgacctcgtgatctgcccacctcggcctctcaaagtgctgggattacaggcgtgagccacagcgcccggccacaaataagtttatacccttgtagtcatggcctttcttttatctttctggtaatgaataaaaatgaagcatataagtgacagagaaaccagctacttgatcaatagtggcattgtttcacaattgtctgtattggattttgccaacccactagagagttaccaaagcacatttctgacataactatgattgatttttttttaatttttgactaaatatgttactttgactaaattggttacttcattgcataatggtgaccatttacacttttcagataggtacaaaaaatctgtgtattctagctggccatgaaagagtagcaagcctgttatttttaagaaaaaagctcgagtagttactgtatttgtatcattttggaaatctctcatttttctaatcagcaaaatggggataatgtaaataacaataaccctgacctcacagggttcttgggattaaatgagatatggtgcatacaacgtgcttagcatggcgcctggagtatggtcagaacttaacaaacacaagttataaatgaggtcccgaaatacaagaaattcacttcctcagaaaccttccttgagcctggctacatctatagctacattttctacatgttaaatgcctccctcagaagtgtcactgttggagttgccagggcaccaatttattactttgaaaatagataaataaaagaatcaagacaaaagaaaaaggtgctaccaaagaagacattctgtcttacactggatcacacgagatgtggatatttggcccggaactgctcacatgggtcagcaagcctgagaatgaccgtggagagaaatggctggggctgcaggactcagccaagcctggcacgcgtgtcttccgggcaccggagcaggacgttgtctgaaaacatgaagaatgaaatggaagtaatgtaatacctggggtcggggctgggggaagctttctaagtacaggcagggtctttctatgttgcccagggtggtcttgaactcctggccccaagcgatcctcccacctcggcttcccaaagtgtggggattgcgagtgtgggccactgtgcctggcctaattactgattttaaatattaatctttctaaaagtcaaactccagaactgtgcatgtagaactattcaatttctgtatataactatagaaatatatattagacgggccgggcgtggtggctcatgcctgtaatcccagcactttgggaggccgaggcgggcagatcacgaggtcaggagatcgagaccatcctggctaacacacggtgaaaccccgtctctactaaaaatacaaaaaattagccaggcgtggtggcgggtgcctgtagtcccagctactcgggaggctgaggcaggagaatcgcttgaacccgggaggtggagcttgcagtgagccgagatcgcgccactgcactccagcctgggtgacagagtgagactccatctcaaagaaaaaaaaaaaaaaatatatatatatatatatatgtatatatttatatatgtatatacacacacacacacattagataagcacattgtttatataggaatcaaaaattacctgtgagtaatttttatttatgtaatttaataattacataaaaattatttgcagaggttacctctggaagcagtattagaagtggaggacttttttcttctatgttgaaaatattttaagtaaatttttaaaaacgaatagaaatttaatcaggaacaggctttctaccattaaaaaactttatagtcttctttacaaaagaagagaaataattgtacttgttcagtcattcaaggccactgaaataattggcatagcttgagctctgtagtactgtcacaatatgcaaacacagtgtggtaatttttatagtaattgaacatgacttacgtcttagaaagtcataagttaggaatttattctgttcgttcttttgaagtgaaaagtaaagaaagcaaaacattttttggccgggcgcgttgtctcacgcctgtaatcccagcactttgggaagccgaggcgggtggatcacctgaggtcaggagtttgagaccagcctggccaacatggcaaaaccccatctctactaaaaattcaaaaattacctggccatggtggtgggtgcctgtaatcccagctactcgggaggctgaagcaggagaatcacttgaggccaggaggcagaggttgcagtgagcagagattgtgctactacacttcagcctgggcgacagagcgagactctgtctcaaaaaaaaaaacaatgactttgacctgaatgtcccaagggtctgctttgtgtagtctgcccctctacaagcagggaccaggtcttggtcacctggtgtccttgtagtaagctcttagcagggactgggtcctggtcacctgggtgtcctggtagtaagctcttagcagggactgggtcctggtcacctgggtgtccttgtagtaagctcttagcaaaggttgctgagtcgaatgaacttcaccgtttcggtcctttggtacagtaacaggcactcaagagagtccacgctgtagggttgatcagccaccatgagagagaagtatactctaagagcacacaccatcaaccccagagcatccctgccgaccaggaatgtagttacagcggtgcaggttcccagctaccccaaagaaatcccaggagagtccatctctactaagtcaagcaaatagaaattgcaactgtagcagcacaatctattttcattatatagtgtgtgtctctctctcccctcatctctctctctctctcctttcccctcggtcacttgacattgatactgggccatttatcctcgtgcatcatcttagagttacatttgtataattatcaacatggccatttgatataaacaattccgtccctcacatccaaagaaaagggaagagacagaaagaaaaggcctaatttctgagcaatttttgttgtttgtttcccattttgtaattgtcctccatctttactcatctgtttttttaaatattaattatttttttgagacagggtctggctctgttgctcaggctggagtacagtggtgcacatggcttactgtagcctcgacctcctgggctcaagagatcctcccacctcagccccctaagtaactgggaccacaattgtgcaccaccacacctggctaatttttgtttgttttttgtagagatggggctttgccatattgcccaggctggtcttgaactcctgggctcaatccatcctcctacctgagcctctcaaagtgtcaggattacaggcgtgaaccaccatgcctgaccaaaaatactttctgagggtctaatattgccaggcaccgtgttaacaattcagaaaatactcctgcttaataaataaagacttgaatttttttagttacttcattgaaaagaaaatctttttatttaaattgtatcgtcagccaggcgcaattgctcacccctataatcccagcactttgggaggccgaggcagacgaatcatttgagtcaggagttcaagactagtctggccaccgtggtgaaaccttgtctctaccaaaaatacaaaaattagccaggcatggcggcgggcacctgtaatcccagctatttgggaggctgagacaggagaattgcttgaacccacgaggcggaggctgcagtgagctgagatcacgctgctgcagtccagcctgggcgacagagccagaggccatctcaaaaataaataaataaataaataaataaataaataaataaataaataataaaattgtgatgtagttaactggtataatcttttcagttatttttaaatttttgaaacaacacgctgtatatcagccatccatcagagaaggaaagaaatatgtagaaggactgtcttctgcttcagatcatgaactgtaggaacaaaatagatatgtgtaaaaatgctgctccttttctgaaccaaaataaaattagatttttgttgttgtggttgttgttggaaaaggtagtagatttcaggcaaaatcagaaaataaattatttcagaaacacaacaaaactaagtacaacgatattttggttaagaaaattatggttagaaattatgattctatcactttatgaaacagaatctttaataatttttcagcttataccaaggatattcttttatttcttaatgactagttttaaatatatgactattctctctgtacagatttttaattaatgctcataaaggctattgatagaactcattctttctccaaaatggagttaacccgaaatgggtagagattcagaagcttcattgtagttaaaattagggtcatgaagggcaaaagcccaggtatttcagcctttgtagaagaatccattaatgcagcattacaagtaagtgtaatttagtggctccttagttattttaagcaagaggcctccttaaagggcacacagataaagtcaacatagatctccactgaccccaggcgtgcggccagaggtcaactcccaacggctgtctgggctcctttttccctgcagtgctgtatgtctgggggggtgacaatcctttgataacagttttttttattgggagaaaatttgtgggaatgcataaggtcttgctaacataattccacattatgcttgctcaacaggagaagttttagtttaaatgtagacttattggagatggctgtatatctgcaggtcagggagtctcgcgtctgcagattctttgtggtttctcgtctgtcgtcgcttatcccaaataagtagctgcacttcttggaagagatgattgcgtcacttgaaggggtcatgggagtctactgattgaactcatttttctcccatctgaaagaaagaaaagttgaaacaagaggaaagacatttcacactttctggcatttaatatttcggctagtttttgtttgtttgtttcttttttgagacagattctctctctgttgcccaggctggagtgcattggtgcactctcggctcactgcaacctctgcctcccgagttcaaacgattctccttcctcggcctcccaagtagctaaaacgacgggtgctcattaccacacccagctaatttttttttttttttttttgtatttgtagaagagacagagtttcgccatgttggccaggctgacttcaagtgatccgcccgcctcggcctcccaaaatgctgggattacaggcatgagccactgcgcccggcctggccaggtttagatcctggttttgtgaaagaatcagaatgactagaagattcatgttccgatccactgcagctaacaaatacagctccaggaaccgcacaaatcctgcatcgcctttcatcagcagatagttaaaggcggagaattgggttttcttgtttgtaaagatagtgcgtgtaaacaagcatgcagtaaattatgttatctgcagtagagtcttccattggtagctttggtcagacgagctgaaatacactgccttcagggttcttcttggtttgtcaccgtgagtagagatttgaatttacactgcctcatctgtactgaattctgcccttgctgtgaatcatgtcacagtctcagaagcagcagcagccatagagtccagtgacatccttaccagtaagatacctttgacctagagagttcatttcaggggtggggcagcatcagtgtggctaaatgtgaatattcatttctttttcttaaactataaaatgcttgttcttttccaaatccatagctaggcacagattatagaggcatcttaaaaagccttctatagctgggtgcagtggctcacgcctgtaatcccagcactttgggaggctgaggcgggtggatcacttgaggtcaggagtttgagaccagcctagccaacatggtcaaaccctgtctctaccaaaaatacaaaaaattagccgggcatggtggcaggtgcctataatcccagctactcgggaggccgaagcaggagaatcgcttgaacccgggaggtggagattgcagtgagccgagatcgtgccactgcactccagcctgggtgagagtgagactctgtctcaaaaacaaaaacctcctataaatgccataagatgccggcaaatgccatctcaaaatgcagttaggcaggaaaattacctggtatgagttgtaacctaggcaactggaaaaaaatatgtgtccaccagttacccttgtgtttgatgtttcaagtagtagaacagtataagtgtggttttctttctggggtctcccccattgtatgcactcactgtagtaaccagaggaaaatgttaccttcctgctgggaaccttaacttccgaggctgtgatacccatcttcatacctaaagttttaacatatagcaagtccccacctacaagcaggtcttatgtcaaaagtgtagttgcagtttattgcctggaacccggaatggattttcccataggcgtgttatgaacggcagctgtattccaggcagctgtggaagcctttttagcccatttatatacctgaagtgcagtcatgtgcaattagcaagacaagaaccagccatcatccatcacaatgttttatgtgttcccccagcctccccactcccactctcagttggcccagctaggcagggaagggggtgttaatgaggcctgcaggtgcacagatttactccccacctgctgcatctgcaggggttaaaccggcttttccctccccttcgctctcaccattccttctctccctctccccacccccagtctccctttccctgtgctgaaggggctgggcagtgaagtgaggaagggtggctggagctgttgggggctgaggccacattgtgcagttcacatcagaaccccctggggacttgctccagttgcagattcaaatgcagcaggtctggggtgggctctgaaattccgaatatctaacaggctcccaggtaatgcccatgcacaggcccacaggccccatttgagtaacaggagtctctaaacaccatgcagggaggagaggctggtgaagagggaaacctcgagtcacgactgaaaggcagtggagggtgagagctgagttctattctctaggccttagggaggtcccttttacactgagaactttttgccacatgggaagaagcaggcaaaccctggatgccatcaggtgctggcacatcgcagcctcatctcatgcaaggtgttcttggccagggcctgtggaggttctacatgatatggcattaaccctcgggagagcaggcacagtagaacctgaatgtctcctccaagcgactgggtgcagcatcgctccatgtgactgggtgcagcatcgccccatgcgactgggtgcagcattgccccatgcgactgggtgcagcatcgttccatgcgactgggtgcagcatcgttccatgcgactgggtgcagcatcgccccatgcgactgggtgcagcatcgttccatgcgactgggtgcagcatcgttccatgcgactgggtgcagcatcgccccatgcgactgggtgcagcatcgttccatgcgactgggtgcagcatcgttccatgcgactgggtacagcatcgttctatgtgactgggtgcagcatcgccccatgtgactgggtgcagcatcgttccatgcgactgggtgcagcatcgttccatgcgactgggtgcagcattgccccatgtgactgggtgcagcatcgttccatgcgactgggtgcagcattgctccatgtgactgggtgcatattgctccatgggcatggtttgtatgaaacactcactattaaagcacagtaggaaatgctgaaatggaaaaggaatgggtcatccgggagccccaggatctagaccctggagcagtgtttcagggcctgaggatccgtcaagggggccagcatcagaagccccagcacacagggggcttctgatgcaggaggagagtgtgcggtttgaagatctttcatcccaacacagcaaggcggtgaagaaccagttttcatcctgtctccaccactaactagccatgtgtccttgagctcataccctcatgcctaagtgtcctctgtcctcatccgtaaagtaaggctaaaatgagtacctacctcattagggtgctgggaagctcaatgagattatttctgtaaaacccttagactgtccattaagtgtcacaaaagcagtcgtaggggtggctgtggcggtatggtagtggtgaaatgagtaatttgagattataggcctaaagtcaaatttctggttttgcaactttttactagtgtgacctgggcaagtgacttagcctctccaaacctcagtttcttcccttgtaaaatggaaataataaaagttcctacctgctatattattgagaggataaaatgaggaaagcacgtagcacagtgcccatcacaaagcaagctctcagtagatatcagttactgttattgagggagaccggggtgacgactggcatctgaacaggagttttccagctgtgctccaggagctataggttttacaaaaatgtgtcttgggggtgagaaggaggccattattcaccctgcccacacctgctgcccccttcaacctgatgggcttgtctttgttggcgttcagcatgaagattttattgagaagaaaaggtttggagtttggaagatcactgttttgtagttcgggtgtgttatggggccacagggaaggtaaatggtctcaattttcaggaagttgacatttgccttttctacttcatttccttaaacaaaaattgaaatatcagatgacaaatttaaagagatatatcccatataaaacctaaagttctatgaggctgtattgaacgatagagttaatttgcatcatcagatgttgtggccgctttgtagcatttgctaatctgtaacgcttggttttctcccccagatgagcaccatgccaggactgcccacccggccctgcttttatgacatagatcttgataccgaaacagaacaagttaaaggcttgttctaagtggacaaggctctcacaggacccgatgcaggtaggctgatgtgcttcaactttttctctctttgtttttttccagttcatatcctttttttgtcattttttttttctgataccacagaagtgatctgataaatcctttccttcctttgttactcaaattcctaccaaatgattttccgtgactggagttcactcctgggtgtggctgtgagttacatgctcagatgctcagtacacaacccttagtgtcctgcgctcgagtccagtgaaagccaagttatgtcatccctgaatatagatgtgtttagagcatctctgaccataacagaactctgtaaactcattgttcttttccaggattaaaaccagcgtctgttataattttaaaagagtaacttcctaccttcctgccacgtatctcttggtacagagctagaatcatgtgaaagaggaatcttggtgtatccgtttcctggggctgccatgacaaagtatcgcaaactgggtggcttaaaacagtggaaagtttgaaacagttctggaggctagaagtccaaagtcaaggtgtcagccaggccatacgccacctcgagactctgggtggaatccttgctggcctcttcctagcatccagtggtggctgtcactccctggcgttcccaccttgcagctgcgtcactcccgtctcagcctctgtggtcccaccacgttctccctgtgtctgtgtcttcacatgatgttcacctcttataaggaccccagtcctattggattagggcccaccctaagaacctccttttaacttgattactctgcaaagaccctccttccaaataagatcactctcagccaagcactttgggaggccgaggtgggtggatcacgaagtcaggagttcaagaccagcctggccaagatggtgaaaccccgtctctactaaaaatacgaaaattagctgggcgtgttggtgggcacctgtaatcccagctactcgggaggctgaggcagagaattgcttgaacccgggaggcggaggttgcagtgagctgagattgcgccactgcactccagcctgggcgacagagcaagactctccttctaaaaaaaaaaaaatcactctcacaggtgctcagggttaggacttaagcatatcttttaggggacacagttcaacccagaacactcaactgtgtggcacaacaggtgtgttcggctctcttgtccctggacagacacatagccatgggacagaccatttaactagagggccccatgggttccaggaagggcagggcagcagaaagtaggccacttgatgacttcgggtttgcacagtctcaggttgggctttgactctgagctgtcttaggcagcccagacctggggactctcggtcttattcatgtccacgccacagcactgcagccatacctgctggcttctatcctgactccccatcgtgaagaaaaatgaccacattcctaaacctcttccctgggagacaactcctaatcagaagcttgaaaggctcagggctgcttctcctaccccagggatcaaacatgtcctcaccatattctaaagacacattctttccccgcaagcaccccgcctccttctccccactgactcctgttcctgagcccagaacctctccctcttgccagcatattctcggcctttgcagatgagcttttgtggcctaaagaccttcttcttcaaccatctctgagttacggctccaagccaggcacccaggattctcatttcatttgtttcactaccaggagtccacttgaggacttgttgttgttgttgttgtttgagacagagtctcgcgctatcacctaggctggagttcagtggcgtgatctctgctcactgcaacctccgcctcccgggttcaagcaattctcttgcctcaccctcccaagtagctgggattacaggtgtgtgccaccacgccccgctgatttttgtattttatttatgtatttatttatttgcgacagagtcttactctgttgccaaggctggagtgcagcggcactgtgtgggctcactacaacctctgtctcctgggttcaagcaattctcctgcctcagcctcccaagcagttgggattacaggcgtccaccaccatgcccagctagtttttttatttttagtagagacagggtttcaccatgttggccaggctggtctcgaactcctgacctcaggtgatccacccgcctcagcctcccaaagtgctgagattacaggcgggagccaccacgcccagcctaatttttgtattttaatagagatggggttttaccgtgttggccaggctggtctcaaactcctgacctcaagtgagccacctcgtctggccaagtttttttgttgaggctttgttgctaaaacactaaagacctaggctatggtgagaaagataagggaaccataaatgaaattacattaaaacaaagtgtgaaattgtttgttttgagttgtggatgttgtttgggggtgtttgtatgtgttttttgctgaggagcgggagctgtgttaagtttgagccataactgcatctttgatctttgttatttcagaaaaaataaaactctagaaaatgaagtaagggagactagtttaacaaagaaacccataaactcaagtgttgataaaatgttgtttcatcttttggtgtgagcttgtgtgttgccaatgtcttccattccccagtaaggctgtggggaaataattgctatttccccaattgctagttggcctagcaattctctttttatgtcaggaacccattatgttacatttctgccatttgtcatttttctccagaataagtgtgtttgattctcccatctctcttggacagtatttttccagcttttggtgagttttcacatgctctccaagtaggtcatataagtccaattataccttaatcactgtagttaggactcaggtcctactcagggatacatccttagcattattaatgcatacccttaaatcctttattacctactccctaacaagaattcctccagatcttatatacggggcctgcagggcaggacacaggcctatggtaattacttccaatgtatcgggcattgtgctaagcactttgcatgggtggtcacagcacctctggagccaagtgttgtcccataagggccacaaggcttcaagaggacggagcctaccccttggtcactgaggggtggccctggtctgcaaggctacagaactgccttgccaccctgtggcactgcctctcatttcatagctggcacatgtcattttgccacccccatcacatgtcatgctggcatcaacccagggaggtgggtagtatttttgttgaagagctgcaagaactctgcccagagaagtcgacaacctgctcaagttgtgcagctaataactacaaaagccaagactcaactcagatctgttgactctcagtattaccccaacctttatgccccaaaccaaaggatgcccttttcatttcagtcacgggtaaaatgaactttggcccattccgaaagatgataccagctatttgaacagacaggtacttgaggataatgaggtaattttttctaataagtaaagataattgtttgggtattaaaagctatgattttgtcataattctttttagtccaagtataatagagccagctctttcctaattctctaatggaatggcatttctaccccttacccaccccccaatccaaggcctctttcttctttgtgaattgctaaatacagttctgggctagtgggcagtggttcaaaacccatcgtttgaccctgcttgaacaatcaaaaacagatccagtgtcctaagataaaaccactatacaaagcaaacattccctctcagtggctcctcggtaatgacccagcaagtattgtctgtttcccgtgcctctcactatagccatcagggaccacttctactaataatcagaggtctgcggctattcaaaatgcataaaataaaaatgttaaagcttaggtgacagcttggacaaacgtgggcatctgaaaggaaatgtctggcttgctgacgttgctccttcagggatcacaccgtagatggtgtgcatacccaggtgcggagcagcacactcattattcccccaggaaagtgttgaaggcgcgttccactcaggaagaagattgtgcttggttgatgacaactttctgtccttcccttcctcacctttctagcctgtctcacctcctaggaaaccgtgtgaaaccaaaggtgaacattatatgccaaaaaacatcagaattggagctctccttgctccctcttcccaagacttctctgtagtgccttcactgtggttagaataagggcatgactcattcttttggatgtcactaaatagaactaattaaaatagattttttgtcccagtgaaattgatccggctgttgagtcttttgtttaaagattattggaatgaaggatttgatacttttccccccattcttttttctcacttggaaactttatcatatttctgagctttggcaagattcattcaaatgaacacacaataaagtctggcaaatttcctgaagaattcaaggactcccttacttctttattgtactgtgcaaagttacgttgagtacggaatcagattcactccagtcctgctacaaatgtttgttatttacaaaagaattgctttttcttgaattacatacacagaaataagttcaggaaagaaattagtttctttcctaaactggctttagggcatctacagacaaatggttaaagaaaatgtggtatgtatagagagtggaatactacttagccattaaaaaagaatgaaataatgtcatttacagcagcatggatggaagtggaagttattatgtgaaataagctgggcacggaaagactaatgctgcatgttctcactctcatgtggaagctaaaaagcttaccctcatagacagaataaatggtagataccagaggctgggaaggatgggtggctgggaggaggttatgaagaaaggttggttatgggtacaaacatacagttagacgaagaaataagctctaatgtttgatagcaaactaggatgactatactcagcaacaatattttgtatacttcaaagtaacaggaagagagtggggtgtacttgaaatgataccaacatacagtagtaatgataaatactcaagataatggacaccccaggtaccctgacttgatcactacacattccaggcacataataaacactcatatataccccataagaatataaaatattaggccaggtgtggtggctcatgcttctaatctcagcagtttgggagtccgagtgggtggatcacttgagcccaggaattcgagaccagcctgggaaacatggcaaaaccctgtccctactaaaaatagaaaaattagccaggcgtcatggcacgcacctgtaatctcagctactcaggaggctgaggcaggcaaatctcttgaacccaggaggtggaggctgcagtgagctgagatcatgccactgcactctagcctgggtgacagagcaagactcggtctcaaaaatatatataatgtatcaatacaagggaaaaatgggcagaaattttcaatgatatttaataaccataaattaatcttgagttgggttgctgcctgccagcccttctgtgaacatgatttgttcagtcccaagtcacaaaccacagggttacaaagtaccctgggagggtgcctgagctctgtggttttagtcttgaaactttatcttttcacaaagcaattcaaaaattgctcatcaccattgtgttccgagaaaaggggcgccaaggcatcaccctgagccatccgaggagtgctgtgtgccttcttcctttctgcttccaagtaggatggaagctccagctttatacttaaataatcctcatcaacatctaaaagatagtgataattaaatctctcctatctaactaaaatggaatgttttaaagcttaggtaacaattctgaaattcttaattccccccaaaacaaactttttctgagcacattttgatttcttattcccatgccagaatagactgttttgtatatggtatcttccaagatattttcccactgagttaacttctgaaattgcttcttccaacgcataagcaataaacaacagattcgtttttacattctcaccttagctattgcatctctgattgttttcatctataatgagactttctatactttggccagtccttctgtttttcttaaaatgtgggaccacaggccaggcacggtagctcgcatctgtaatcccagcaatttgggaggccgaggcaggcggatcacctgaggtcaggagttcaagaccagcctggccaacatggtgaaaccccatctctactaaaaatacaaaaattagtcgggcatggtggcgggtacctgtaatcccagctacttgggaagctgaaccctgagaattgcttggacccaggaggcgaaggttgcagtgagctgatatcgcatcgctgcactccagtgtgggcaacagagcaagactccatctcaaaaaaaaaaaaaaaaagtgggaccacatactctaagcacctttagacaaaaccacaggatacaaatgtaatgtggctaatcagctggtcttccaccacccacctctggagcatggaaggccttgtccagccttgccttgccaagccaagggtcatctctagtccactgagcccaccctctaccctagcacccctcctgtcccaagagtcattgaccctcaggtcaagggataccagagccactacagtgaggctggccgtgtctctgaaatattttctttttttttttttgcccttctctcttcctcggcgctgcctatggaggtggcagccatctcctcctcggcatcttggccgccctcagaccccttgtgaagcccaagatcgtcaaaaagagaaccaagaagttcatccggcaccagtcagaccattatgtcaaaattaagcgtaactggtggaaacccagaggcattgacaacagggttcgtagaagattcagggtccagatcttgatgcccaacactggttatgggagcaacaaaaaaacaaagcacatgctgcccagtggcttccggaagttcctggtccacaacgtcaaggagctggaagtgctgctgatgtgcaacaatcgtacttgtgccgagatcgctcacaatgtttcctccaagaaccgcaaagccatcgtggaaagagctgcccaactggccatcacagtcaccaaccccagtgccaggctgtgcagcgaagaaaatgagtagacagctcgtgtgcacattttctgtttaaataaatgtaaaaacagccatctggcatcttcctttaaaaaaaaagaaaagaaagaaatattttctttcttttctttttttttttttttttgagacgcagtctcgctctgtcacccaggctgaagtgcagtggcacgatctcggctcactgcaagctccgcctcccgggttcacgccattctcctgcctcaacctccagagtagctgggactacaggcacctgccaccacgcccagctaatttttttgtatttttttaatagacacggggtttcaccgtgttagacaggatggtcttgatctcctgacctcgtgatccacccgtgagccaccgcgcctggcctgaaatattttatttttgttcatctttgttgtgcttataatactcctgttttctgtttattcccctgacttgaaccagatgttaggggagtatttgaagctcctcgttccctctcttcatcaatatcttctgtctagaaactaaccaagcaccttatctggctccagacctctcagtgatctgtgggaggccaactcgcaggatttcagcagagtttgcactttctaggcctaaaagataagtccttccatgtgtaagttcagattaaaggcaacatattgcatttacattttagagaggtgaacacattattttctgggacttaagtgttgttttgtttcttttttttttttttaatgtagtttatttctctttctaagagattacaggattcaagaatggcaatgaatcttaatagcctttgggagaaagcagcaaagctttaatactaagttccaggaccatgaacttccatgttgtcctaaatgcatttttcaaacattgctttctgtgcctactctataaaacctaaaaatccaaggtgacagtattccttatctaaaatcctaaacaaggctgggcgtggtggttcatacctgtaatcccagcactttgggaggacaaggcaggcggatcacttgagcccaggagttcaagaccagcctggccaacgtggtgaaacctcgtctttactaaaaatacaaaaattagccgggcatggtggtgcacacttgtaatcccagctactccggaggctgtggcgggaggattgcttgaacccgggagacggaggttgcagtgagccgagatctcgccactacactccagcctgggcgacaaagtgagactctgtctcaaaaaattaaaaaaaaatttttttaaatcctaaatattctcattccacaggatcctgcaaactgtagatcccaaacttggaagttctgggaattctgccagtatccccaagtaaatctcttgggaagtttagaatgctgcatggcgtagctgtgcctgctcttatagagtggtgcagactctgcttctccacgtctgctaagtaaaatattccaaacacagatcagccttatctagcgaaccatcactctgctcttgaattttcttttggcctcaaactctagagctataacatgttaacggtttaacaccagaggagaaagctattcttaaactactcaaacatggtttttttttctatttttcagactcctgaaacagactactctttgcctttttgctgcagttggagaagaaactgaatttgaaaaatgtctgttatgcaatgctggagacatggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaa

SEQ ID NO: 2023 - DNA, 81526 bp, Homo sapiens
cgagctgtgccccacgctcccgctgcaacagtcccgggcatcgcagctgccagtcaaggctaggaggcggtcggggactccgcctcctcccgacccgtaggtctgggagcgcaagtcctgttgcagtcttgcaaagtgtaaagctgtcagccgcagagcacggaggaaagacggagagaatggaagagctcctgtccggtgtgccagcagcccggactggcggtgagcgcgagggaggctactgagaagcccggcgacggaggaacgcaggtctgctgccaggtaggtttagcgagctttttaaaggctacaggcgttgcaagaccggaatggtgttgctggactaaggaaaaaggacaggaaactcactgtgacaccacaatttttcgattttctgtctctagtgctcaaaccatacagaactgaattcattctgaatgccttaaacacctgttaacttagaagaaaaatgcctttgttaaaggaaagtagtttcatttctaataaaacagtttctataatagaatgtattgtagaatccgagattagaccagacctctccctaggtcttaaggggagaccaaaagttggcataatctcggattatgcattatagtgcttattttatcaggtaattgctaatgaaacagtgaaactctgatactacgagagccattctcaaatttaagttaaaatcgaactgattgtcgtttgtgcagggaaaaggtaggtatcttttgcttattctttctaaaacaccttttgtttttctcatgagtttcaaggatcctgctgtaagtctactcctcatgcatatacactattcacataaagatttcccagaaattaattcccttctctgggaaatgttcttttttcatgttctcataacagactgtcagtttcatattgctttctgccacatgtatcttatcaaaacattagctctgaggttcttaacaggactatctctgctcttccgatttggcatttctggacgtttatttgaacattgagaggtataaattaaatggcaatgtatctaacatttctgaggaagcagattagggggtgtctgtgcccagaagcaaaataaatgaactttgggatgactcagtttttagggtgtgggtaagaggcaaaaggaacctagccagtcctaactgagttgctggctaattagagtatctgtctgccgcagctttcactgaaatgagcctcttggtccctttcacatcaaatccctctgtgagtccctccttctccttagtttatctttccttcacaacctgggtccttttcatggacagcagtgccttaaatacttctaaaactatcctgagggggagaaaaacctatagcagatccacaaagccacttgtagataattgtattatgaaatccaaggtcatggtttcacacaactcctgctctgcccttgcacacctttgactggcatttttttttttatttttgtcgtgggcataaacttagaaaagtgggaaagggaaaaacctcagtttcaaaagtagtctctgactaattaattatcttgattaaaaaaaggtaaacatatatagtgaacgtgaaaaagatgttgagtagtagaattgggttgcttggctttttatttaaaacaaacaaaactcaaccaaaaaaaccccccaaaaccccaaacaatcaccctagataactttctcctacactactgtgctggaagtcgggcttgagtgtggtcaaatcctgcccatttacccagagttttacaaatatttacagtcatctatgccaaatatctttgtgctgagtcccaaagaacattctcagcattcaaaaggcccattctcatgaatggtttcagttcattggcaatttaaaggcattcaggcttccaaactaggtcagcttaagacatgtctttttaaaataatcagtttttgggtctcagattatgaaccaggtttttggagccaaactctacagcagagagaagagtatgctctctctggaaagaaaaagcttattttatctacctggtatgaccatttaacttcctgaaaaacgtctttctcctcagtagtatgaatatttttcatctgaggaggtgcacttaaaatttccttcttgaaaagtcatttcaatattttagacgtttagaaacatttatatgtatgtcagaatcctttctccgaagtgtttctgctaatcctggcttctttgtttcccctggccttgactttatgacattactttcttggagagtgaagtttttagtgtttgaaatctccagtttgagatagaggtcaggaatcatgctgaacccagatgttactgaaggaacaaagtctgagcagttttgggactaagcctactttgtacaactgattattttggatgtgggaaaagggccaagctgccagacaagtcatgcttttcacttggactttggggaataggtatctgtagccattgctcctaagtactgaaacatttctttcaggggtgcctaccttaatttatagaagctccttacctgaaacaaatggtcaatattttcagcttgtgaatttctggaagtgaatacagatgagaaccaggcctttaatattttctctcctccaagtacaatcagaaaagttatccactctactactgagtgactgatttgctaggtgctaggttagatgctgggatataaagatggctaagatgtggtctctgtccggaagaaattctcataaggtcagaagtgacttgggtctagagtggtagttctgaattcacattgctttgccagattataaaaagtacttcgatgtttgtcacctcgatcatcttaattttcttggtagtgttaccttgaccatttgaccattaagaggtatatgacacctaagttaatttatgtaaatattttaattcataatttttacctttaggtgtatgtgggaggtcttggactaaagttttagttttattaactttggcatttgctatttacccagtcggtgagtactttggaacctaatgcatcataccatagttgttattaaaaaatggataactatatattaaatgagtaaaaatgaccaatgcttctgcaacgtggaatgaggatcttctcatctatgagcagatctctttcttgaattcaaaacacagcaatctaagtgaaatagacttttcttattcatagctggagatacttctgatcacatggcttggagtatttattaagagcatactttgaaagccatgtcccattgttttctaaatcttttgaagtcacgagtttgagtcccagcccttcatcaacttgttctttgtttttcttgggaagataaaacaagacaactcgtttctgtctgttgaacttgtggctgaaaccataaacccacacattctcctgcatatgattatatgaaatcctctgttgaaaacctcctcaactagttgactcttaataagtaggagctgggtttaatcacctttacatccctagcacctaatgtgtagaatttgttctttgtgtgttgactttgtttccttcatgataaattcctgttataggaaattaattggcaaagacatacaaaaatctacacctgcactttgctcaggtggggtgaagattcctcttccaaactggtttccaatttgtttctaattaaaatttctatatgaaacttttaactttaacaggagggggtaatattggcacatgcttttattcatttgaaaaaaaatttttgatttagatattcgtgctttagcggctctggttttctggtaatgtcctgacccaagaaatcagcctggctcttgctctataaggctctttgaaataccacttctccttgattggtcaattacatcattgtctgacctgcctttaagtggcgttccttcctgcttctgagctttgttgttatgccaggcatagggaagaaaattatttagcagggctgtgtgaataattgtgggaggcagggaaccactgattaaaacaggagtgggcaaggcacagtggtgatattgaagaggtagctaccatgatgaatgcaaaattgccatgccaaaaatatcattgagctgttattctcatattcactcccaccttctttgataagtttatattgtttggaaaactgggaatggatttctacctcttgggccttaccctgtagggtaatgagaacatggaaagaaggcaagaagaaatgtgcttttaagaaaaagccagttgcggtggctcatgcctgtaatcccagcactttgggaggctgaggtgggctgatcacgaggtcaggagatcgagaccatcctggcaaacacggtgaaaccacatctctactaaaaatacaaaaaaattagccaagcgtggtggtgggcgcctgtagtcccagctactcgggaggctgaggcaggaggatggcgtgaacccaggaggcggagcttgcagtgagccgagatcgggccactgcactccagcctgggggacagagccagactccatctcaaaaaaaaaggagcagcagtttgcaaatgttaaaactagatgtgccaagggccaggcgcggtgacttacgcctgtaatcccagcactttgggaggccgacgcgggaggatcacggaggtcaggagatcgagaccatcctggctaacatggtgaaaccccatctctactaaaaaaaaaaaaaaaaaaaaaaaaaaattaggtgtggtggcaggtgcctgtagtcccagctacttgggaggctgaggcaggagaatggcgtgaacccaggaggcagagcttgcagcaagctgagatagcaccactgcactgcagcctgggcgacagagcgagactccgtctcaaaaaaaaaacgatgtgccagatgttctgtcctctgtaggatttggagttagcttatcacaacgtcatgtacattgttggccatgcttggacatcagcaccaatatatattttgtaagaaaaaatattagatctcactaaattagttgtaacagactttattcataacctaatttcaagcagcaaagagattgtttggaaaacagttcttgctaatactttaagatgcttctccttcctgatgaagtgcctactttttttttttaacccacaaaaaggttaatagggctatatttgcatatcagttccatttttagaaggttaatagtctccaagttacaaagttgtgatctcattgccatcctagaaactgttgaaatgacgatgttaaaactaagaaattatagactaaataaagtgctttttgagcactttaagccatgaaacagtggcgagaaaacagaagtcctcttctctaccacaggaggcacagtgatacaatactgccacctcacagagcctgaataggtgaatatttactttcttacatctaagacctaaatatttcctgggtttgtttatgctagaggatattttctaatctatttcattttttcaaataatgacaacttatgtgtaatatcatgtatgtactcattgagtttgagcattattcttttaaaaagggcagatcatgaggtcaggagatcaagaccatcctggctaacatggtgaaaccccgtctctactaaaaaatacaaaaaattagctgggcgtgatggcgggcacctgtagtcccagctactagggagcctgaggcaggagaatggtgtgaacccaggaggcagagcttgcagcgagccgagatcgcgccactgcactccagcctggagacagagtgagactccatctcaaaaaaaaaaaaaaaaagtaattaatagatatacagtttatttaagtaattgcagttccctgactacgagaggggcagcctatgtttccatttgttcatgtcctcttaggttagggcatgcattagaactgtttttctgattgaaagaatgtacgctggttcatcttgtccttgaatgaccagagagctggttggagatgcaagcggagagtagagctacaacactggccacaaaggaggtctaccataagcccttgcttccttcattgctgttgctactgctaccagccagcaggtcaccctgccattgtatttggattgtatttagggtagaacttcagctaatggctgataatgctcagcactttactagactcaattagtaccattgggttcactaatagtttctgttaggaaaaggaaccagtagctaaccaaactactctattgggcagaagtaccaagatcaacataatgctgattttcagattgcattgagtggaaactggttgcctggtgtgttcttagctgatatggggatagctttcctaacaaggcaaggatgggacctttagattgctgctctttttttctgctttattagaatattagcttcccgagaatatgtctccattttacaaggcaacacttcagcctttcttcatcaccacccacccttctcaaaaactttcccctttgctacctccctcccatatttatgcattcatatctgttattctagctacttcacagtgatgactcgatgtctcacaaaggcatataaacacattgagagtatacatatgtctcctcttctgtttgtcccctgtacttgagtaactcttagaatttcatagcatagcttggaattaagacctcagtgcagatcaactggatttttatttacattaatatcctgtggcatcagtaatatctagctgattcattttagtagctttctatttctcttagtctccttagttgtgctttagcagtttctccaaattttaaagtttctgcataataaagtaaaaattccaaaataattagggataagtgtcctaataataattagggtaagtatcctaataaaacattatcccttccaattacactatctttttgtgtaagggaataactgtgttgattttggataatcaaacagacataaactacattggttaaaaatactttgaatagctgggtgtggtggcttacacctgtaatcccagcactttgggaggccgaggtgggcggatcatgaggtcaggagttcaagaccagcctggtcaatatggtgaaacctcgtctctactaaaaatacaaaaattagcccggcgtggtggtgggcacctgaaatcccatctacttggaacgctgaggcaggagaattggttgaacccgggaggtggaggttgcagtgagctgagatcatgccactgcactctagcgtggatgacagagtgatactccgtcccctaccccccaaccaagaaaaaaaaaaaaaagctttgaatgttggctctcccatcatttgcatttttggagcagattgctttttcaggccatcagcagaatatgaaaattccttatacattctgtgctgaagtattcccttctttgacaattctaatgacaagacacgaggggaaaggcgactttccattctttcctatcagatagtacttgcttctcatataatgaacactttatagtgcaagagacacatagagcaggtagaactgctggttctcctttcctggtaatttagtgcaaactcagacgtttcagaatggctttccttccttacatggcccaaccaatctgtcttgttctatgattaggtatatataagcaagtgatacctgctaccaaccttagaatgcctaaacttgaaaggcagctgtcagatttcaaggtgccccttgcattctctgccaaaattcttttcacaaggggttcttgacactcggtgagaggcacagtcacatctataatcactgtaaaagtaattataattgttagcttttaaaatcaagtggtagggtggataattcaagtcactttcttatttttgatagaaatgtgaggtatgaggcagtaggagtgagttagcctctttctggaatgaagacttttcttgaaacctggaggggagtggatgtgaattgcttgtgcccctgtgaagttgtggcccaatgggagggacaggaggagctgggagtgtgttatcaaatgccctgagcttcctgaggctctactattgggggtttcatgctgtgaagaccggtgaatagtaatatgacacaaaggaagaaatgcaaggaaaccttggagccattcacaggcatctcaggtgtggggaaattcattagaggctttcaggattctcctgtttactgattgaagagctcattttgcaatgaatcaatggtgaaaggatttcttgtttgatattcttttttttttttaaatgaagtgctcactgcatttcattcatttttttaactatccattgttggttttgcccaaagtgagaaacgaaagggttggtttttagtctgtgcatggtgcaggtttaggcttctgcaatggtgcctggggggctgctgagtggggaaggtcaaggggactggctctggacacccactattgggtgctggcacttgtctacctgaatctcttttatacagtggtggtttgactaagatttttgtttttgaaagctcattgcttgaaaaatgtctgagagccattgctttagggaattggtgttattgtacacagaaaaataaatcactttttgaagaatcattttggattgttcacatctcaaggagatgaaatatgtaacttttttcctctatgtcactgagtcataagtcctgcctttttggaatgcttggaattttttaaaaaacaaaatgcatctctgctatgtaaaggtttttctattataaaaattacatatgttttttataactttgacttcatagcctataggcatgtaactccttagttttaaggagtaaaaacttacgtactgtttatagtaagagacaattatgtttcacatggtcttgattaccacaatttttagttctaccttcaaaagaagactatttctaagaaatatctaattataggtattccattatggataataattgaggtattattagaggaatccaatatgtctttcaagagtatccaattaatttctaagaggtatcccaattatgtctttgtttttcaagagtacattaaaactttggcctgtttaatatttccttctaaaaaaataatatagagtaagactgagaaatacttggatttctcgaagagtacctagatctcttgctaggtcagaacaacaggattggctattcacaccagctttctccacatggctaagtgtatttgacatttggggtgtgggatggttctggcctgtgtcattaccctttttctcctactcaggaagcatttactacctacgtttcttcttgttgttttacttgggatttctcttgaaagaaagataattcagaatagattgcataagcagtgaagcagcgttgagaatgtacaggtgagaagacaacagatgggaagttggtgggactgtgtgccatgagcccgggagtactggagacgcaagctgatgacagttgtttaagcatgaactgggaggaaggaaaaggtaaagtcattcatttttacccgtatgtttatcataaagagagattttttacaaaaactcaaaatcctgaatttgacgtgcaggtctatttgaatttaatttgctcttggatgacagctcctcagtagttaatggaataacgctgtgtcttgaactttatccggcatttgctgagaaaaaaaccatgtcttccacatggaaactaaccattagttagcttcctatttaattattttgaatcaggttttctggtactgagtactgggagtaggtgaaaaaccttgaatgcttcaggttgctcgagttagtaatcgttgactttctggtatgacattaagaaagtggatgtggacagattgacaagcaaatatctcatttatttttttccttttctatctaatcgaatttgattttcccctacttgttttagtacttttgtacttacatattgagacttaagctattgttgggagtaggtagcaaatgattacatgtaatttcttttgtctgaaaattaagaggaaaagagcttggttcttgtagggggaggtgtatttgcaattatttctatggcagaatttattagaattggccactctttaaaaatagtaagaactataggattttgcttttgtttaaccagaacatgaaatttccagatgtgatataaaatatgaatatgtggagaaattattttcacaattatttagtctcttttaaagataaagattcagaataaaaacaatctagtagaagaactttggctgtagtttttatttttcagtctaaagatgtcttttcccatggtcatgctgtgtggggagacaaattttgtttctgtgcagcttcagggaccttaaggatagctgtagtcatggacttcaactctcttttcctctttctgtcccccttcctccttcttttctctgcttcgtctgtccatgtgatatccacacaaggcagctctggtgtaatggatctggcactgggcttggtggcctcagaaggctgaggattgtcttctgctctgccatgtacaagctctgagaactttggcagattacctaacttatcagtatcacaattaatctataaaatggggaaaacaattatttcatcatcccaagcagaaactctgtacccgttgaacatgccaggtgaggaagcataccctgactcgggaggtggagtcgggagggtcatgtcagtccaggagttcgaggctgcagtgagctatgattgtgccaccacactcgagcctgggcaacagagagagaccctttctctaggaaaaaaaaaccccacaaacagtaactcttcatttccccctcccaccagcccctggtaacctctattcttctttttgtctctcagaattgactactctaggtacctcatttaagtggaatcatacaatatttgattttctgtctggtttatttcagttagcatgatgtcttcaaggttcatccatgttgtagcatgtgtcagaattttatttctttttattccactgtatatatagaccacattttgtttgttcttctgtctttttaattttttattttttgagacgtttcattctgtcacccaggctggagtgtggtgacgcaatcttgactcactgcaacctctgcctcctgggttcaagtgattctcccgcctcagcctcctgagtagctgggattacagatgtgccactgtgcctggctaattttgtatttttgtattttttgtaattttgtatttttagtagagacgaggtttcaccatgttggccaggctggtcttgaactcctgacctcaagcaatccacctgcctcggcctcccacagtgctgggattacaggcatgagccactgcgcccagcctcattcttctgctgatggacacttgggttgcctccactgtttggctattgtgaataatgttgctatgaatatgggtgtacaaatatctctttgagaccctgctttcagttcttttgggtatatacccgattgctggatcatatgttacctctttgtttaactttttgaatgacattctattttaagtactttttgagtctgttgaattgattgtagtgatgcaactcctaaatatgtttgctcatagtgatatttcccgcccctgaccttcattaaggtataattgacaaattacatttgcagtatacaatgtgatgttttgctctatgtatataaatgcttaaatcaagctaatgaacatcatcacttcacatttttctttgtgtgtgtgtggtgagatcatttaaaatctactcttggccattttcaagtatacagtgtattattactaactctagtcaccaagctgcgtgagagctccccagaacttattcatctcatctaaatgaaactttgtaagcttgaccaacatctccccattcccaccccaccatagtggtcttttaatttccatagctcatatgatgtgaatcaggacagtgaggtcagcttacatttcaggacttcagggataccttgccgaggtaggtgaaccactctctagcccgtcgttcccagaaatgcattagctgtaagttttgggataactgagggtgagaatttgatcagctggcctccagacgtgttggctaaacaatagctttatcaatccatataatattttctgctttggacctttctatagggattgaggagactgaagaatgctgaagacaggctgatgggctcagctggtaggctccactatctcgccatgactgctgaaaatcccactcctggagacctggctccggcccccctcatcacttgcaaactctgcctgtgtgagcagtctctggacaagatgaccacactccaggaatgccagtgcatcttttgcacagctgtgagttttccttgatgctttcactatgagaaaatacaaagggaaaaatcataaaagtaggatatatttctgtggtttactgagaaaccagagtgtgctacaatatgatcctgctttggaaagcatttcatatttgaacctatttccaaatagtatcttaaatggtaaatcctgggtttacttgttttagctgagtataatttatgtttgaaatttaattattggttgaataaatagtctttctgttaaggttcaaactatggaacagaatagaaaaattttaacatgctggccaggtgcgttgcctcacacctgtaatcccagcactttgggaggccgaggcgggcggatcacaaggtcagaagatcgagaccatcctagctaacatggtaaaaccccgtctctactaaaaatacaaaagaaattagctgggcttggtggcgggcgcctgtagtcccagctactcgggaggcggaggcaggagaatggcgtgaacctgggaggcagagcttgcagtgagccgagatcaggccactgcactccagcctgggcgacagagcgagactctgtctcaaaaaaaaaaaaaaaaatttaacatgctgtagttaactaccacctataagaaactcaccaggtattttaaatgatggagaagtcaggtagtaatttactttatgtactgaattttcattcatatacttgttcatcttctacaatgtacatgatataaattgtactttgtcatagctccttttatgctgttttcacagtatgctgaatccttcttattccacttaatgagagccctatagacctgcagaagtgggcttatctcttttagtgtgacacctggtatcaacacctgtgacctttactgccacttttccttgaaggttggtcggttaaggtataaaggtaggaaatagattgagttcctgtaggcttcagtgatgacacagaatagcattgttcatttaatcaacaaatatctgttgagcaggaactatgtcccaggaatggttctaggcacgaggatttatcagttaaggaaacaaaacccagcgaagtttcttgcttttaggagcttatattctatataagaacgttgtgtaggagttcagggcttagaggatgttgctgttttaggtagggggatcagaagtaggccttgctgaggagtgatgtttgtgctgcctctccttcctcttgttgttagtgtgtgttgctttataggaagtgaggaaatggccttgtcatctcagagcaacttcagtttcctttggtcttgctttgtttctgaaggctgtccttcaaaacaattatttctctgactttctcacccttgctgcagacccttgctaatccttgaaacaaatgagtcagaagcaacatgtggtgaaaatcagtatgcaaatatttcactgagggttactgctgtttaaaagaattcaatttttgctatgacatttaacagtgcagaatttaagcgtgtgcgtcaacattggggaaataatacatggtgaaggttgtatttcatcttctcagggagctaacactgtcctgttattgtttcagtagattttagttcctgattcaaaacagcatggctgcttctcatttctctttcagcaatttgagggtaggagttagtacagttagctttttcagtcatctagattcacacttcctcattgttagggagtgctcaaaagcagagagtcaaatggctgaatgttttttggtatccctcaattttggatccttttgcacctagaaacattaactttccctggcatcctgttacctgttacctgtgagctgccaaaatagtaagcggtgtatgattacattagtgtctgtaaaattgtaatttgaatcagattcacctgaaatactcctctaactttcttttggttagagatttatttcttgtttttaaaaaaatgacttaaaatgtgtctaatacttcccagactttaatttgcatctgtattcagtatcaaatgttttgtattttcgaggctgaaaagaaatttgtaactttttcatatgccacatactactgacttctacttttaaacagaattggatgacatctcccaattgcttgtgcctaccatatatttaaaatggttttactgagaaccacccccctgccccagggagtatccacatgtaatgatcttcctgctagatttgatgttatgccggtatatactggtatatgtaatgtatatattttttcttttcatgttagatggataatgtgcttatggtgtaaccaggtttgagggaggcatatctcatgtgactgggagaagccaatcatcatgcttatgaactacaagaggatctatactggtatattttcttggatttaataaagctttaacaatattctgtcattgtcctgtcttctgtaagaggcatccctggccattttgctgtgagcctagctttttttgttgttgtttccaagatcaccacactccaattccaactctaccccaactcagctgtgtaattgggcacatgattaatctctttgggcctctgatttctcctgtgtaaaatgaaggtgctaggatccttcacagtgcttcaaatagggggtgcagtatactctgggtatgcagaagggacagatgtggagtatctgacttgaccattgaatgttaatcagttatttccttatctttagagagacctggcctttaaatagatgccccaagtgtgttccacggaccaccagctctgggaaacagagatatccttgaatgaaatgttccatggtcaaattagcttgggaactgcaatgttcttctgttcctttcttagagggatgtaaggcacatttgcatattagaggctctgtgaaatcttgtggttaaagggaaagcaggggaatcttgtttagcttcttctgatgaagcatttccctttgaccgtgccacccttttgagtggaacatctattgcccacaaccagtgctctgaggaacactgctttaaattatttcatgtaggtaattcttgatttaaataacatccagggaaaggaatgtggtagatgttgtctcaaataagccatcaatattatctaggttcttgttaaaggatgttctagctgtgaagatggtttctgctagactgtttgctcagttttaatatgcagaataaagtgtaatataaagcaagagaagctgcatatacaggaaaaattgggcatagttcttactggcatgactgacgtcatagaacatgaggtgtattacagatccaaagaggttgatgtcttggggttacagagaaaaagatgtagcataattacttgttctattttgaaggttaaatatctcagggatgtttgtctgtttatgacatgcaaagagtatctgtctctcccttcctctcttttgcctgtatatttaaataacccaaatatgaaaattctaactttccttttctgggtttgcaatgcgttctttcagataatgccacataatgttaattcaagcgaaataaattcacaagtcagttatcaaagtaatggaaatttgtgagtttgctcccttgtgtacaatatttgcttctgatttattttagaagtgatttctgtcagccgtgaattaaggaatagtgaaaacacagttgttgcttgtttttataacttagataatttcacctgaaaagagtcggtatgttgggcatggcctatttacctttcagattaaatacaggatgtgctaagcaaaaagaaaataaagtccagccatattcttgccttttttccattacgttctattggctctaggtagttagaactccttttactattcatttcttggagccaaatggattttccaatgtttaaaaagtgagaggaaatataaaacattttagaccaagccgttctttcccttggggcctgtcgggtgacctttaagaaaagcccacagttggtttgggagaccgtcttagtccattttgtgttgctataacagaatacagaggctaggtaatttataaagaaaagaggtttatttagctcacagttttgcaggtggaaagttagagaagcacggtgctgacatctacttggcttctggtgaaggtctcatgctaggtcaaaacacagcagagaaggtcaaagggaaagtggacatgtgaaaagagacaaaacccaaggggcatcctggctttctaaaaactcactctggcaggaactattaagaattcattcccgcaagaactaattcattctcgccacagcaagaactcagccactacctagagagtggcaccaagccattccccaactaggtcccacctcccaacactactacactggggaagaaatttcaatgtgaattttggtggggataaacaaaccatatccaaaccatagcagagacatttacagtttgggaggatttgcaatgtgtatgtgcacacacagtttggtaactttcaaatgaagcatgaatctgtggtggatctttcctgggttctaactgttacctgcattaggagaaagtaatgccactttcctatttctacctctgtttctcccttgcagtatagcatagtgtgttagaatgcagatatggagataagaagactcaggctcaagttcaggctttgtcatttgatggtgtatgatttggggcaagttgtttgccttctctagactttagtttctttgcctgtaagacggagggagggaggggttgacaatacctacctttatttcctaagatccatcagtgtgctgagctgttacgttcttcaaaaagatttcagagaaaggaaagcctataatgatttgactggcttcctcactagccttttataaaaaggtggttatataggtaattacaacctcactgctattctgagatactcagagattagcagttaggatagagagaaatgtctcttttggatttgttcaaagtgtggctttgaaatatttaaactaaatatctagaattaggacttaacagggaaaaaaaagtgccaatacaactttgacagtaaatagatgagcacatttatggtggatataaaagattcagatgaaagggtgtttcaaagtaccacatatttaagaacttgcttacttccaagaacataataatataattacttgttggcttgatatgttagtctagtatcattttaagttccttttattgagaattctctggaaccacaagaaataatgagggatcttactcaaggccaatgccacagaatgattctctgtcccctcttctggtcatgagacctgccaacctttcccaaagctttcaaattctccagctccagattcccacgtcttctactactattaaatgggccgaactaagttctgccagttcaaagcactgtattattctgttggtttctggtacctaaatatgcttgcttgcaaggttagtttttttctttattattattattattattattattgttattattatttttgagatggagtcttgctctgttgcccaggctggagtgcagtggcacaatctcggctcactgtaacttccgcctcccgggttcaagtggttctcctgcctcagcctccggagtagctgggattacaggcatgtgccaccaggcctgactaattttttttgtatttttagttgagttggggtttcactatgtaggtcaggctggtcttgaactcctgacctcgtgatccacctgcctcggcctcccaaagtgctgggattataggcgtgagccaccgtgcccagccgcaaggttagttttatgctttcccttaactttgcttggggtggttagcagtaaatcagtgaatttgtctttgtttgtgaaataacttcaatatactcactgcttatatccattaagagatttaatgacaatactatggtgacttttgtatttattggtcaagtcacaggtttacaatgccgattttattggcactatatttttccactgacaacggagccactgcagggtcagatggcatctgtggaaaaagagcaaacagtaacagcatgagaaatggattagagatgactcaaggaggagctggcttcctggacctatgatctcatccatgcctaatgcttaccacttacttattcaaggaaagtagtaaaatgtggcaagagaggaaagaacagcagaagaaaaccatactattaaggccctaatgtctttgtcatagcatcatagtcctagaattgtaagtgaccttagatcttctagttcccccaccctcctaatgaaagaagtcattttctgggatgccagtatggtttggcatttaagagaatgggtctcaagtttggtagcttaggctttatttattcaacaaatatttgctgtgtcttgcatagttctgatggtttgaatatagtggtgaacgatcagattaagccctggttttcaaataactcaacttttcgtatgagacatagatgctaacaagtaaatacagaagtcaggtgatggtttgtgctatggaaaaatagggtgaggggggtcaggagtgctgtggggaagagggacttctactttattagatgatcagggaagtctcagtgataaggtgttatttgagcagagacctgaaggaaatggggaacaagccatacagatatctgggagaagagggttgtaggcagagggaagcagtatggaggtcttaagttgggagtgtgcttggtgtatcctgttacagcaaaggaggctggtgtggctggaaaagtgtgtgtgtgtgtgtgtgtgtgtgtgtgtgtgtgtgtgtgtgtagggggagtagtaggagatgaaggctaagtcccatgatcttctctctgcaagctggagacccaggagaaccagtggtgtatttccagtccaagtctgaaggcttgagaactaagagagccagtggtataagtcccagtccgagggcaggagaaaactgatgtcccagctcaggcagtcaggcagggagacgaattctttcctccttttgttctttttaggcccttaatggattggatgatgcctgctcgcaatggggagggtaaactgctttactcagtttaccgatgcaagtgctgattgtattagtctgttttcacactgctataaagaatacctgagatctataaaggaaggaggtttaattgactcacagttctgcatggatggggaggcctcaggaaacttacaatcatggtggaaggggaagcagccacgtcttacatagtagcaggcgagaaagagagcaccacacttatcaaacaaccagatctcgtgagaattcactatcatgggaacagcatgggggatactgcccctataatctagtcacctcccaccaggtccctccctcaacatctgggggttataattcaagatgagatttgggtggggacacagagccaagctatatcactgatcttatccagaaacacacacacacatgcccagaaatgaggcatataggaggcatcctgtggccaagatgacacacaaaattaacctttatgcatagagaataaactacaggggccagggtgaaagcaagaagactacttagaaggcaaacgtaataatccaggccagagatgatagtggcctggaccagcagatggtaggggttaatgtctttgggcagtctattgggtcattttctttcatgtaatatagggataataagaaatcatctcacaagattatatagaagattacagtagataatctagataaattacttagtacactgccagaatacagctagcatatatagctctactctttttagtgtggttatctagcttttgactgataatttccaggattgggacataccatagtactgactattcaattattggaaatttctaaattgaaaccatctttgctctacattcatttgaaactggtttctatgtaaattctaactattagcgttacttccactctctaaaataaaattggttagaatctaattttactattcctggttgaaatctaattctactcactagctgcatattatttgaatgaaggttatcttttttttagagggcggacgtcagattactcatgaaaaattctcctatagtgctcagtccaatgtaggaaatagtgagctatctagtagtgagataagtaggcctgctattagttccaattctgtcaataactctatgactcgaatcaagttatttctctagaatttcctcatttgtaaaaatggtggcttggtttggaatttttctttttctttctttctttttctttttttttttttttttccagacagaatctcattttgttgcccaggctggagtacagtggtgcgatctcagctcactgtgacctttgcctcctgggttcaagtgattctcctgccttagcctcctgagtagctgggattataggtgcctgtcaccatgcccggctaatttttgtacttttaatagagatggggtttcaccatgttggtcagcctggtctggaactcctgacctcaagtgttcctcccgccttggcctcccaaagtgctgggattacagatgtgagccactgtacccagcttgagatttttctaaaaccatgatttctttttcttcatcattttctcttctttaagctgagaatcctcaattactttaaccagccaaattgttttcctatgggaggtttcagtttggtaaggaagatatatcattcatcttactagttactattttaatatgcatttatcttctacatttaggtcctgtaatcaaattagcatgatcttattctattttggatggaaacatgactgtagtggaaactgtggcattcactcggatccctcttcagggcaatgtttctatcctccatttcccagggactggcttatggaacaatgactgattgctacagggatataaaggtctttccctttcagcttaatgaggtgccgctgcgaagggcccttcctaccttgagagtaccctgttggaatgtagggccagatcagaccctggctgcagctgcatggcgggtcaggatctccctctgcccacttctattctccttacttccttataggcatgactttggtgagagtataccccatactcttctaaatggaattctccatccctgaatcaatttctagggaacacagttaaagacacaaatccgtgaattattatttttcttctggtaatgcctccacctatatagtccagaaaagtgttttttttttttttttttctctgcaaaatgagcatctcatgacctttacagggtctgcctttcatcccattgcctctaagttaactaataaagtgtgatatattccttaagtgtgttatattcctgctttattagtatatttacacaattctatagaaactggaaaatttggctaggtgtggtgtctcatgcactttgggaggccgaggcgggtggatcacttggggccaggaatttgagaccagcctagccaccatggtgagaccctgtctttactgaaaatacaaaaatttgccaggcacagtggcgcacacctgtaatcccagctatttgggaggctgaggcatgagaactgcttgaacccgggaagtggaggttgcagtgagctgagatcttgccactgcactccagcccgggcacctgagtgagactgtctcaaaaaaaaaaaaaaaaaaaaaaaaaaaaccctggaaaactcttctttttctgggtagatctctttgaacatactttaacatatcttaccttcttgccataggtatattaagaaatagtaacttatgccctcccccaccctcttgggttgacagaattcttttgggacaaacttcacttgcataacctttttttttttttttttttactttttgagatggagttttgctcttgtcccccaggctggagtgcaatggcacgatcttgactcattgcaacctccgcctcctgggttcacgcagttctcctgcctcagcctcctgagtagctgggattacaggcaggtgccatcatgctggctaatttttgtatttttagtagagatgggatttcaccttgttggccaagctggtctcgatgtcctgacctcaagtgacctgcccgccttgtcttcccaaactgttaggattacaggcgtgagccactgcgccccggcctacataacattttttacttcgatcataggcgtaacaagtactttaggcttggtattcgggtaaggggtgatgttataatgtggaacagaattttatttctttttacaaaggaagttgtgaaaagatagtttggtgatctgtgcttgtatgttgtgtagacttttccccccttaagcatgcctttgccaaagtttaattcttcaaaccacatatcagaatgtaataggctggccaaacatgcaaatcatgaccagagagcaggcaaaagttggtttctgatgagagaacttttccattgttgccactaagtcaccaaagtttatgtatttcttcttttgaagttgcacccttattccaatattctctaagtctattcccacctttgtccagactctactgatccatttggtactagtgtgtgccaggcatggtgttaattgtggagcaagtggcagtcatcagacacaaccagccctgctgttatgtgggcagtagaccctctgataaaggaagtacaatatgttataaagcatacagaaacccacctaaaatagactcagggaggtaggaggtttcctaagggctgagactgaaagataatagggattgcttgatggcattgttgatggggctgtgggtgagaacagtgctccagggaaaagaggccagccacatgtgagaacacagaatcagggaagagtgacctgctgaggaaccaaaccggaagatgttcctgggacacattgttggaagtgtgggtgtgctcaggcaggaggccagagaggcaagcagagactagatggagggcctggtatgctgtgttaaaaaaacattatggagccactggaaggctttgtttgggaatgagatagggaggatggcgtcggtacaggatagagaatggactgaaagtgggcaaggctggagcaggaggagggaaccatggcaggctgaagcagagctcggagaacaatgtccttatcaacttaggatacatgtgtatggcagactgcagttttgatgcctggagtatttaaattatttttgtgccccaatttctcttttttcctatccatttgggatactgtcagctttcttttctttttttttcttcttttcttttctttttttttgagacggagtctcattctgttgccaggctggagtgcagtggcgtgatctctgctcactgcaacctccgcctcccgggttcaagcagttctcctacctcagcctcctgagtagctgggactacaggcacgtgccaccactcccagggaatttttgtatttttagtagagacgggatttcaccatgttagccaggatggtctcgatctcctgatcttatgatctgcctgcctcggcctcccaaagtgctgggattacaggaataagccaccgtgcccagtgaaagtacatttttaaaaatcatggctagtactcatagaagaaataggaccctaaagtacaaaataatcatgtttcagggctctcttggtttattacattgaagataatttttaattataaatgtaacacatgctaatttaaaaataaaccaaaaaacctcaaaaagcatgtgcatgattcatatatatatatatatatatatatatatatatatattttttttttttttttttttttttgagacggagttgtgccctgtcgctcagggtggagtacagtggtgtgatctcggctcattgcaatctctgcctcctgggttcaagtgattcttctgcctcagcctcccaagtagctgggattacaaacatgcgccaccgcacccaactaatttttgtatttttagtacagagggggttggccaggctggtctcgagctcctgacctcaggtgatctgtccacctcagcctcccaaagtgctgggattacaggcgtgagccaccacgcccagcccacctgtactttcttctagactctttccctgtgtacttacgcacatcacttaatagagaaatgggatctttaactacagatacttttaacttgagttttacaaacatagtacattgtggacaagtttctgtgcaaaaatatacagaccaaccttcctttttaagtattgtatagtgttctatgatatggttgtatgaaaatttatttaactgggcccctcctaaataatggattttaaggttgtttctagtttttgctattatgaatacattttttttacttatataaatgtgaaaatacctgtccttaggataactttttagaaatagaattgcctaaccaaaatagatgtacattttaaatcagtatgtgttaccaaattactgttccaaactgttgcaccagcttggcaactccaccaacagagtaggaacagaggcctctcttttgacactccgggtattttccaacttttcaccttctgtaatctggtatgtgaaaagaacatatctcatggtttaatccatacttcctctttttaggaggaagcaaattgttgtaagagaagctcatctcatgaatctatctttaaaaaacatacagtatgctcagtgccagtatagtttcaactgattttataccttggtattaatagtaatcaagttagaaaaaaatgggccatatctagaaaagtatattacacatagaagacatgaatgaatgaaaaaatggtggtgttcagactgagggagatgccttatcacacaaaaaaattcatgtccagtgacaaaatgttactaagtaggtaaaggaggtttaaaaaatttaggcaagttgaaaaagggtggtgagttaactagaaaattcagttttttaaaatcccattttctgtatatttcagttcattaaagattggttatataaggcttatctatgtggattccagatatgcagtgtaccccttggaatcaggtgagacacagtgcctcatttccatggaaatacatggctctgtgttaactgaaagcctccatggttttgaatcatttcccacccacagtaaggaggtctttttggtttgactcttctggaaaatatgtgtgaggtatttactacatgaatgtagggtattttttcaatctgcttaaacctcattttattcatctgtttaaaaaaattacggaaggaaaagcaagggcatttgagtacctttcatataatatgtaatatgcaagggtactattttttcccccatttactcttccagtttacagataaaccaattcagagttaaataacttgcccaggatctgtaatgttaatccctacatcatagtgtcgtttggaagaaataaaaacaagctctgtgaaaatatataatgtatggcctagcacatagtatgtggttcctaaattttttttgttagcatgaaaatggatgaaggcccatatttggcttttgtgatcttaacctgaaatgtctaaagcttgacaatagcctataaaatgcaaaattgacaactggctactgattttatatacgtaaaagtttagtcagtacaaaacaaatgtaaagaactactggtttaaaaaatccaaggagtttttcagagaacagaaagtatgtaatcagaatatagtggtggccatggcctcatattagagattgagcatgaacatgagtgttctgtgaactttccactgtgtgatttcgggtaagttatttgaggaaaccaaggccgagacattcagaggtctgatttacacaactggaagttcccagtgcatttagcatattttcagatgttgaaactgaagtcaaggttcaaggccaggcattctgcctcaatgactgatgttctcccaccctccaggcgcattgtgtctgtggaagttactggtgttcttaagaggacctcagtctgacggttgtttccaagtgattcttctgtgttgagggtgtttaatgcatgggttactgcagagcacagagaccttttctgcaaatggaaaaaaatattatagcttaacatctgctttccctaggtaatgtgttaattaaagattgttttaatatggaatgatgtctagcctttgaaaaactttatcttacggtttatggtattgataaccttcagaaaaggaagactggttcaaattatgtcaattaatatgaaaaaagcccactcaatatgaagccccttgacttctaaaaacttgctttttagaaaatgttaaaaaaaattccaggttttgcaggataaatcctcgggggaatattgtgaggtgaggaatagtcgtggtcttgatgcaatgtaacttataattagaaagatgctgattttgctgtggagtcattgaatatcattatttcaaaataattttgaataaaatgagatttctaataaccaacctagtcattgtccaaccttttctactttttcagagttcagttctcttaaatctaagagattctcttttgtaatgtagctcaagaggaagtttaagggttaggtctattcttaactgatgtcccttgttcctatcattccatgtatagaaataatatcttcttgaggaaactgttaagcgtcactctttcccaacttttgggtcattaatatgagctattttgcatgctggctttgtaggttatatcctgtaggaaaaaatgttggtgatgagttagctttattctgtcacttatacagtgttaatattcttttaaaatttcaaaaattcagatagttattaatattgctaccactagttttatttaaaaatgttttaatttgtatagatacgtagtaggtatatatatgattagttttaattaagatattatttcattataatttattcaaactggtttaaatactgagacagattttatttaaaatataggatttctgcttttaagcagtattaaaatctgagatttgatgaatggtataaattttatcttttgcttttagttttaaaatattgtacaacatcctgtttctattcttgaaggtgaaaaagaacaaaaacttttaaaaagatggaaaaaattgtacaacagtttgttatgaaacaagataaagatttttacaacaaatacctgtagagttatcccttggtatcttcaggatattggttccaagccccttcccactccccaccccaaagatacccaaattcatgaatgctcaagtcccttatatagaatggtgtagtatttgcatgtaacctatgtacatcctcccatatactttaaatcatctttaggtaacttataatatctaatacaatgtaaatctatataaatgggttttctactgtattttttgtgtatttcttattgtgattttaaaaatatattttctgtccgtggttggttgaatccatggatgtgaaatctgaggacggggggctgaccgtataccaactatctcttagattgtgcctaagtccttttgtgttgatataacaaaatacgcgagactaggtaatttatcaacaacagaaatccactactcatagttctgaaggctggaaagtccaatatcaacgtgctggcaggattggtgtcccgtgatggcggctctctgcttccaagatggcgtcttactgttgcttcctctggaggggagaaattctgtgtcctcacgtgacagaagagatggaagggcaagagagcactccctttaaccttgagccctttcataagggtgccagttccattcatgagagtggggtcttcgtgacttaatcacctcccgtgggggttcagttttaacgtaaattttgaaggggacaccatcattcaaatcatagcggattctaacattaactttttgcttgctttatcacatatctctccgtctgtttagcctgctgtcctttgcatggtgtagtttaatattcattctgcattctctagtggaatgtgagtactcaatgtgtttgcttagattgggttgaatggttatattttattcaggtgactagcatagccgtacctcatggttgaaggggtttcttgaacctttactaacttgggttttgttttttttttctgtgttgctgggaccttaagtgcacttttagagattcagaagcgctaacagttcaagcagagactctaatagtaggaggaagaatgaaatgacaaatgaattcagtggaatctggctatgctgaatccgtggtatgcttattctcactgcctgtgctgggtctgtgtgctaaggctttggtgtcagctgagggcttacagttctgaaggctaatgtttctttggagaaagtagaaggatgtaaacttggcaagccttcttgttttctttctcctggaatggtcagttacttttctgagcatactgtgtcataagatagcacctgggccagagggatctctttgggattagtataaaaagtggggcctccttctgttaagaaaggcagcacaagtgggacaaaaggaaactcctctgaaaggttaatggatgagtgattgaattactcaaattggaagcagatttttccaacgctagtgccagttcactgctctgattggaatgttcttccattttagcaaatttgtttggctttcttgtgaagcctggaccaggctgcagcatttccaatgggtttctcttcagagctatttctgtcatagagtttcttaatttagatatttcatgatcatttgagataaagatagacgtgtttgatcactcttggttggtgggaactggaggtacttttgattggagtccagatttaatctcccatattgaatgactgtcctcaaacttacaaggtggatcttagtaatcttttccagaaaatgtaacggcactattttgggctaaagtatttaaaggctctcaatcagagttttaaattttgcatatataatttcccccttaagcttcctttgctgtttcttttggaactagctgaatgcttgtattctctatggagaggttgggtagaaaagagtgatgaggggcataaaagtatcttccctgattagaatggagggcatgggtggtactgaactagtggtgcttagacttggttgcaaatgggaatcacttcaagagtttaaaaatattgataacagttcagcaaggtggcagaatataagatcaatgtacagaatcaattgtatttccatatactagtaagaaataatataattgcattaataagaaaataattccatttacaatatcattaaaaggaataaaatatttagggataaatttaccaaagtagaaaattctctgaaaactgcaaaatactctagaaagaaattttaaaagactaaataaaagatatcccatcttcatggattggaagacttgttaaggtggcagtactccccaaatggatttacagattcaacacacctcttgtaaaaattccgactaaattctaggcttatcccaaaattcctatggaaatttgagcaacctagaatggtgaaacaatctggaaaaagaacagagttggagagctctattcctcatttcaaaactgattacagagcgacagtaatcaaaacattgtgatactgtcatgaggatggacagatagatcaatggaatagaattgagagtccataaataaataaataaatcttattttttgtcatttgattttcaacaagggtgccaagacaattcaaagaggaaagaaatgtttttcagcaaatggtgctggacaactggatatctgtttgcaaaagaattaagatgtctgtgatcttcctcataccacagacaaacattaacaaaaatggaccatacacctataacagctgaaactatagaactcttagaagaagaaaacataggaaaatagaaaaattttcatgatcttgggttaggcaagacattcttagatgtgacaccaaaagcataagcgacaaaagaaaaagcagataaattggacttcatcaaaattaaagacctttttgcttcaatggacatcatcaagaaagttaaaagataactcacagaatgggaggaaatatttgcaagtcatatctcataagggatacagctagaatatataaagaattcttacaactcagtaatgaaaacacaaataactcagttacaaatagatgaaagtatagatagttctgaatagggacttcttcagagatgatgtacaaattaccaataagcatgtgaaaagatgctcaaaatcactagccaacagggcaatgcaaatcgaaaccacaatgatattcgacttcacattaagatggctataataaaaaagacagaaaataacgagttttgatgagaatttaaagaagttgaaactctcatacactgctggtgggaatggaaaatgatgcaattgctttggaaaatcatctagcagttcctcaaaaggcaaagatagagttaccatataccatacctactcctaggtaaatatccaagagaaacgaaaatgtatgtccacatgaaaacttgctcatagcagcataattcataataccactcaactggaaacaacccaaatgtccatcaactgatgaaagtataaacaaaatgtggtatattcacacaatggcatactattcagcaataaaataaatgaagtaccaatacatgctacaacatgtatgaatcttgaaaacattatgctaagtgaagccattgacaaaggaccatatattgtatcattccatttatatgaaatgtagagagtaggaagatctatacatacagaaagtcaaatggtggttccctagggctgtgcatggaggatctgggggagaaatggggagcatgtactaatgggcacagagtttcttttgggattatgaaatgttctaaaatcaaatttggtgatagttatacactgtgaatatactaaaaatactgaattgtacactttagatgggtgcattgtatgggtacgtgaattatatctcagttatagatatctgaattatatctcaataaaacatgacataatataaaatatataatatttacatatcatatataataatgctatatatataatatacactgacacctggatccttctcttagagagtctgaattaattggtctgtggtatggcctgggcattggacttctggaaaccttcccagataattctattaaaaagctgatgtggagaatctttgacatgggtcttggtacttacaagtgtggtttgtgtgccagtggcaccaacgagacctgggaacttacaaggagggcaaaacctcagaccccacccaagatccactgaatcagaatctgcatttttgatgggatcctcaaataacttggatggacattcaagtttgagaaacattgtcagtaaggtagttgaatagtaaggcaggcgaatgttatctctgaagttccttatcctctgtccatccacccctcctcctcctgcctatggctttttattaaggatacccttcccagtagtgtcccatatcttccagtgtttcttgtccataaaaacataccaggcttagatcattttcttcgggggcactgctctctgctagggaaccactggccttttgggatatattctcctgagagcaaataggcagtggactagcacaactggttctatatagcaaatgaggcgacccaggaagaaagtgtagaaagaagagagtttaggtcctttcctgaaattccagcatttaaaagttgagttgaggaaaatgcagaagattgagaaagagtgactagagaggaagaatgaaaaccagaagagtatgggatccagaagacaaggggaaaaagggtttcaggaaggtgggagtggttagctgtgtgtgatactgctgttgagaggttgggaaggaagaaatgtgtactggattcagtgacctagagccacttcagttgagtggcagggaggagttgggatgggattggtgaaggagtgagggaagacaactctttcaaacatttgattgtgaagagttgaggagtgaagaaggcagtatacagccaggaagaggagtgagagagggctgttctatgctgttttattatgacttttctttgatttctttgattaggatattttgaacatgttcaagtatagacaggacaaaattcaagacataggaaagaaaacaggtaatgaataggtaaatttcctgaaaggcaggaggagatgggaaccagaaaagcagagttggctcctatgtgtcaagaaaagaagaacagaggatggatgtgtgtttgggtgggttcatatgtttcagttatcagaggtgaaggagcttggccacaaagttgagcacagactgagtatcccctatctccttatctgaaatgcttgggaccagtagtgtttcgggtttctgattttttttttgattttggaatatttgcattatacttactagtctaccatctctaatctgaaaatctaaagtctaaaatcctccaataagcatttcctttgagcaccatattggtgcttaaaaagttttggattttggagcatttcagattttggattttcagattagggatactcaaccagtaagtgctggattcaggcttccagctctcagagaagcctgagtgtctactatgtgccaggtcctgtgattgattaggtgcttgtaggggacatgaagaggagcagatataatctagatctagaaggagcttctaggctatagaggaggcaggcaagttgatagtcatttgcaatgcagcatgctgggcgtgctacattgctcatgtgtacaataaacatctggtgttacctacggtcatcatagaaaggttggcaagtagaggaggaaaagccaagtcttctggagaatttggggagcgggggaggttgcatcatttataaaattccttctggatagtctgatattctagtatgtccccaagtgagaaggcaataccaccagcctcactgctattgagaatcagtccattctccctccttttgatgattttatgtggcttccttttgaaggggaaaagaattggaacttaatatcaaactattttaaaatttcctttattagagtcttacgaaaacttatacaaacatgatactaagtagtatataagcatatttaggcatatatctcttaaagaataagaacaccacaataattatacaaacttaatattgattaaaattacagaccaataaggccaggcatagtggctcatgcctgagatcttagcactatgggaggctgaggcagacagatcacttgagctcaggagttcaagatcagcctgagcaacatggcgaaactctgtctctaccaaaaatacaaaatagcctggcatggtggtgcgcacctgtggtcccagctactcagaggctgaggtgagaagattgcttgaccccaggaggcagaggttgcagtgagctgagatcgtaccacttcactccagcctgggtgacagagtgagaaaccatctcaaaaaaaaaaattatatattatacacacacacacacacacacacacacacacacacacacacacatatatataaaataaaattacagaccaataaaatgtaagttaacattaatgtgatgagtgatgtttaactttgggtaaattgctttttccagttaggctctgagtttgatgtgttccaatgactaagtggtaattcagtgatcttgtcacctttctctgttggaatcactaaaaattttgacgtgttcagcattcactgggcccagattcttctcttctttttttcatttgcctgtgacaatgatagcacccctacgtggcaaagcagggtggcaccacagaccaagggttagcacggacactgggtggaaacaggaaatttcctgaggtggttccaggcatgcttttattaagagcattgaataaacataaaatggggaaaatcttgccatgaagaactcttgggttcccaagaatacacctttgcacgcagtttgaaaaatacagtgcgagctgggccttagggtgctatgagggcagacgggctgggtgtgctgccacactaggggatgaggcagggaaggcttctggaatgaaaagggatgagggacgagaactgtcaaaccaaggtctcttttaaactgtgcttatttatggcttgctgtttgatttggtgctttttcctttaatcatttggtgccaggttttcctatcagtcctttcatgtcctatatggttggccaacacctacaagggggaggttggtcacctaagtaatctcatattggtgaaaaagccaaggtatctgaaaggggttttgtaagaaaaattttaggatcggactataccaggaaacagcttcctgcctagctataggttgttaatttgtctgaatattttcaaaccaggatgcttttggtgtgttggataggcttttgagtagggagagatactatcttgaattgtgctaataatttaactcaacagcatctaacaaaggcagtcttattcttggatcatgtgtacagatcatagtctgaagtggaataagcagaatgttgttctcagtgtgagatgttatttagaacacactggaaacattgtgatgtcattgtgcactgaggcagggaaatgttagtctacattttatggaatatgtacttcagtgtttgcattgtacctggagtgataaaaagcaaaacaggtactcaagacctgtctgggctttggcctttgggcacattccccctcatcaccttccttcccacttggctgagctatggatgagaaaacctaggtcaatagttcaccaactcaccttcaagccaggtgggctgacaagtcctcctttgaccacaggaccccagcgcctgcatccagaagcatctaagatcctggaagtcaacttaaattttcaatgaatgggccagttgcagtggctcacacctgtaatcccagcactttgggaagctgaggcgacaggattctttgagcccaggagtttgagaccagcctgcttgggcaacatagacccaatttcaatcaatcaatcaatagtcgagtgtagtggcaggcatctgtagcctcagctactgaggagctgaggtgggaggatcactgaacccaggagtttgaggtttgcaatgagccataattgtgccactgcaccctgggcaacagagcaagacccagtctcaaaaaaaaaaaaaaatcaactaatggcactcattacctccttcctctcaacagtacctattctcttacctattcacctcaccctcatgaagcttttctaaggttcctatttgtctgtggactttcatttctgcatgcctgcctattcagaaacatctattccattctccaattatactttacgtttgcatacctcttttcacttttcaaagtgaatgggggactctccattttccctgagagcagcttagacaggtgatattgtcccattttataaatgagagcactgtagctagagaggttaatgactggctcaagatgtagaggagactttagagcttgtgcttcaacctacatggctggaatccagtttcattggctatagattataatgctttattttttcttagaaaaaaaaactttaggtagggcataatttagtgatagagaatgaggaactatatagtacgtttttaaaaatatacatatattccctgcccactcctgtgatttgttcttgggtaggtacatagtagctttgtcttaacactgtgaccctttttgccatgtccatcataataggtgagaacaccttatatgaagaatgcctgtgactttggtacatcggaatctgatacccttgaaaggggtctaggagacacctgtttctgagtagattccattgcatacaattcatagactctcagagttggaagagacaatatgagtcgtctggttcaccaggtgtttggttacatttttggttagatcccatatgaatccttaaaggttgtggagtgagtttgacgaacaatccttattattttgcatgacccttcatggcctaaaaataattctgtgttttaccaaactaagtaaaatgttgactatacaaaagaaaaaggtttttttcccttgggtcatttgggttttgagatgttctatttgaaacattttccttacaatttgttacctgttaagaaaattgcttatttaaatatctgttgaatgctacttaataaatgtaactttcaaaatgtgactaaatggtggtagttttctttgttaatagtgattattttattttgccattgttgcattgctataatttgttttcattttctttgtttctctctttataagctagatgccagttttcccccctagaattgttaaccatttacctgtgttttgtatgacatgcacatgggattcatgtgaacgttttcacttattttgcactttttagccagagatacagaagaagagagggacactcgagattaaatgttttagtgaaagttaatgggcagcatataacaagcctggggtacttgaaaattcagtaaaaagcaataactagggctggttgttttccctctttgcctttgaatagaaatgcatgcccacactgatggaatgtcaagtgcctgtgctgtaggactacttagcaacctgcccttacaaatctctatcttgaaccagtgtttcttagcattaaaaacaaagggtatgtgtacttaaaccctggagtcagtgtacagaggtctaacttctcacccaaaatcgtgggtcatataatattgtggccaggagagtgcttataggaagtttcaaaattcatttagttgatatattgtggtttgtagtgtacctaggaacattacattattagtaagaggcacatccattataagctcttgggaaggtgtatatttcaacttaacacatttgcagttatatttgaaatgaatgtgtttgcctataaggactcacttagtatctttagttcctatttaatgctaaacttattctgtagacccaaatatttctaagagccttgcatagaggcacctgggatattctgttacaaatatctgttctgtctacacagcttctccaccttaagtggtttaactggtgctttgcagggagtggagaaaggatatctcagaaggtcaaaggattaacattttcccacaaagtctttgatggaaagtctaagaccaggagaagaggagtaataacatgacctattattctgtaatttgcaaattcatgaagggcttccatatataaatttcacgtgtatgtgtgtatgtgtgggtgtgtgtgtgtgtgtgttaaaacctgtgaggtaactataacaggtattattgtccctactttttaaattaaggaaagcaagtctaggtcataggctaagtcattttcccattgtcacctagtaaagtggaccctccacccaggtgttaggatctgaagttctttgcattgttcactttgttttcctcaaacaccttccccttgagcctggagactatatctttcagtctttttacttaaatttctttaagtggctgctgggggtcagtgggaagatcaaggcagtaacaatggaacaggtgtggctgatggaaggctgagatgtcctcagcagcagaacaggatggacaggctttcacactgtttattcatttgtcccctggcaaaacactccttttggtgagccgccttgactgttcccctgggtgttcgcctgcccattgacattcttccccatatttccttgctgctgctctcttctatgtcccactgctgctgctgctggataccatgtttggcacagtaaatcctagagcaagtgatttttcacccttctgttgaacaaggaagtcagggttaaaacacagtaattatatggcggtcaagtgcaagagaggagtgactgcagaggatccctgttcccagataccttttattcctgaatttatactaaatcatgagcatttgtgcatgtcttttaaatatcatttgaagactcttttcatgattctgcacattctatcgcataaatttagcaacatttatttcagtgttctattttgggtatttaggttattttctagtttttgctgtgatgaatattatagaaaaaattaactccttggagaaaaaaactgttaactatttgaagagatacaagtctggtttaaatggtttgccctagtcattgattcatcagtacattgtaagttatttataaccagataaatacatgattagttttctgaagtaatataatagtgatactagttttattttcaggtggaaaaaatgagtaaagatggtcaataacagggatagatttcacaattacatcatcaatattctgaccctagaattttacttttggctcatgcttttataaaaagttggtgcaacagcaatatttttaatgcagtaagttgatacataaatgtataaatctgaaaaatctaaacccagttgtaaataatcaccactttgtaagagtcgttgcttcagtggctggcttaagtatttttggtggaatgtactcctcaacatttgaacttgacttttttttggtcatgcatgtagaaaaggtttaccgattatgagcaaattagtagaagttgaagaaccaattacttagaggtttatttcctggaactactgccttcaatttcttgtgcagttgcatagagaggaatagggtgaggcattacaggtttccataaagctatcagtccctctcttaacttttcagtcagactcacatcttcacccactgtccaacatccagacacaacaggcagtgagcagaccaactttgttcctggtgttctccctcttctctctgggtttcttttttcttttcagtttcttctctgggcttctttttttctattcagtttcttctctggttttcttttttctattcagtttcttctgtgggtttctttttctattcaatttcttctctgagtttcttttttctattcaatgtcttctctgggtttcattttttctattcaatgtcttctctgggtttcattttttctattcaatttcttctctgggtttcttttttctattcaatttcttctctgggtttatttttttctatttaatttcttctttccccaggggaccagtgccttttttcctactccaacctccttaacatggcatccaccaaggcccatatttttgaggtctcattgtctttgggataatgtctttgggacaatgtgtctcttgtctttgggaagcaagttatctttgctgtccccagtcagcaggaagtcacctgactttcccaaatttgacattatcttttccaggtatgtttgcttttaagcgtggtcctagaaatgtcactgccttaagcttactttgattgtgtggctagctcagtgcaagggtcacagcgttctgttctagttttgggtaaactttgatggagaggaccactaggtaaaaatggaattaggaactcatatttttttttttaaaggagggggcctttagggttagaaaatagtgttttttcttttcctgatctatggtggctgaaatgtgtgagcatagggaaatctgacttgaataaactcttaagatgaagtcatacataattaattgcctgtctctgcattctttccaaagtgatggctcttagtattcacacttgtgataacttatgtttcttgagtacaagagcctcaggacagccaattaaggaagaagacacagtggtggttctgttatgtaacctttctgctactgtaatggaatgggcaattgtcttttttttcttaacttccagtgcctgaaacagtacatgcagctggcaatccgagaaggatgtgggtctcccatcacttgccctgacatggtgtgcctaaaccacgggaccctgcaggaagctgaggtatgaatgactaccatcatcttcccctctttcctatttatgttatttattaggatcttgagtctttatgtatttccctaccagggagtctagcaagaaaatacagaggttaactttttaaaggagcactttattgcagcttacctttggactttttatacaaactgttaaagctgtcatttatctcagttctatttacatataccatcttgagtgttgaagaagctatagaataggcaaagtaccagaaatcaaatttaccaaatgtgaagttaggaggctgatatgatttggctctgtgtccccacccaaatctcaccttgaattgtaataatccccacgtgtcaagggtgggaccaggtggagataattgaatcatgggggcggttcccccatgctgttctcgtgatagtgcgttctcctgagaactgatggttttataaggggcttccctgccctttgctcagcactactccttgctgcggccatgtgaagaaagatgtgtttgctttctcttctaccatgattgtaagttttctgagaccttcccaggtctgcagacctgtgagtcaattaaatacccagtcttgggtatttcttcatagcagtgtgagaatggacacatacagaggctgaatagtgaatggtcttgtaaattgtaataccctaaagataaatagaccatggattagctgcagttatggaaaatataaactattgtgattccacaatgatagcctgagttgaaccatttccaaagagtagagacctttcaattgatctgtagcaggcatctgaaatctttttctttttttttcatatcccctcgtttgttcaatcaccggttattggtttgcctttaaatcttcagactctgctcactttaaattagaatataatgaactcttgtttattcttagggtgtttgtaagcctctgaacgacatcccaagaaacagatgaaatcagttgttcatttagcaaacacagaacacctgctttgcaccaggcaccaccaccccccagttgttttcattgccagtatactacctaatcctctcaacagacctcatgaaattgggtgttgctttcagatagggaaactgaggcccagaaggtttaagtaacttacccaaaaccacatatctagaaagtagaagagataggattctaatccattgctttctgactgccataattacgtggctttgagtagaattaggttggccaggtgctgtggctcacacctgtaatcctggcactttgggaggccaaggcagaaggattgcttgagttcaggagtttgagaccagcctgggcaatatagcaagacccccatatctacaaaaataaaaattagaaaattagccaggcatagtggtgcatgcctatagtcccagctactctggaggctgaggtgagaggattgcttgagccctgaaggtcaaggctccagtaagccttgatcacatcactgcactccagcctgggcaatagagtgagatttcatctcttaaaaaaaatgggaatgggggcatagaactaggtaggtagatagaatgtatgataaaggacttaataattggaagctcaatttgtgtgtgtgtgcagacacacatgtagatgtgtgtgtgtgtatagatatatatactgtacatgctttgtttatgaatatatattcttttacatatatatcctttgctttgtaagtgaagcagtcagaaagttagtatagacagtttttaacaatttgtgtctgggcatcctgtgttcaatttattgattagtggctgagtgctacaagtgagatataacgttttttagggaagtataaaaggaatatctgtttagaagtgatttaagaaaatcatggaataacttttttggtaaaaaggtaatatcgagtatgtaaaccctgtggagagatatattattgacttttgtagggtaaaaagagctatagtggagagaaattggactagttactaagaatattgttgatctgtgtcacttcagaattgtttttaaaatgagtcttgggtatttgggtgtatctttctatgcataatccttccaggaaagacacttcctttttgacttgcttctcaggtgtctgatgggtcagcaagtcttaataaagaccacagtgtgtgcctggccccattccaggctgggctggagaggagaataagaaaggcccgctagtgctcttcttatggagcttctggtccagcagagagacagtcaacttataacgagtcagataattataaaagtgaaatgcaagaagtggggcaggcaacaggagctgtgtctgctatgaaatcttagtgaattcatgcacataaaatctattaaacataagtgaatagcttggtgaaatttcaaaaaaagtccatgacatttatcggattcctgtattctagacctgtgctgactaatccagtagccactagccacatgtggctatttaaacctagactgatttaaatgaaattaaaaatttagttcaatcatgctagtcagtaattgctgagtgttcagcagtcacatgtggctaatggttaccagaccggacagcacagaataaaatacttccatcagtgcagaaagttcaaatgcatagtgttttagaattttcagtaaatggtagccactaggcactgacattttgagtatctaatgtaaggggccagtgtgcccaggtaagtggatcaggacaggctatagtgtctgtcttgcagttctctagagcagagcttaagtagtcttctcattttctttttttcttgcttcttgctttctctctctctctctctctcttttttaaaacctggttttcctctgttgcccatgctggagtacagtggtacaatcacagctcaacttcccaggctcaagcgatcctcccacctcagcctcccaagtagctgggactacagatgtgcaccaccatgcctggctaatttttaatttttttttttttttaaagagagggtctctctatgttttccagcctgggctcaagcaatcctactgcctcagcctcccaaagttctgggattacaggtgtgaaccaccacatctggcttcattttctttgaatagacattttctctttgtatttcccccctcctttgttctccttatcctttccccactctatcccttctctgtccttctggttctctttatccagttttactataaaagcattttacttttgtgcattaaaaccagacaaacccataatgagtcttaaaaattacaaaaggaggccaggtgcagtggctcacgcctgtaatcccagcactttgggaggctgaggtgggcggatcatgaggtcaggagatcgagaccatccgggctaacacagtgaaacccctttctactaaaaagacaaaaaaattagccaggcatagtggtgggcacctgtaatcccagcagggcttacacagcctaacccaggaggtggaggttgcagagagctgagattgcactactgcactccagcctgggtgacacagcgagactccatctcaaaaaaaaataaaaaataaaaaaaaaagaatcaaatgttctctatcaacttgctactgtctttttcagtgataaaaatacgtggtagtggtaattgataatcattttgagttgaaaatggaatagaagattatattggagatatgggtagctgcatcagtttacataggcctcctcctttgaaagtaaataccacacacatgaattggactgtaccaccttcatttctaacttgctttagatcaagattttattgcatacagttataacatgtggcttataatctatatattactgagtataccacaatggggttcattcacatatgcttgactaggttctatctcaatgactactacttccttctgccttttaaaaaatgcttaattacacaggtaacacataaatatactttgcttgttaaaaataattctgattaagcctggttctctttgtcttgctgctatttatattacaacacgtgattcttcattcttctctgtcttaccaaatgcatttaagtctaacatttcttcatcttcaaaggatggcaggaatgtaagctctttcctctgagtgcttccttgtgcaggtctagcttacagagttggctgtgctccatgtacctgccttcttgatttttccaaattggctcagctgtgattatgcctcctaaattttatctatgaagagtagcctccttagtgacgcacttaatgcccagttcaagtacaattgaacctcagtgtccatgggttctgcatttggggattcaactgcccatggagaatactcagaaaaaatatttttactgaacacgtgcagactttccttgtcattattccctaaacaatatagtataatgagttacctagcatttgcattgtattaggtattataagtaatctaaaaatgatttgaactatacaggagagaggatgtgcataagttatattttagtactaccccattttatatcagagacttaagcatctgaagattttggtatctgcgggaggtcctggaaccagtgcccttcagatactgagggatgactctactgttcccttgtataggaaatggtagaaaacggcagcttccctttcagtgtcatggaagctggtgagagacagtgactcaggaggacttgtggctagaggtgaacacactaggagccagggaaaagtaaaactttcctctattgcatcatctggtacttttagcttttgctctgcagagcttttccaatgtacttgatcttgtaatcatgtccaacatgaaattatgagaggcaggacacagattgtttattccaatagcattacttcaggcgaagcccttgcttgaagttagtagccctgttaaaaaaggtgatgtctaatttaagcagttcccatgtagtgttattgaagtagcatccatcacttcctgggaaagtttgaaccatttgtctggcctgtgcgaattttgagtggtgagtgcatattcctatttgaatagtacctgccattacatggcctgagagttttaacttcttccaattgctaggtgtcagtggagggcagggaagagcttctcactcactaatcttctttctaagccctggagcactgaaatgaccagcctgccttttactgctagtgccgcagtgtgcaccagagaaagggtgggtgcagctgaatggaggcttcagaatttctgtaagaagggagttagggcagggcattctggagacctggggtggaggtatggtggaggagggatcgagtactggggaatttgaagctatgtttgcaaaataaatacagtttttactcagattgcatatttagttgggtggctttgggaaagttggctacagtgatagggaatccaggtgttcttcccaaatcctctgcctccacttgccatctcttaacattcttccttcccattatcatggtgggaagctagggcaaaggaagggtgagaatgcccaggcaagaggccatattcctgttactgtggtgtaaggatctgaatgggaagggatgagtgtgtctgtaataacctttggctgcaatacgtgttggctggagaaaagtaaacctttgagatggtggggttagaggaatccgccaagccagagttaatagatatttttgagtttcctggctgaatcacattttagaaagtagttaaaactttgttttaaaatgtacttaaaactgtataagtgggtaataaggtttctaagaaaattctttaactaatggcacatagaaaactaagccacagtgagttgaatgtgtcacatgagtgtatggatatgtccctttttacttatgactgagtggagggagaaaagacgggatgatatatggaaagatgatcttggttagataatgtacagagacttctatagcacatgtgaaacaaagaccagtgaaagctgccctctacagtggactgcgaagatcagtggccctggaattccatttcttgccttctgcctctcagacagtgatgcccacatatggtttccaatcaggatttttaatctagtattcaggtgagagacttcagcttgttagtttcactcaggtgaatgggtgaatgtgctgtttttctcctctgttaggaagagcagctctcgttctctgcgttgtgaaaacatttttagttcctatgttaatgtgattagacattgatccgcacagtgagtgttatttcccctgccctggattttgcaagtcatagcatcccccaaattgcccaaaccttgacaggttgtaatgatccacttactagtggtcaattccatctccagatgttctgatatgttttattatttgttcagcctgtttaatttttaaagcaactgtagcagaagcatgatttgaaggaccaaacctaagtaaagtctgggcgctttttccttctgtttgggctttccggactctgatgggtagcagttctctaaagcctatccccaatttctgtttcatttttttaattgagtctttttttcttaactaaaaagcaatatacattgtatttattaacacttcatatgggaacacacaccacttttggcataaatacttttgtggtgagcaggcttcactttctgcctcccttttttgctttgtttttttctgagagggggtaaggtcagtgttagtgtagatggtgatgcttgtttaaatattatgatcgtggttaatactgattaacaggtgtgcctcacttttcatttcttcttggttgtggacgttagagagattaaatcacagttgtgtgtaacagttacagcactcccgtgtgtaggtgtggtctggcttccctggatatgctctgctagggatgaaatggaaaagcaaagacattcagctgagtaggaactgagtgtttttgttttgtttgtttgtttttttagacagagtcttgctctgtcgcccaggctggaatgcagtggtgcgatctcggctcactgcaagctccgcctcccaggttcatgccattctgctgcctcagcctcctgagtagctgggactacaggcgcctgctaccacgcccagctaattttttgtatttttagtagagatggggtttcaccttgttagccaggatggtctcaatctcctgacctcgtgatccacctgcctcggcctcccaaagtgctaggattacaggcgtaagccaccttgcctggccagaattgagtatttaataaggatcataaggttcatttttatcagaaatgaaacaaaacaaaatagtgattgtggacaattagtagcttttgttgtcattattctgatattattgctcttattctattaacatgaaactgaatttattttatctttgaattaaagtttgggtgttttcccccacctttggaaagagtttctagaatgatcatgaggaccaaaagttgtcttttgtgcttggataggagagagaaatttctgtttaacaataaataaattagcacagctttcaaagaagaagtagcaaaaattaactttaaattaaagaccattaagtagttgatctcagggtagtggtctcttgatagctgagaatatacctagggagctttgcttttactgctcgaatatggatttggttagtaatgaattagaagccactgaataaaataaatgtctgcagtctatgctgactgaaatttaaaaaatgaataaatagagaagggacagctttttcttacagtggaattttaatcaccaagtacaaaatgaatgatagaaatagaaaaatcactaagcaaatattacagtaataattatttttggcaagaattgtcagtggatacaaaaattagtgggcaaagtttgattagaaacaggattttgcgtagtttcagaatatctccctacaaggtaattgttaattccaaatgatagagaagctggcagataccaccttaaccacattaaaaagttaacatactatgcagccataaaaaatgatgagttcatgtcctttgtagggacatggatgaagctggaaaccatcattctcagcaaactatcgcaaggacaaaaaaccaaacaccacatgttctcactcataggtgggaattgaacaatgagaacacatggacccaggaaagggaacatcacacaccagggactgttgtggggttgggggaggggggagggatagcattaggagatatacctaatgctaaatgacgagttaatggatgcagcacaccaacatggcacatgtatacatatgtaacaaacctgcacgttgtgcacatgtaccctaaaacttaaagtataataataataataataaaacccacctcaaatcacacactaaaaaaaaaaaaagttaacatcatcaataatgagacatgttgtcctcatgtagctcctgatggccccaaggacacgtctgtgatattcttgccaaaaattcataacctgaatctaatcatgagaaagcatcagacaaatccaaattaggggaacactgtacaaataactggcctggactcttcaaactcatcaaagtcacaaaaggcaaagataaattgaagaactgtcccagattggaacgtcaaggagataccacagctaggtacaagttggttacctggattggatcttagactgaaaaaaagaccttagtggaacaattagtgagatttgaataaggcccgaagatgctttaattctattgtatcgaaatataaatgtcattatttcaatactatgattatcattaggggaagttggaatggcatttagcaactaaatttagaaagtgttattaggggaagttgggggaatggcatttggtaactctctatacaagttttgcaactttttatataatggtctggtgtgattttgaatgatttggaaattctcggttggcagaaagaagataaatgcataccacaagatacctcttcataatctcttttattctctaggattgtcaggtgtagcagtcaattttacagtacttgtgaatatcctcaaaaaattgattgtagcccttttacctgcagcctgatttagtcttctaataatcatcctaacacaagtattaatatttcaattttacagttgtaaaaatggaggtcttgagcaatagtgacttagctccaaatgacagtggaaccaggaatttaaccttttgtatcatttgttgttgtgttttttttttgtacagctctcatctaaagccaaaaatataatagaaatatttcagaaaattagttctaatctgcaaaatccaacagacaacatcaaggggtagatcttttgtaaatcttatgtttattgctttctaagtaatttcagcctcttgagtgtagcttctgtatgtcctgtctcattgtatgctaggcttccagaccaaagctttactcatggtaagctgtcaacaaatatttagaaaaaatgtgactgggtgcaactggctcatgtctgtaatcccagcactttgggaagccaagacaggaagatcactggaagctgggggtttgagagcagcctgggcaacatagcgagaccccatctttacagaaaattaagaaattagccagttatgatggtgcatgcctgtagtctcagctacttgagaggctgaggagggaggattgcttgagcccgggagtttaaggctacctgagctatgattgtaccactgcactccagcctgggttgacaaagtgagacctcatctcttaaaaaaacagtaatacaaaagatgcaagtctaaatgaggggaactagggaagagaatggtgcattctatgggtgtcttcattccaaaaggaccaaatagaatgagaagcaaagtaattaacttcttgtaatcacagctttcaattaaaaaattgatttaccttagtaagtcttcgttccatacaaacctttgacttaaatgagaaatccaaagtaccataaaagacaaaaaaattagaaatctatgacttccctgttggcagtagtatgtactccaatgaaatttatttttctaatttaaaattaaacatccatctctacagttgtttactttttactgcattaatttctgtcatttttcacattaacatttcatctgtatctaaaacatcttccgtttgccttgtcttccataaactgtatttgacatttatataaattgctcatcattgaaaaagaatcagaatttttaggggttgactttgaaggatttaaaaggaggtcatcagtccacaaactattttagatgagggtgagtggggtacaagactgtcttctggaatcaaagaaggtggtggttaaaaaaagattcatagaatattattgaggtctcttgggcccagatggtatcaccccccaagtcatgttggtccagaagctgacgtagcatttgtttgtcctccacccatgatgaattagcgacaaagtcaggaactgaactctggttcctaaatgcctcctatcacttcatttgcttgtaccttctgtctccaactctgaattttatttgagacatctttgtctttcaggaaagatgtctgggtagcattataacagatgaataaagttgactttcagtgtaataaaagtccaaccacactgttgaaagaactatggtaaaatacatataacatgatattgcgcataattttttttgtaaagattgctaaggagctttaaggtaccagatgaaaatgcaacattttctccccaactggagaaagaaaatttggataaaaatgtttttataattaaagttatgttttaccacactttacttggaatgaggaagaccaaacttgttttgtggtcctttatacattttagctaatttagattcatttgcgaaataaacaacttgagattatttataagggaaaggattagattttgaatgcattataaaaggtataatatttgttaaatacaattttagctgcatcattttcttactccagttttctcaaagcagatgtcctttccttagttgcaagaacgtcaatgtaggtgtgttttgtgccaaaaaaaggtgatagtttagagttggagttgtcagggctaaaactctgtcctgtatgaacttactggatgtctggaaggctaatatcaaatgtgatttgatttgatttatatatgatttatatatgagaaaatctttattttctcatatataaatctttaagttatgtcaatatatttacatttgacatcaatggaattaaaatgtttagaatgctggtttaagagcagttagcttttcctgcatctgcctttaaaaataactaatttgaaatgtcattcagttaagtgtgaattgttgttgtttactagtaaacctttggtttatgttgccatctgaaatggaaataggagtctagttgcaagaaatattttaggcatttcttttctaccagagtctgagatgtcaatgtcccataaccgagggctctaggaagtgactcttgtcagaagacatgatttttatattgtttaaaaggtactctttcctaggtgacaaatgacatttgcataattcctgagatgctgtctacctgactttagtttttcaggattccaaagctagaactttaatttcaaaaaattcttaaatgaagatatagagaaaggaagcatctttaatacaggaatatgaataattttagaagtccctgtaataaaattttgttgtctggtcttggtagccactgactgaaggtagaaggtgatcaatgagttttgtaactgctcccttcagcagtgattctcagctatggtggtggagtggggatgacttgaaaattgttgcatgtgttttactacatgaacagtgtggagaaaaagaggtttgcaaacaattggtgtagagaaagtataataagcaaagccagaaagagaaatcaaaaggctggtaactcagggcactatgatgactgaagtctcaaccttttatgtctctggtttcagattgcctgtttggtacctgtggaccagtttcaactttatcagaggttaaaatttgaaagaggtatgaactcttctttttttcctgatgatgaatgtggttttacatgtgtcatttttacactaacccacatggaagataaaggcagctatgggctgtcaacaaagcctcaagggtactctaaaaggagaatactgtaattgcaacataaaatttcaagcctctaagctaccaccagaaaaaaatgcagactagcaggaaacagaactttccttatgttgtttgttttgtatttttaatttggctcatgtaagaaaggttttgcaaaatttagatggctttataatcacaataatacaaaagaaagtgaccctcgaaatgggttttaccactaattttcgattcttgaagatcacttcgaaacattaccagcccaaacatttttactgctcctcagaatacataacacctgtttttttgatactacttttgtaatcatggtaataacagagtatggatatgtatcattcttgtgcaatttacaatgtattggactgattttctttctgactttgggcttggggtaacatatagcttttctatttagctataagaattatatttttacttcatttggcttttgacaggtcttttttaggagacctttccctcttgtcataccctaatctatttttgaggtaaatggactatttcttagtatctcagaagtaggaaaaaattgtttctcccagaagttattggactggtctagtctcattgagtatattaaacttgaatctagcctgaacataaagttttctgattgctaacttttaaatatgtattcataaagtctagaggtgagggtggggggaaaatgaatatttatttgtcatgtgccaataagtttggtcagtacaattatctttatctcatttaatttttacaactaccctgaaaaataattcttacaggaaaaaagaaaaaaaacgtacagagcatgaagaggggtagagtaggaatgcttgttggggatacataggttaatagcaaccttagatctagatctggcttggtcttataggagaataacactgactttgtttttgtggtgttttttttttttttaaaaatccagcagccaaaaccagatttatctcatgggtggattacttaactcataaggctgatatattaagctaaatataccaaaaaaaaaaatcttggattaggttatttgaattccaaatggtgggtacgtttttgctctatatccagatgtgaagtaggaaatagtttataatgttgaacatggaatcagaaccagggagtcagaaggatttttggtttaatggatgatgacataatctgatgcttctgttctgtgataagttaatgatgggggtagttaatattgactctctctaatccatccacatgggccgattagattgagcattataacaccagatatgatagctaaagataagagcatcaaccatctgccctgccattttcccactttatcccaacatcctccactataaaaatcaattataattagaacatggacattcccagtattcaccctgtggatgcctggctggtagcaagtaccatgatttgagtgcttttacctggagaaagcctacagagttaggttggattttcaggctgctgcttaaatggtgagatatgacatatcaaccacgtcagtcctactcagtcactggagctcagtctatttacagtattctcatgcctccatcagcacttctcctctcccatgactgcctgttacttccctggctaacttcactgccccatatgtcagcaacaggccttgttcctaattgtttacattttaggtaacatatctgttagctcaaatgtcttttttgtaattagaatattctaatattaccaggaattacaactttctgtgggttgtttctcactgatgaatataaagttttggtttattttaaaatcgtagctaagaccctgagtgcaattgcaggctccaccactggtaagctgtgtgaccatggcaaggtccttaatatttctgcatctcaacttcctcatctgtgaaatggggataacaagtatctctgtaccacagggttgtgatgaggattatgtgaattaatacttgtaaagcacttcctgtgagtgcttcctgtgtctcagtgttcaaaattttaacagttggcaataaaaataacttaaaagtagcacgttttaaattaaattattctcaatgttcttctcctgtacacttttttcccaaagaggtaatcataccgttcttcaggaaatatcatcatactgaagtagatattattgattgtcttgttgtcagtgggattagaacacttgaagttaattggcaacatccatcgttatgtggggcaaggtagatgtggaaaatcattggctaagatttccactctttccccagatagtggttggctttttgacttttcagtagtattcaaacctgcttgtaactggcttattctttcattagacgtgataatatattcagtctagctacaattaagttgggcaggcatctgagccagtctatcttttttaggtggtgatgcatatttctactttgctctgttacaaattgatgaaatagttttattcatacatggaatttatttttttctcacgagttctgggcagatgccccactgtggatcccatgcattaacaattcatgttgttattcttattttatagatgaagaaactgaaaacaggacagattgagacttgcctaggaccacatagactgtggctaaccttccttatctatacaaatgttaaaattctatacttttctttttgttattaaacatatacctaacataaaagttgccatttaaaccatttttagatgtgcaattcagtgacattaattacattcatacagttgtgcagccatcaccactgcttctaaagctctttcatgatcccaaattctgtagccattaaccaataagtccttattcctcctccctgaaacccctagtaacctctaatccactttctcttatttgcctagcctagatatttcatatgagtggaatcatacaatatctgtccttttgtgtttgtcttattttacttaatatatgtttttcaaagttccattcctgtagtagcaggtataagaatttcattttttaaggctgaataacctattgtatgtttttaacgtcattttgtttattcatctgttgatggacatttcagttgtttccaccttttggctactgtaagtaatgctgctgtgaacactggggtataatctgagtttctgctttcagtatttttgggtaaagtaactagaattgggattacgggatcatgtggtaattttacatttagtttttgaggaactgccaaattgtaaaaccctataatttaaatataaatttaatagacatcttactgtcataaagtattgcagtgtattaaatttagtggccttttgatttaacctcctcattttatgaaaaacgtaacaggcccagaggcaatttcctcttaagtgattttgtttttgttttgtttattttttttgagatggagtctcattctgttgcccaggctggattgcagtggcacgaactctgcccactgcaacttccgcctcctgggttcaagcgattctcctgcctcagcctcccgagtagatgggattacaggtgcctgccaccacacttggctaatttcatattttagtagagatggggtttcgacatgttggtcaggctggtctcgaagtcctaacctcaagtgatccacccacctcggcctcccaaagttctgggattacaggtgtgagctaccgtgcccggcctcttaggtgattttggaaggcaatttgtaatcgtgtaattcttcattaccatccgttataattattattggaaaatggacatttcaaataagagtaaatttaagttaatgaagtgctacataatggaatttacatgattgggatacactttatctaattctgtctaaactttatctaaattatgtaaaatagacttcttatctacctcaaactcgagaccttcatcagctaggtgactttgagactatgttgtgaatatatatttgatgtgaaaccatttataaggggactttggggtgcattaaatacccactaatactgtaaatgagttaaatgactaaccaactgaaagaaaatctcattggctggactgtgagacagaattgtagagattgctgctgctctggaaaaacgtagaatcagagtagatgcagtactatttcttagttataaaaaatcatccttagttttttccaattcttagtgcctgccaagttcttttagtctttagcttgttgttcagtgtgtgaattgtcctctgctttgtgttacgtatttgctcagcttgtcctttatgtctttaagtctgacggaaaatattttgaataggattgcacaaaaatcatcctcctgcttacacgaagcaaagaaatactatctgatattggttggttattctacccgctttccacccatctgtgactttttgtctggctgccactatgtttctggctttctctttctgcatcagctttccaatattaacaaggaaaagggaatgctaagtttggcatggattaatgatcactgctttactttccagtggttctcaaagtacatgcccgatgattaatgcaagaatttttcttgcctcttgtttccagagtctactttttcaaaatagtttttttttgaaaattgggttaagatgatccatcttgagttcttacgcacttttcctttttttgtgaccctgtttgactttctgtaactgcaagttgcttccgttccttgctaggttgatgtatctgttcttgaatatttatttatattaccatatagcagtttaagaactcttacagaagggttgtgtcatattgttctccttcatttaaaaaaaagtgaaataggaagttgtctttcttttgctgtctgttaatattactgacttcactcctgtattaagtatgtgcttatttatgtattgcgtgtctatcctatgccaggtgccattccaatgcttcttcaagctgtggttccatctttctttgaaagcccttttgttctcagcattctcctcaagcctcctttcatttcatgtcttcacatttatgatattactctagtttcaccttgctcttttatttgtccttggtgaaatgcttccaccccagcttttgtatctgatcataaaggttttattccatcagagctccctatgtagttatgtagtttcttttagtgtttttttccctctttgtagactgtgtgatgcttaagtactttattgtctgctcagtttgatttttttaacacctcccatctctcattagtctactgaaacagttttatttattacagctgatagttaactcaagtgcatggtgtttcccacaataataaaagttcgtttgatgtcttttttggcacaatggtggagaatggcagaaaaaccactcctgctaggacagagaatatacaacagaatcaaaagcaaactcagcatatgtaatgctgatggtgccagttgggaaaaccaagggttttaaattgagattttgaaatctgaaggcaatcattaaggtcagatgtggtctttaggtctcatggcagttttatttcccagaatgtttctgtttcccagtaatagtcagaatacagaagtagaaaatagttttaaatagcatttcttgcctcgcataatttacatgaacatgcagagtctcaagatcacatagctgtggggctttgcttcagtaatcaattctactttttgtaagtaaattgcagtttaagtctttgaatttgtctatctctgatgtaaatatgtcagagttaaccacttctaaatcatgtatagtaatataaaattttgaaggcactattatttaggggctgacttacagggccctggtttctcttttactagatttctgaactttttcccatctcaaagctacataatgttttcatcactgctgatgcagaagtaattagttgactaggcatcagttcactttcttccaacattggaatagaaatttgaagggagggcaaccggaccttaaacttctggataattgtgcattttgtatatctgtattataactgtgtttcctaggccaaaagccaggaggtagaattgaatttacaataaaaataataaaaggtgttgaaaaaaatatcctgtgactcctgtgggcactccactttgtctcaaattccttataggtcattagtgtgagaagagaatgagaagaacagctcttcatgtgatagcaatctgacttccagctggtgtctaccagtttgttccttttagcttgggttctgtgtagtcctgttagatgccagggctgctgatgtctgatgactctctgcattttttctatttctactaaacctggcctctaggccatgtgtataatctgttacatgaggtatataagacaaaactattctcttaatgggatactggaattataatacatttccttaaaaaacccagctcttttaccttccattggcttttccttgtatctgctcttctaggagctgagctgaagggcattgtgaagtgtaggtgccatgctgtgctcagatatcttttcagtggaatctggccagatttctatgtctggatccctgtttctccgggggaagcacttttacagaagtgcccttttgcaaatatctctctgggttgttattgctgttctctggaaacacctgaatgtagggctgaacaaaatagaacttggctacatatgctaccattatcttttttactatgggaaattgatgtactgatgctatgtcttatatttctgttatgtcactccatttagttacacaaatgcaacattctaggcatcttgctgggtcagtgattgtcagagaagggtgaatggatcttccagggatatttggtgatgtccaaagacatttttgatcgtcacgacttgggtaggaagctactggcagctagtgggtagacgccagggatgctgctcaacatctaatgcatcattcattaaagttttattggttctattttagggtgtgtgtgtgtgtgtgtgtgtgtgtgtgtgtgtctgtgtgtgtgttgtgtgtttgttggctcaacaaatatgtcaggacatctccatgacggtaaattatccaatccaaatgtcaatagtgctgctgttgagaaatcctttcccagctgatggggaatacagtgatcatcaggacaaaatccctgccctaaaggatcctgtgtatgtgcatgtgtgtatgtgggaggttagataataaataaataatattagatggtgggggtatatccttttatataaataagggtaaggggaaagagatagatgggggaggctattttggataggatttttgtggaagacctctttgatgaggttatatctgaaaaaggacttgatttgatgtgagcaagccatatggatacttacgggaagaacatcatttcaggcagaggtaaaggtacctacaaagcccctgaggcaagaacaagcctggtttctgtttgagaaacagcaaggaggcccttatgatggagctaagtgagcagaggggagagttataggaggtaatttgaaagtgttagtcaagggcctgatcccatagattatgaagatgaagtcttagtgggatgagaagccattggagggtttggatcaggggaatgtcgtgaaatgatttccattttagaagattactgtcgctgctgcagaagagtggatggtaatggaatgacatggcagcagggagatttattaggaggctgtggtagtgatccagtccaaaacagtacagtagattatatgttaaaagcagaagcattgaaaatgcccagatttggagtctgttttcaaggtggaactgtcaggatttcctggtagagatacatctggattatatgagtcaggatcagtagtataaactttggaatcgtcagcatagaggtcaggtttaaagctgtgacactgaatgagcgcatctaagaattaaacatagctaaagaagcagtttcaggactgagccctgggacactataggttttagaagaggtggatctggcaaaggagattgacaaaggatggccagaaatatgaatccagaaggtgggtgaagacagtgtttaaggaggagagtgtccactgggtccgaagctactgacagatgaggagagatatggtctgagagttgataacagaggtctttggtgatcttgacaagtgggttttagtggaatgacagagaagtgccagcttggagagggttcagggtactatgagaagaaaaatgggtgcagtgaatatattaactctttcaaggagtgttttttgttttgttttgttttgttttttcttgaaaggaacttatgatccagcagaaagggatgatacaggagagggaggggggaggtaattgcagaagccaaatccttgagagtgtgaggggaacggatttcagtgccagatggagggattggatttacttgggggtaggtttaggtcatctctatcaggaaagaaggtggagaggttacggacatggatgcaggcagcctagtagattggtctgcatgggttctcttctagttgcttgcttcctaggtgcaataagaaggagggtcagcagctgagagtgagaagagaaaaggggtaatgcagatttgaagcaaaaggaggagctttatgtaatatgaaagtatagcgaacctagcaatattgaacgtgaagtttacaagatacctcccaggttgcatccattcataaatcatccagcagatatttatagagcaccaactttgtgtaagtcactgtttttcaaagtatagaactgtgacccagaataataaatccattttattttgaaagccagcatgcacacacacacacacacacacacacacaccccacccccaagatagaaccagcaaaagtttcatgaaactaatgtgagatgcaccctactttcttttctaatctgtttcatttttatgctggtcacaacctattaaactgatacctcaatccccattgtttgaaaagcatcatgataaagaatatagatttgtttgtccctttcaaagagtttaaagtcacacattaaggttgaggattgggggaaatttcactaattcttgtgtagaacctgcttcatgtcaggcactgtgttaagtgtctcgtttacagtgtctattcaatcttgaacatctctattttatagggaagaaagaagtcttgtgttagatggtttctatagtgagtagaaccacactttctcctatgataaccctagctgggttcagtgaaaactaaagactacttccattctgggtttttctgcttttgtaaaattcacctactttattacatgtgagaatctcatttacatctgtattatttggataaaatgtggaaatctttcagatcaaaactatctgtagattggttgcttattcatagttctaacctataggtttaagtgcaatttttaaaaatgtgcagctgtcagtaactctcaaaagcaaggcttagaattggctcagtgtgatctggttctcacaaacgtaatcatctcaaaggctttatctctagcaatttttttctttaaaaattataaaggttttaacatttttatttcacaaaaatcaataatacatagacaagagataaatctaagaaatatacaaaagtaaagaattaaaatccctttatctaaagatcagttgaagtttgctttacccttaatatttttagctctattcatttgtattgcatgtatatttactaaaaacaaagagcttatcttatgtgttaatctatttaatgaatttttaaaaattgacagataaaattgtatgtatttactgtctacaacgtgttttgaagtatatatatatatatacattgtggatataactaaaattaacatatgcgttatctatcttatgtagtcattgtttttgtggtgaaaacattttacatctactttcttagcatttttcaagaatgtaatatattaagtatagtcacaatgttgtacaataatctctagcaattctaagttagtagttacccagttgaaagagcaataaatgtactttgagctcagaggtgcctactgtgaatcaaaaatagagaaagtagatggaaaaacaaattgtataagtattctttgtgctttcagacagagttaccaatttcccttttcttatccaaaaatgccatttatgaatttctataaatgatctgtgtgtagctgtttgactgtaagggataagtcagctgtcactgttccagttttggtttctcctctttttgtgctgtgcaaattctgcactttcccagacttgtctgtgctggatgcaggttttatattaatgtattgatatgtttacttccaattcattactttcatggcctgtgtttaatgaggtgttggtaaacagtctttggcgggatgaggggaacaactctgatttgtagtgcttgccagttttttttttttagatggagtcttgctctgtcacccaggctggagtgcagtggcaatatttcagcttactgcgatctccgcctcccgggttcaagtgattctcctgcctcagcctcccgagtagctgggattacacgtgtgtgccaccaggcctggctaattttgtattttttagtagagaaggtgttttcactatgttggccaggctggtctcgaactcctgacctcaggtgatccacccacctcggcctcccaaagtgctaggattacagttgtgagccaccacacccagctgagtttctaaggtgtaaatattaatacttccaccatggctaattttaagctaccaaggtaatgtcactgaacttggagttggaaagagacacaattggttctcatgagctggcaagatcccacttcgggatgtgaatgcccttgttcagtgttttctttaaggacagaatcttaattctaatatccagaaaaagtctgttctctcttctacagcttctaaatgctgcctgcaaagttgctacctcagggattttttaaaaaagatctgttgatatggtgctttatctctttgtaatctaatgtcattgtgttttgtctcagcatgtgtttcctgctttgttttatgattaggagggactagttttacccccctgtttttagagttgattaaaggggaaactacatttggatatttggataaaaaaatcataacaaactttccatatataactattaaatatttcttacctctaccccaagagatcctcatcaatatttgttgataatttcatttttgttatctcatgggatgcactgtcatttatttgcattgcttggtttcccttttctttttttgacattgtattcattttaaacatctatttccttttcatactgtgaagcttctgaggaggaaagcctctatttttcatctccatgtgcccagggtctctaacaagtacctgaaaccagtcatttgttgaataaacaatgaataatagacatgtgtctaattttcagtcttattgtcataagaggtcatatctggagaagttatttggaataatccaaatttaattgaagtcgaggcttacttacgatatgagttccgtaaataagtatgaaagaaacctagaagtaagacctggataccatccatggatgggagaaagaaagcagtattgatgataaaggagaagggaccatgagaagaaaagagagggcagggcctgacacatagaagacagagtgacgagaagtgtccagggtcagagatggatttggaaacatttgctgaatgtgactatagagggatgtcacttgtaatttttacagagcagtttattaatgtgtttagagcaaaagttcatttcagatacttaagaaggatttgagtggataggaatgagaaccagtgaatgtgaattgctcatccaaaactaagctgagataggaagtaaaataaaagttatgtatagagaatagaattctaaaagggatagttatttgttttaatgttaaaatttgtttttcattgttgcccttgtaagtgatacttcataaaggaggtttaatgtttaagtgctatatggaaagttccaagtcttgccaaatcgatgactttcgaaatttgagagccctaattgaggtgggtggagagctatggtctaatagaaatcataacatactttcaacaccaggactgatattggatgattttaatatgctgtgcacatctgttgatgagagtactagaagtgaattggaaaattccaatacaaggcaattcaagatggtattattagtatgtgcattataagtcaattgttggcatagaaatacatctatatgcttttgaaaaacccagaaattactgctctgaatcaataggtgggcatcccctcactgtttcaggtaagttggagcacacaaacagaatgagaaacagccttgcctaccgtcagagaggccatctccatgaaatgaatagacagcagcaattaacaagatgccgattctgtgctccttcccccaaattaaggcatgtgcacaatagaaggtagttcacttaagaatggataggttatgacttgaagaagaaagggaatttttaggggagaggaaaagcataggatgagaattgtgtatatggagaagaatatgaaacaaaggggaaatttgaatgtgtttcagtattataaaaaagtaaatgatttttctaggggacagcttagttccagaattgctttatctgtttgtacatatgcagatcaaagtagctttttaaaaccaattttaaaaaattataaaagtagtacttgaccttttttaaaaaaaaatttcaagtttagagatgaagtaaatctttgcctcctctcctagcccctgcctttactcaagagtaactgttatgtttttttaatattcttctgcaaatgttaaagtatatttctatatatacatatttttattttatttattttgagacagtgtttctctctgttacctaggctggagtgcagtggcatgatctcagctcactgtaccttctgcctcctgggctcaagcaatcctcccacctcagcctctcaagtagctgggactataagtgtgcaccaccatggctggctacttttttgttgttgttgtggagatgagatttcaccactgttggccaggctggtcttgaattcctgggctaatgtgataggccagccttggcccctcagagtgctgggattacaggagtgagccactgtgcctggcctatatatacatgtttttataaaaatgtttcatttatactctttctgtctgctttttttttttttttttttgagatggagtcgcactctgttgcccaggctggagtacagtggcacgatcttggttcactgcaacctccgcctcccaggttcaaatgattctcctgcctcagcctccctagtagctgggatcacaggcgcccaccaccacatctggctaatttttgtatttttagtagagatggggtttcaccatgttggccaggctgatctcgaactcctgcctcaggtgatccacccgcctcagcctcccaaagtgctgggactacaggcatgagctactgcacccagcctgctttttttttgtttgtttttttcttacacttaacattatatcttagaggtctttccaaattgttatattgatttattttttttaaaaaagctatgtggcgttcaactgtatgaatgtatattatttgctcacctacatagaaaccttatagacatggcatagcatgttaactttttacaaaggtgtatcaatttttattgtacacaatgttttctacaggatactgtatgtggatgcatttttaaatttctacttacatacacatttccatgtgcctcacatttagaatgataaaatcattggtttggaaaagactttaaaagtcatcttggacatgatgctttaatctcgttgataaaatatctaccacacaggaggaacagtccttgtttgaactgggtacttgcttgctattaccagaaatagccacatcagctaagatgctttcagctgcaaggaacagaatgcctgcctaaaagtgactttaacagcaagggcatttcagtacctcactcacaagtccagaggtaggctgtcatgggttttggttaatttattaggttggtaaaattgctgtttttgccatgtttttaatgaaaacacaaattattttttaccaacctaatagcatctctgaatcatttagctttccctcatagctgcaagattgttttgatgatccaagcatcataacctcacacagttgggttcaaaggcagaaaaacagaaaggcctttctttcctatgtatcaaggtggagatccagtcccagaagccccttagtggacctgcctttgcctctcattggctagaatcatgtcacatgtccaagacttagtttcatggaattgtgggaaagaatatctctagaatattcagattttatagtgataggtcttcataaggaaggttcaagggggttgggagagatgttgaatagacgctctacagagttggctagagtagtcaatttcctttttggatagagtcaaaatctgtctcttagttactccactaatgctcttagttaagctctgtaagccattcctaaggaataaggacttctaatgaaggaaatgtgtagaaagctgtaaagttttcctcctttttctttttctacactcctttgcatggacctttatgtgctgtcataatagtgaaaaatacggaagttcagtgttttctctggctcaaactctttccttgctttcaacggactgtgccatagctgcactgcgccatagctgcactgcttactaaggtcctttctttatagtaattcatcaaaacctataatttctcctttatttatttgtctgtgcttcccttttgtcaccccagatacctgaaataataagctggtagaaacaagtcggaacttctaccaagtagttttaattgattagagctatgagaacaaattgcatccttgtatctttttaaggtgatcactagggatgctataaattttaacagtaatatgtgttttaagtttccttttcccttatttttccttctttttcatcaaacttttaaaagatctctgatttagaagggaagcgaagtagatatttgatatgggagtctttcactctaagttacatactaaccttcatttctttgggcttagtatttgtgaagcggttgtaatagattggaagaaaatattaaatggtgtagaaataaaagaccaaggccttggatcctatgtgtgccactgtttccttgacttcttaaggttttagtgatcttggagggtccatctctgttggggtctgagcatctgtgaattatagaatttcctccttgtgattgcatttgtgtgaagggttcactgttctttgacccccaccctccagaattcctagataagaccatatatttaaggatgcaatttttgaatgaaaacttataacaagatagatccaattatttcatttctaggcgagacattagtggagacagtattttattggaacatttcagactttctccttgatattgaatgtgtaaaattattaactgtaaaaactaaattcctacttaatacctttattttctttttgcaccatcctttggatttgtttgcctcctgtgtgtacatttctaggaatcatgagccctaggacgtttaaaactagaatgttgtcaattcaaattttgcaaaatacctgagttcagagaaaaaaggggtactctacccctcaaataacatcattttttacatggtatgttcccttaaaggtcatagtatatggaaagaacatggggtctgctactgaataaaaaagagataccaagcaagatttgcaaacacttaaatagatggctgtcagttctccaactctatcttctttcctgtatgtcatatggaactagccaatgtgttatgactagctattataatggtctgtgaaagtctctctgccttttgtttctagaacatgtgggggttttttttgtttgttttttgtttttgttttttttgttttgttttttttgagacggagtcttgctctgttgcccaggctggagtgcagtggtgcgatctcagctcactgcaacctctgcctcccgggttcacgccattctcctgcctcagcctgccaagtagctgggactacaggcacccgccaccatgcccggctaattttttgtatttttagtagagatggtgtttcaccctgttagccaggatggtcttgatctcctaaccttgtgatccgcctacctcagcctcccaaagtgctgggattacaggcgtgagccacagtgcccggcccacatgtgggtctttcacacattgtccctaagttgcacattggtagggagcagaatatccaaactgacaggtaatccaacttcttggctaagccacaccagatactgtttaatccctaaactatttgattattttcttccttgttctttaatttcctgggaatgtggaagaaacctcactatctgtttctcagtgcctgaaaggacaaagtctttttggaaaaatatcttattaaaaatttgctttttatgtccaattctcttccaagatagtgcccaaataattgtagaagggatttgagatttttgcctattttacgtgctcaaaggtgggaaatattctaaaagtcttgtgaattttgtttacagagaacactttttatctgttcataaaggcaatggtaagctattctgttagtacctactttgagaaatgtggcagggcttagcgaccttgtaaatgataggtttggatccattatgaagactaatagtagaaatcctcacccttgttgtattatacttccataaatgtcagtttaaaaaagagggtaaatggggcaggtgtggtggctcatgcctgtaaaatcccagcactttgggaggccaaggtaggcagatcacctggggtcaggaattcgagatcagcctggccaacaaggtgaaacctgtctctactaaaaatacaaaaatgagccaggcgtgatggtgcgcacctgtagtcccagctactcgggaggctgaggcagaagaatcggttgaacccaggaggggaggttgcagtgagctgaaatcatgccactgtactccagcctgggcgacagagtgagactctggttccaaataaattaaataaataagagggcaaatgaaggtgagaaagactcaaacatgaatcgggcagaccatcacattttctttctttacactttagaagttcatctggacccctaccgaacatggtgtcctgttgcagactgtcagacagtgtgccctgttgcctcgagtgacccaggacagcctgtgctggtggaatgcccttcttgccacctgaaattctgctcgtgttgcaaggatgcttggcatgcagaggtctcctgtagagacagtcagcctattgtcctgccaacagagcaccggtaagaaaggaaactttgtctttgggattattcactagttttcttagaaattcaacataccttacgtgtagaaggagttacgttgtgatggcgtttagagattggttattttcctgcagaacttccctgagaagtgtctcagaattggtaagttgccaacaaaaaagcatttctagttgtttgccccagaggaatcttccagatattgctggaattaaagtttgtatgagttttgctttctctttaggtagtgaggcaccgtggtctactggttctcagtaggaaatcatgacttgttcccgctctttgctcagatacagtatctgcctgtattggtatatatcattcttgttgcttgcaaaatgagaaaagaaattttcttacctgactaaattgccagctcatgatgtgtgacagtcatattagaaagaacacaacaatagaaacaacggtcctaaattctttcagcacgtagaaaggagggttctctcatgatattttatgctctgtaaaggttgagattttatcgtgataggaagcaattaaatctgtacctttttagtacagcgggtttttttttgttttgttttgtttttgagacagagtcttgctctgttgcctagactggagttcagtggcacgatctcggctcactgcaaccactgcctcctgggttcaagcgattctcctgcctcagcctcccgattagctgggattgcaggcacttgccaccacgcctggctaatttttctatttttagtagagatggggtttcaccatattggccaggctggtcttgaaatcctgacctcaagtgatccacccgcctaggcctcccaaagtgctaggattacagacataagccaccacacttgggcgatacagagggtttttatggcaacagcagtgcccagagtgagagacctctgtgtttcattcctgctttgcttgaggctatcgttgttctgcatcagcaagaacaaaatacgagtgttgtaatcccattggcttaatcacacagtgcacccagaatgtgtagaaccaggcttcatgaatagtaatgctacttggctacgatgctgtgcttgaatctcagaacaaacaaatggagaggaatagagaagctaatacacatggcaggcatgtgccctcttagccggattcaaaccactgttgcctacattttcgtggccatagcaggaagctccgtgggtatcacagggcaacgtaaagaactcagaggataggaggatttgcattctgacattgtcactcggtatctgtgtgtctcatagaagccactcagcctctgtgagtctgtttccctatctgaaaataagggaattaagatacaagttgagcatcccttatccaaaatacttgggataagaagtgtttcagatctcagtgttttcagattttgaaatattttcatgatatgtttattggttaagcatccttactctgaataccaggagtcagaaaggcttcaatgagcatttcctttgtcatgttggcactcaaaaagtttcagattttggagcattttggatttcaaattgtggactagggatgctcaacctgtaataactgtcttatgacaatatgaggttattgttcatacgaagtctgataatagatttgacaacactctgtgagttggatatctctgtgtgctgggtggtggttttgatgggcagtagctaaagtgttacatggtgctatcgctcactccaattcctgttgcttattttctgtgccccttggggctgtgagcctgtattggtctattcgtctgtttggagaaggtcttttgaaagtatttgacattattttaaagtgtttatatttgagaaccccttctccatttgtctaatgaacagaccattagatagattatatacgcccagtttggaccctgacctagtttctctgctgtgtagccaactccttgccattcttatttaggcaatgcatgcttagggaatgaaatattaatttgacaaaatagtgagttaaatcagtggtggaaactgtaattatataattcactgaaagccaaaataaataaagattccttcttgtatgagttatctgtacatctaataatgtttttgcccacaccctttcttttggaagtgaattaagcatggataactgtgagttcattatctaaccatcaggagccctgggaattcaactgatgaccatcagctgaatgccatttctcatccattttgtttctagagccctctttgggacagatgcagaagcccccattaagcagtgcccagtttgccgggtttatatcgaacgcaatgaaggctgcgctcagatgatgtgcaaaaactgcaagcatacattttgctggtactgcctccagaacttggatgtaagttccacctaggtttgttgtatggtgtttcctatactgtatctgcaccacagctgatatcctacagattttcctttaaaatattggggcaatttttgtcctgcaaaaggaatttatttttcttaatgagacttactaagcctgatactttagatatctaaaaacatctttttgatgaccttacatatgccaccctggtgttaaaggcaagcttttgttttcagggcatttcttgctatttgcacattgtctctattatgtaaaggactattagtgtcttcattttatattgctgttgtaacgaattagcacatacttagtggcttaaaataccacaaacttattatcccacagttcttcactttggaagtctgacataggtcttgctggattaaaatcaaggtgtcagccgggctgcatttctttctggaggctttaggggagaatctgttttcttgccttggaggctgtccgctttccttggcttgtggcctcttcctccatcttcaaagccagcaacatcagatctctcactcccttctttcttagtcgttgctccctctgaccacagctgggaaaggttctctgcctgaaggaccaatgtgatgagattgggcccatcaggataatgtaggataatctcctttatctcaaggttcttaatttaatcacacttgcagaatccctcttgtcatatagggtaacacattcacagattctgggaattaggccatgatatctttgggaggtagttattctgcctaccactattagattttttcttcgttttgaatttaaagaaaaatggttcaaatcaatggtgtctcctaactctcttctctccctcatgctctcttgcatgctctcactcgctctctctctctcttgttcatgagcatgcagcagtatcgctactgttttgacagtgttcccttcccagatcaaggggcttggcttaattttttctcaccattcatgaatcaagtctcaaattgaggtgcagttttattcagccctgtgccaaggctaatggtaacttcagagttaaaaatgcgatgcaaagagttggtgagaaggtcttacttcacttctggtcttttaaagtttggggtaacataagttgtttatagataacactctgttttggcaatttggacctctaaaatatgtccatatcagcgtaagccctcagttaccattgagttgctattcttttctcagctctttgttttgattgcttgatttgctttaattcaacaagcgatttgtgtagtgctttagttcagacatgcttagtgagtgagtgtgcagttagcatgtaatgtcatcaagcaggccaccacctgcttgatgtttaatggaaaactagatatgttgtttaagatgacatgtatgaataagaataataacctccatcttagtgatttaagaagaggtataaactgaggagaagaaaatggacattttagactctagaagttcagcagctcagtttggaagaaatatcttctatttaaaaattgatttatcataggcccttgagttacaattatgtttgatatttaagacctagcatgcatctaagtgagtgatattctggatgaggattttactgattgtacattacacatgcattacaaatgaaaaacaatttttttttgttttccttcaggtttcaccagaatattaattgggttcatatccacaaggaggctgagcccatgaggttctctttaggaggccagagtgtaagggaacaaatatgtgcaccagatctccatcctttggttgaaatgtgtttgggggatggtgttgcaaaggacatgctgttctgtctcttgtgctgctctggttctggagatgaaatggtgcagatgttaaatggctgaatacacagacttcaaatattgaagcatctttttttctggtgactgttttctaagatctcattttcagttttagccaggggcattggattgttggtaatgatgtttttctctacgcaagtggagttctacatcagatggtggtgtggatctctgtttataggaaagtttgagatcatggggccaggagaggggtgattgtctaaaatccaggcctgagacggacaccaaacaggaattttgagtgttgttggagttgagcttgttcctgccttgattctcacccctgtagtttcagaggatgagttacgcttaattgtctgctttagaatcctattcctgtccatagccttagagacttgagctgttcagttatctctttcctctcctgtggtttcaatttccactctccactctctcaacatatccatgcattcggctgtgtcacatttaaacacgagtaaacatttttcttaaagcctacttcttttccttactacccctctatttatctttcctttagaagccaagcttcaaaaaagcctaatcacctcttgctactgacattacttaccttccaaatactgcaatgtgttcggattgccacgtagtcacaccccgactgtacctctttcccagattttgagtgatttcttattggcagaatccaatagtacttgtttttagcatacctagattctctgctgcatttaacatcttgaccacttccatttcagtgataccacctctgttggtttctcttctacctttctggtcatatcccagttccctttttagcctcttcctcgatccagtcttaaatgcctgtgttcagcagcctctttgcttctcagtttacccctcttcctagttaatctcagtctcttctatggtttcttctaccccatgtacaccgatgcccagttgagtcccctttctccatttgtctaatgaacagaccattagatagattatctacacttaatttggaccctgagctagtttctctgctgaggtccaagtttttttttttttcagtgtagatctttgtgatgaactgccttttgaacagccctgcttggatgtctcaaccatctctcaagttcaacgtgtccaaacttatcttcccaacaaactccatctctatgttgtcacttctctcaataaagcgactgccttcttttaacccaatcactttcccttctctgtgattgcttctccttgtttctctccagttactttcttaatatctgaggactgtaacttcctcttctccatccatcctcagtcactggcattttctctctcctggtttgccacaccagcctttcagctgccttgctcctggtcttcccattccattgtacctccgccagagctaccttgctaagataagtagtcaggtcattactactctttttttttctttttaaaaataattaattgagattcgtattgattatgatctgctttcactttggtgatttacaaaactaccaagataaagattacaggcttggaattcctagagggggtcactgatatcaccagagaaaaactttgccttccatttggtgatctgatgtggtctgtattcatttctcaatttaaaactgcatatttactgaaatcaatctttttatttttcagaatgacattttcctcagacattatgacaaagggccatgcaggaataaacttggccactcaagagcatcagtgatgtggaaccgaacacaggtaccctgaccttatagggagcgtgacataaaccaaaatcgtgatggcttaaagagcccacctcttcgcctttcctcattattccctcctgggaggtaccatcccagcctgggagcttctggggagtgttagggcagggctagggaaaagtaatggggtaaatacctaaagttaattcatgagcacagtctccttaaggacaagcggagaaacaggggcaccagagctgccaggcagtcaacagtgacgtgcagaatgcaggcagatgttctttcctcttgagaaacagtggaatgactttcctaaagccctttaaggcatattacctatcaaaggcagtgtattagtctgttctcacactgctaatgaagacatacctgagactaggttagttattaaggaaaggggtttaatggactgacaattccacatggctggggaggcctcacaatcatggcagaaggcaaaggaggagcaaagtcatgtcttaaatggtggcaggcaagagagcttgtgcaggggaactcccatttataaaaccatcagatctcatgaaacttatttactaccacaagaacggtatgggggaaaccacccccatgattcaattatctccacctggccctgtccttgacacgtggggattattacaattcaagatgagatttgggtggggacacagccaaaccatatcaggcagtgctctaaaaccctgtgagccccttctagggcttagatccctgtgtacatgccattgtgtgtttatgtggcaggttcaaaaggagtcatggtttatttttaatttttaatagtgttttatatttattaaaggcggtattcctttggagggagtcagtgctaatatcctagtaatcattaacatccctttgagctagttgaggaaattcaagtagagagagagcaccaataccaataattcatgactatactgagcttgcgacagcttgagttagcatttggatggtttccatccttgatttggtcctttgtatctctctggcttctctccaattcagatcattgctgggcactagctgaaaggtcccagaaatgtaactgttctgtgtgcctgagatgatgtcttgttcaggctgctataacaaatgaccatagactgggaggcttaaagaacagaaatttacttctcatagttctggaggctgagaagtctgaggttcaggtgacagcatggtcatatcttagcaagggctctcttcctggtttgaagatggccatttttttgctgtgtcttcacatggcatagagcctagagaaagaaagcaagctctctggcatctgttcttgtaagagcaccaatcccatcatgagggccctgccctcataaaccaactaacttctaaaggcctcgtctccaaataccgtcacatcggggatttagggtttcaacatatgagcttcagggggacacaaacatttggcccacagcagataacagtatagttggaataagtatacatattgaaagacttaattgctgaaatatgcttttctttgaaatttccaggtggtggggattctcgtaggcttgggcatcattgccttggttacttcacccttgttactcctggcctccccatgtataatctgttgtgtctgcaagtcctgtcggggcaagaagaaaaagcacgacccatccacaacctaaagatctctgtgttcatacgccccagatatgtgagttacatgagatggcacagtgataaagccccatttagtgaccttgcctccttctccttgccaactttgaaagtgcctccgtgtccagactttgaacttgcctgccagccttcagcatcaggaaaggccaagtcctgggtgtgagtgttcctgtgtaacaagaactgggctcaacggtccagctgtttctatggagctttggggttccttgagatgaatgaacatatcattttatcatccaaaggatctcactggactgttcaacttccagccaaattcaaggagcttgcgggaacatttgatataacaaatgtgttgtcattgttggcaacatacaagataaccaagaagctggagtctgttctgtgttgatttgactgccatgagaaacacaggggaaacctgatgaggagaaggataagactgcgtaaggagaaatcctcataggagctataaagcaggctgctgatctcagcagttgatatggtggttgtgcctctgctggctactgggtgtgctgtccccatgttcccgctgtgatttggcagaaacacaataggcttctccttgtgtgatctcagcttcaagcaggtgaaactgctgtgcagagggagttgccccttcccagtaaaagagttgcagcctgttaaacaatgtggtctaatttagtgtctctcccttggcaaatgtaagttttctaagttggccaacttgtctcttacagccagtggctgtggtctacagaattgtttcatataaaatacgggtagagtggtagagtttcaaaactttcgtcatagatatctgggacctttctcaggatctgtgttcacacagccaatagatttggaatcaggcctaagagtacacatggagggtaaatattaaagtgcgtattatgtacatctagaatccatgtgacttgcagcctacctgtaatttctatccattgagcatgcatggatatacccaatagtacacacaaaataaatgtttacttaagagccattctatccttttgtgactgaaatggtttattgtaaatctgcctaaagattttttgcatattatatatgtgaattttggttgtaagttcataacttacccaagggtatagactcataactcttttaaaacagtgcttagtacaatatcctgccatctctgtaaaaacgctaattgataaccgagtcatttacatgttttcgaacacagaatagctcttttctcagcatcattattgctctttcagcatctgttaggacagtctgaatactttctgtttcaaggcactgataaaaccgcaacaaaaacatgtaagaaataaaatagaaatgctttatataatttagtttaaatttatgtatcacctcattgtgacttattttttccattataccattagtcagatttgaataacgaggttttgaaaggataaaaccttttctccaatgacaggattatataattgctattggcaatgtagcctggtgcttcatgagacctatgctaaatgttactggagagttcttgaagccagggataccatatcaggaactattcaggatctatgatattttctgaggtaactgggtaatagaatatcaaattgctgctatctcggacctattgttaaaggatgatgctttgcctatgtaataggatatatcctaagtggggatgtgtatatttcaggaactttaattcacaagtatatattgatatctgatgtgtgtatagtacatctgttggttatgtacattttaatttacatgttgtgtagaacatagatgagaactctgggaaaacttgggaatggcaaccaaccaaaatcatttttaatcatttattagaaatttctcaatattgtgtctttttcttttgaaactctaaacacttcagaaaaaaacactatcagtgtagttcatgttagtataattatagatttacatatatttgaatagttaatttgctttgttttacacgtagcccactgcctcattataggtaaaaggcatttataactgctcaggggattacgagaactcaactgaaactgaatttttgtaacaagaatgttaatagtggcaaagtcctctgtcagtaaactctttaagcttggtgctgcaaagagtctttaaatgggggctgatttcaagtaacctaaaagactgtgttatcagaggaagaggtcccaaatttggagtaaagatgggagaaaataaatatgtgctatttccttggcgagttgagggaatttgccaccttacagagtttgtatcactgaattagctgcttttgtttttttttttttttttttgccagggctatggagtgggggttgtttgtcaaactgattttcaataattggatttaattttttttaacattgaaaagtgcctgaaaaatggtaaattcttaaatgtgtgtgagattgtcagaatcaacaaaactaggttggttaaacatatctctggtacatcaaggggcatgatacaaaccagtctaaagactgtttataaaggagagagctggcgacttatttttatttttattttttggacagagtctccctttgtcacccaggccggagtgcagtggcatgatcatggttcacttcaacccctacctcctgggctcaagtgttcctctcaccttatcctcctgagcagctgggactacaggcacacaccaccacacctggctaagttttgtattttttgtagagatggggtttctctgtgttgcccagtcttgtctcaaactcctgggctcaagcgatccacccaccttgggctcccaaagtgttgggattacaggtgtgtgtcactgtgcctgacagctgacagttttaactgacaactttgataacagaggctgctatttttgttttagataattggccagtgacagagtttacccttgcctcctttcttggtctgccagctttgtcctttctgagtgattctctttctgtattgagaggaagtgtgggtctacatagggatgtttggatgctatggcaagaatctttttgtgtttggagtgtagtccatttgcaatagaaataaaaaaatccgtcaccaaattgtaacctggatgttatagcccagcatctagaaatcctatgaaacgtattagcacaatatcttgccattgtcccatctaggaaattttttcttgttgtgaggtagggaagtgaggaggaaagccatgccgaagcaaatgttagaatcttaggcatcctatttgttcatgccatgggtatttgctttggacttggagtctgtactttgaaagaggcctttgaaaaacaaataattctgtgtgaattttcttgtagcgtgcttcatgaaaatatctacttatccaggtttgcaaatgtacatgttcatttgaatgtaaatcaccatttcttggaaccccacgttttttcttaaaaattattctgaattaaatgtatatttctttagccttccctacacagtactaataaaagacttttctttctgttcatgaatggatgcctttatgtgatatagagtcatgtgtgtatgtgtagctttaagggcaatttcagaaatgcattagatgaatgacattttataaagcgatcacaattgatatctacaggctattatgtctcatgttgattcatgatccaggaagttttatgtatttaaaaaattgctatcgtgttatatttttccaatttttggagaagaaaatagctgtttaggctctctagccacaataaatgtaagcaggaaatcaa

SEQ ID NO: 2024 - DNA, 61524 bp, Homo sapiens
tttcatttccaaagcacttgcaagaatctgtttatttatccagtgacctcagtgtattggctcacatgtgttaacatattttaagaaataaatcactgtgcaaatttgaagtatttgaatagcactatcattatttgattatatttttatatattttattatatttatctgcatttggtttatatccacagggtttttagtcatagatacatctgtaatttatatgccaattacatatgataatgttatttgtacctccaattttttttctcatattggtgatccctaattccaggtgtggtagagctcacagatcatgcacaatcttctcactatgtgcaggccctttggtagcaaacacaaaagaaaatcaagagatataaagagatcatacaaaaggaattttgtatatcttctgtaaacagaaagacagattggaaatttgtaagcaaagttgcaatatggaaataggaaaaggcatttctgaataagggggatgtttattcaagaggttgtgttagatccttgtgtatgggcaatgagctatcagccaactacaattactaggttatgagttcttggatggaaaggaatatgcctactttgtctaacaatgctaaaaaacaggctatatgtacatgataagtgattagtgtctgttggtaataaccaaagggatggatacaatctaattatctatcgagaggggacaggtcaaataaattgatattttcaaacctttataataatgaggtatgtttacatgtgcttttagaaaatgatctccagaatatattattatatgaaaaaaagcaaagtttagtttatcccctttaaaatagtaaaaaagaaacataagaaatataagattttatatataatatttctagaagaattcaggatatctgtttatggtgaatgtcctaaggagtaggacagagttactggtgggaaggagaattgcttttcattgtatacctttttatcccttttgaatcttttaatttataagttcattaatttttcatttaaaatatttaaaaaatagtattacagaaagtaattctgtatcactatgcattcagctctttaacataccacatcccatttaatataaacaacaactcatcttatggatgaatacatgaaggctcagagaccacaagtgacttatataaggtcacatagctagacagtaaatagcatatttaatacttgacccaaatccttgggcttcctactcactgatgcttttcccacaactccacagaccaagtgcatatggatataaaaccacagtacatttcaacatagttcagtcaggtcaattcagtactcaagcatgctggttttgctacagatgacagatcaagcttaaaagtactacatgatatttttccacatggctcctgctccttctagtccttataattctttcctattggggcccaacttcttcatttacatggctcttatctctggcttccagcttatacattactttttccccatagctgtaattagcccctgaactcccatcatcttggatcttccatgctacattcatcgttcccttccaatatcttttattccttttttttaattgaactcttagcttctacctatttccatttctttttttccaggtactaagttatctctcccttattttatacaacttcctatcttcctacctactcccaaattaataaatcccaattaatcaatcaactcccaattaatcaattatctcccaattaatcaatctctgctaagagttccttacccttccactgagcatggctactttgatccttttaccccaaacataagtatttataatatttttatacctttgtatagtatccattttataattttaccatattctttaatagcgactcaactgcacttctctgatattaagaccatggataatataactcaagagtacgtttttttcataccaacaattccatggttggcagtgtccaagtggttaaaaacatgtctctaaaattaataaaacctgggtttgagtcctagttctgtcatttaataattgtgtgagtttgggaaattttctaaatcttatctgcttccctatttgtaaaatgaggagaggaatacttattttataggtttcccgtgataattgcgtggataatgcaagcaaagtgctgcagatgttagtggactcaatgtaagtagcaagtaaatacccctcgtcttagcctcactaccgcatcagctctccacaaaccttgcaaaacaaatcttttccttctccaagacccatcccacccacctctcagcctcaacactacctcaacacatcatctgtgttgaaaccaagaaaatttcatcatgccacttacactaagggattcataggaaaaataccaaatatgcatcctttggcacagaatattttgtgccttaccctttttggagtaaagctataaaatttcctctaagtcataaaactctagattttaatctcagacattttctttttggaaacaattaaagtctctttgtgctgcatcagaattcacaaaaaagctatccagtgtccatttacattaattatactggtgattgactatggctatgccagagaatgtattccaggctcaagttctactttttgatgactgttctcaggatcatcagacacctgtccgatgtagcagctggaatatttaagcatcacagtgcttttaaaatagcagacaattgctgtggctgcaagaaaaagaaaaataaattaattaaaataaaatagcagataagccaaaccacaaagacatattttaaaccagggggttttaacactgaacaccctgatttcaattttttcaatgctatctaaatagaagtatattataatccaagataatacaagcctatggctccaagcaaagtcagatggagaaaaaagtagatttggttaaagataaacgaaaagaaacatttcttcctcacctctacactttgattgtagttcctggaatcaaatcagaatggagctaggctccctacaagccccattggaatggataagggaaactgtgaaaaactctaagggaccaacaagtcttttgcactggaaggaatcttcagagattttcctgaccctagtctaactccagtccccttgttttaccaagcaggaaactgaggattagaaagataaactgaaagtcccaacatgaattctaaagattgtcaaaggaatcataatagtgagattcaaaataatataccttctatttctcacccagcgctaggtgatgaaggctgggtatacagtataattggtctaagtgagcattgtaacccattgggttaccaaatcaggaataagcatgtgacctagtatcaatcaaacaaatataagggaaatttctatggggatttctggaaggaattttgatccttaataaaaaaaagaaacagtgagaaggactatatcttcttctggttgtgaatgcataactttgaagatgcagttcctggagctatcatagttgtactgcaaacttgccttagacaaaccttagaaagaaaatcaaaccactgagggtggcagaagggaaagatacaaagagcaatggtcactgagagtactgttgaattgctgcacccaagtagaataattactaaatttactaaaaattattgaattgtgcactttcaatgggaaaaaactatggcatgcaaattatacctccagaaagtgtaaaaagcaaacatttgattaattattgaaatacctaaatcattcagtaaaggatttgatgtaaacaactggtctacccagtaccaaacaagatataaggatgcaaatatattcctttaggtggattaacagatgagttgttctgactgaaaaattattaagttaagtctaaagtgaataaaagaagagaaaaagggtactaaaatgtcaaaacaagaagcaatcattgacagctacattttaggaaatatattctaatatctgaggcagaacctcaactgggtttggacaaaaaagaagtatttggggtaaaacaaaaaagtgtttagcatattctgacagtggaaaaaaagtagggaagtgcgattgttaagggttaggttgagtgtttcagtttgtgctcagaaagggctatttatagttatttagatttcaaattaatattcagatatttttaaaggtaagatattcttaaacctttgaggtcaacatccaaatctttcacttaaaaaatctaatatttttgtataaaataagaataatcactttcagatgttcttttattgttgtttttaactgaacatgagttcaagtaactcatgttgaacagattacaatcatgtaaataattctgtttaaatacttaattacactttgccacattttaaattataaatttaatagatttgattttttgcaagcatttcaagtgtctgcacaggtacacctataccctaaaaagtaaggccttccacagctccttcatcacttctatagagctaataaattttatctatgaaaatatgaatcacgattgttcataaatattccgaaactgattttaataaattattcaaattcttatatttttcctcttaagtcacatatctaaaccaaatacatatttcaaatgaaagtgacatgtgtaatctcttagattaaataacacatacacatatttccctaatgattgtgtaaaatgttcttatataaaagcctaagtatcatgggtttcatttatttcattgcatccattttaattctaaaccttcctgagtttcaagagatttactcagtgaaggagatttaccatctcaagtattaatagaatgaagttattaaatcaaagttctaagatcttgatagttatttattgttcagaaatttaagactagagagtggaacttgaaatctatacttccatgattcttccagaatcacaaaatagattgcagctattttatacaaactgtgtcagcaagtctatgcagctcacaaaccaattttattcacctgactgggatagctagaattctgcatccttaccatgactgcaattaacttccttcatgctctgacttgattccattaatttccttactgtctgataggactctgcaaaatttttgcattcttttagtcctgattggattttgtatgcctctcatactttggtctgactctagacatactcataatccttttaatgacacacttgactttgcagtggatctggcccacagtgtcttctatcctttaacagagttctttttgtcaaggatcaggtgccaaagaagaaagtttgtgaggtcacgaaattgatgcccaggtcattactttcatgatggaaggtgatctatagtgttggaatggttagagtggaagccaagcagggaataagtgcaaggtggtcaagaaagactcactgggtgaagtaatactagtggcctgatagaggagtagagaagacggaagctataagaatgtggtcctacagggaaaatggctccatttactctctgggaaatttatgatgataaaatccagggttaatgccacgcccatatatggaaaatatgttgggaaagtgaacctgtgcaaaattagagagtgaaagatttcaaagtggagaagcctaaaatgtactaatgtagatgtaaaaggcattagggatggtggcaaaggtaaaatgaagaaagaaatttgatccaagagctccagccatctactaagagaaccccaagccaaaaaatccctattcaactaacattttggacagtccaaggatgtgtgagcaacaagccagctacctcttcattttaagccacatatggtatatcaaaaatttctactggtgacaagaactgaaataatacagtttcttcagagctggtagtgataattaaatttgatctgtggcaactttaaacatagtgtttttgaaaataaaggtttgaaaaagtgataaaaatgtgttattgtactacactgagctaatctcatctttatttaaaatcatactccaaggttggtctacattgccttctatattcttgcaaatgtttctgaattggacggcctgtgattcaaacagaaaaagtgaaatataagaagccagaaaacttattgctcataaatttccttaaaggaaagaagaggaagaaatgttggcactcagcttgtttccctaaatggtgaatggcttcatcatcccacccctaattcaagtgcttagaaatttagcagaacaattgacgacaaatttaacttgatctttgccagagatatgaaaattttagttacaaataggattgccatatttatcaaataaatattcaaaatactcagataaatttgaatttcagataagtaacaattttggtggaagtatttaaccaaatattgcaataatgcatgggacatccttatactaaaaatttatttattgtttatttgaaattcaaatttaactgaatatgctgaattttatctggcaacattatgttttcaagtgagtagagtttagtgacttgaaattaaaaagcaatgaaccagaggctgtatgacaaatatagctcataagggtaataactttacccaagactctaatttccttccattacctatcccgtgctcccatccctgtaatattttttaaattttcaaattttaagttttagtccaatttttacatagggatagtcaagtgagtagcaactttgaaaaccagcttgactctaacagaaaatcagttcttctcccagtcagaaggcattctagatttaaaagcttcatttatttatgtcaacatttttagctaataagaaaataagcacagtttatacatagttgttacaacctactaaatcagctaaaaccttgcctgtttaataactaatatacatgtcatataaatgaaaataagtaacagattactgacttcactttttttttattattatacttttaagttttacggtacatgtgcacaatgtgcaggttagttacacatgtatacaagtgccatgttggtgtgctgcacccattaactcgtcatttaacattaggtatatctcctaatgctatccctccccgctccccccaccccacaacaggccccggtgtgtgatgttccccttcctgtatccatgttttctcattgctcaattcccacctatgagtgagaacatgcggtgtttagttttttgtccttgccatagtttgctgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgccacaataaacatatgtgtgtatgtgtctttatagcagcatgatttataatcctttgggtatatacccagtaatgggattgctgggtcaaatggtatttctaattctagatccctgaggaatcgccacactgacttccacaatggttgaactagtttacaatcccaccaaacagtgtaaaagtgttcctatttctccacatcctctccagcacctgttgtttcctgactttttaatgatcgccattctaactggtgtgagatggtgtctcattgtggttttgatttgcatttctctgatggccagtgatgatgagcattttttcatgtgttttttggctgcaaaaatgtcttgttttgagaagtgtctattcatatccttcgcccactgtttgatggggttgtttttgtttttttcttgtaaatttgtttgagttcattgtagattctggatattagccctttgtcagatgagtagattgcaaaaattttctcccattctgtaggttgcctgttcactctgatggtagtttcttttgctgtgcagaagctctttggtttaattagatcccatttgtcaattttggcttttgttgccattgcttttggtgttttagacatgaagtccttgcccatgcctatgtcctgaatggcattgcctaggttttcttctagggtttttatggtttcaggtctaacatttaagtctttaatccatcttgaattaatttttgtataacgtgtaaggaagggatccagtttcagctttctacatatggctagccagttttcccagcaccatttattaaatagggaatcgtttccctatttcttgtttttgtcaggtttgtcaaagatcagatggttgtagatatgcagcattatttctgagggctttgttctgttccattggtctatatctctgttttggtaccagtaccatgttgttttggttactgtagccttgtagtatagtttgactgacttcacattgttaactgaaattttaacaaaaagtgatcaatttgtcatatgttggtaataaaaagtcatcctcattaaatatcaaatgtatgagaataaatgaaattcctggagaaggaagtgaagagaagatagactatccacggtatcagtacagacagggagaggaaagaaagtaaaggtgagcaaatgaatgcctcccaaggtgtagtgggcagaataattacctccccaaaattgtccatggcctaatcctggaacctgtgaatatgttgccttatacggcaaaaggaattttcaagatctgaataaggccaggcacagtggctcacatctgtaatcccagaactttgggagggaaaagtgggaggactgcatgagcccaggagttcaagacttgcctggacaacaaaggaagaccctgactctccgtataaataaaatttaaataaataaataaaaatatgtgaataaatttaagaaatttgagacagggaaattatcctggattatccgggtgggcttaatctaatcacctgagtctttaaaagtggagaacctttcctggctttatagaaccagagagatagcagcataaggactagacccactgttactggctttgaagatggaggaaggggccatgaactgatatggttaggctttgcgttcccacccacatctcatcttgaattgtaatccccataatccccacatgtgaagggagagatcaggtggcactaattgaatcacgggtgtggtttcccccatgctgttctcatgatagtgagtgagttctcatgaaatctgatggttttataagtggctcttcctccttcgcttggcacttctccttcctgctgccttgtgaagaaggtaccttgcttcccctttgccttccacaatgattgcaagttttctgaggcttccccagccatgctgaactgtgggtcaattaaacctctttcctttataagttacccagtctcaggcagtactttatagcagtatgaaaatggattaatacatgaaccaaggaatataaacttctagaaactgagggaaaaaaatggattctcccctacaaaggaactagaaagttcctagaaaggaactcagtgctgccaacaccttgcttttagctcagtgagacctatgttctggcttctggcctgtagaaccaattataataaatttgtgctgttttaagccactgtttgtggtaatttgttaaagcagcaataaaaaccaatatgtaagacttgactgtttttaattaaaacacatacaattttagagtgcgcattttcccaggaaaggtctcagtgttgggatctctacaaggatataaaaggattttctcttgatacctccctgtgaatttgcacgctaactcccaccctgccccctcatcttcacccctgaaatttacagagtttctagggattgtcaagatgttggctactccatatgcaaaagaatgaagctggacccttatcttatacacaaaaatcaactcaaaatggattaaaggcctaagcatagacctgaaaccatgaaacttctagaataaaataggggaaaagctccttgatagtggccttggcaatgattttttggataggaaaagctcaggctacaaaagcaaaaataaacaagacaaactacatcaaactaaacaatcggcaagatgaaaagataacctacagagtgggagaaaatatctgcgaaccacatgtctgataagtggttaatatccaaaatatggccaggcgcggtggctcatgcctgtaatcccagcactttgggaggcggatgcaagcagatcacgaggtcaggagattgagaccatcctggctaacatggtgaaaccctgtctctactaaaaaatagaaaaaattagctgggcgtggtggcggatgcctgtagtcccagctagggaggctgaggcaggagaatggcgtgaacccaggaggcagagcttgcagtgagccaagttcgtgccactgcactccagcctgggtgacagagtgagattccatctcaaaaacaaaaccaaaaacaaaaccaaccaaccaaacaaaatatatatatatatatctccaaaatatatatgaaattcacacaatagccaaaaaaatctgaataacccaattttaaaatgggaaaaggacctgaataaacatttctccaaagactaaaaatgtccaacaggtgtatgaaaaggtgctcaacatcactaatcatcagggaaatacaaatcaaaaccataaggagatactacctcacagttgttaggatgggtatgtagtcctaactactcaggagctaaggtgaaaggatcatttgagcccaggatttgaggctgcagtgacctatgtatgatcactccagcctgggtgacagagtgagaccctgtctcaaaaaaaaaaaaaaaagaaggaaaagaaaatattaatgttctattgtagaacccttaaaaggaccttaaagatgaaccaattcaacttcactcatttactacataaatgcctttttcaaattcttcatgtgacagaaaaatgagttgagctaacaaaatgaaggcagaattgttaatctgataacagtagtatgaataattcaacagaagctaggaatttttgtactgatacattgactcatttacaaagctagaaggaacttttctgctgtttgtaaaatttttgtttagagaaaacccaccaagcaatagagtgaacatttagtaccttaatcttagatgatgaattcgttaaagaatttaatggcaggctattaaataatttgcattcactagcagaatacagcagtgtggtgacaaaaatctatcagacttaaaattaaatgtagtacatttgctaaaaagagtgatcatgtaatctaaaagcaagtctagaaattagctggttaacattacgtgtttttcaatgttttgaatttttctctttataaatggtttcagcatagtttttaaaaagaggtcccaattactagcgttcctatacaccaacaacagccaagccaagagccaaatcagaaaggcaatcccattcacaattgccacaaaaaaagaataaaatacctaggaatatagctaaccatggaggtgaaagatctctacaataagaattacaaaatactgctcaaataaatcacaggagacacaaacaaatggaaaaacatcccatcctcatggataggaagaatcaatataatcaaaatggctatactgccagaaacatttacagattcaatgctattcctatcaaactaccaatgacattcttcacagaactagaataaactattttaaaattcatatggaaccaaagaatagcctgaataaccaaggtaatactaaacaaaaagaacaaagctggagtcatcatgttacccgacttcaaactatactgcaaggctacagtgaccaaaacagcatggtactggtacaaaaacaggcacacaaaccaatggaacagaatagagagcccagaactaaggcagcacatctatgaccatctgatcttcacaaagctgacaaaaataagcaatggggaaaagatgccctattcaacaaatggttctgggaaaactggctagccatatgcagaagattggagctgaccctttccttagaccatatacaaaaattaactcaagatgaattaaaaacttaaatgtaaaacccaaaactataaaaaccctggaagacaacctaggcaataccatcctggacataggaacgagcaaagatttcatgacaaagataccaaaagcaatcacaacaaaaggaaaaattgacaagcaggatctaattaaacttgagtttctgtgcagcaaaagaagctatcaacagagtaaacagtcaatctacagaatgcgagaaaacatttgcaaactatgcacttgacaaaggtctaatatctagcatctataaggaacttaaacaaatttataagaggaaaacaaataaccacattgaaaagtaggcaaaggatatgaagagacacttctcaaaagaagacatacatgtggccaacaagcatataaaaaaaagctcaacatcactgatcattagagaaatgcaaatcaaaaccacaatgagataccatctcacaccagtcaaaatggctattactaaaatgtcaaatcaaaacaaaacaaaacaaaaaagatgctggcaagattatggagaaaagggaacacttatacactgttggtgggaatgtacattagctcaaccattgtggaaagcagtatggtgattcctcaaagagctaaaagcagaactaccatttggcccaacaatctcatcactgggtatatacccagaggaatataaatcattctaccataaagacacatgtacacgaatgttcactgcagcactattcacaatagcaaagatgtggaatcaacctaaatgcccatcaatgacagactggataaagaaaatgtggtatatatacaccatggaatgctatgcagccataaaaaagaacaagatcatgtcttttgtgggatcatggatagagctggaggctatcatccttagcaaactaatgcaggaaaagaaaaccaaataccacatgttctcacgtataagtgggatagaaatgataagaacttatgaacacaatgtaggaaacaacagacactggggtctacttgaggaggtaaggtgggaggagagagaggagcagaaaatataactattgggtactgagcttaatacctgggtgatgaaataatatgtataacaaacccccgtgacacgtgtttacctatgtaacaaacctttacatgtactcccaaacctaaaagttaaaaagaaaataaagttcccaaaactttatttctctctagcttcttctccaagagcaagtgattaaatcatgacaatgtttctaactatgaatgtcacacataaaatatgataccaattgaaagtatatagcttgcaagtacatctgggaattgtagaaacacagacagctcatcagtgttaattcaggcatggttttgaacaatgttctgtctacatattgggttttctgattacctaactttcctttcttgtctacatttctcaacagagatttttagtttatcttagagtattcatcatggctcaacttataatttcaagcgaagcatgattcagaatgccctcgatttttagcccttcacagcctttggttatctcaaagttacctgttctgatgtccacatcagtatgctaaagttaggagactatgatactatattccaaagattttcctcagaaaaatgaagacagctgttggctaatcagtctgaagtgcttgtcttttgcttataaatcaggtgctccttaagttatagttctttctttccttatctgtattcattcagcagctgatgaaactgtgctattatcttccaaataatctggcattttctctgcagaattgtaaaatcaatataaatcagctgagaattaaggaaagcggtaataaaaatcctgaggcaaagttaaaaaattttaagttttctgatgcatgattctgatttagattagttttcaggtaactgtttgagggtcaagaaagaatacataaactgatgatgatctgggtaaaatctgtgaaaaatagaaacttggtgttgatataaaaagatgttaactgtatttattatacaacataaacatcaacatgtatccgataatggaagaatgctctgtagctaaagccaatgaagagagaaatttggtagatgatagatagacagattgcactgattctacgagcccccaggattttgtattcccttgagatgtctcagtgcctggtcagcagctggtggagaaaggtcagagtgagctgcaccataaatcaatggtacagagaggcaggataagtggctgggcagaggcgggggagagagggacttaataggaataaaaagaggaataggttttgagatggccagttaatggttactgaaccggaaaaatagcactgcaggttgcagaaatggctaatgtcaaaactttgcattataatgagatctagctcaaccgtagaaggtttttacttctacagtttctaataatctgaataaagtttcttaaaatgccacatttattctccaaaagtttaagcattggtaaattcagagggcatactattagggtttgtaaaacaaacaaagaaaacccacaaaaatattattttagtaataaatttgcagacttgttcattatttaacttatgccatgtataactctgagttgtaacttctggctctatatctgaattctcatcaagtataaaataatcatactgaatccaaaaactcatttcagagaggtgtatggttacaattttttttaacatcaataaagatcctcttcaaattcccactaaaattaaaccataagtgctaccatttctagggtttatagtttttaaagcaaaaaacaaacaaacaaaaaagaagggatatttacctgagtataccaaataaacaaatatttttaaacatttgtttaaattgttaactttggcatattgtaatttagaggaaaatatcccgaaatcttttagcctaactctcctcatagtacagataagacagccatgcacattgcaaccctgggtgcccaaagtcacactacaaattaaggtcacaggcagaaaattgaatatacgtctcctacttcctggtccatcttcctttcttcaccagaaaaaaataattttaaaaatgtataaagactatcatggtaagatattagaagaatgcttcagcaatgatgttatgttttatccaagtcaatgttcagtatgagtagaatataatcaaaattagagagaagatagaagagtcaggaaacgtgctggtttggttatcatatcttcatagtgtgtgttcgtaaaacttaggaaaaaaccctgggattcagctgcccagatatatttaaagaaatatgattgttctacaagatttctttcaagtaataatagaaaaaaatagcatcagttttgctattgttgtaggagtagtagaattaacagaaattcatcaattgcctcatttttttttctagtgaaaggagatggccagcattcaagaatttgcagaggctactacaaggaagtgcagattcttctcacagttgtttcttttctcacgtccaggagaattcagcattgcttaagcatatttgccccagggtctagatgacaactgattggagtgatgtttgccctatgcttttcagacttgattaaaatgactagtggaatgaatgtgtgctgtggttgacagccttctaaatttgataaagaaaactataattatatccaatcttacctgatgttttaaacaaaatatttacagtgtgcaatgaagatatctttgtcctttatatgacctgtaagatggcttagaaattatagcttaactggatgcgttgatatgattaaatatatacttagttgactacctaagaattgcacaacaaaaatgaaaatgtaagcctgtgttttttttttgatcttccctaagaatcacttatgtctgaatgtgaatacaatttttaaagtaatgctcgttagaaacataaaaataagaaaagatactgtattttattttcacagaaaagtgcttctataattttaaataaatgcaatatgtaggggactcatccaactctgtatcagaaaggagactgaagaaactggaatacaaaatgcatctgtttatcctgttttcaaatatagtcaaaattgaggtcttttatgtagattttaatcatttttagtattttaaattcttccttaaatttatctttatagcccaaatctctcttgccatgatttggatccaattcccatttttcacctttaacagaggcaaatcagtgggtagtgtctaaaatacgtgataaccttcaattgaaaagtaaccatcagtttacaaatattttgtatttttaaggatggatctgcttctattaaaattaagaatgcaggtgaaggctcaggactgtcactctgtttacagactgaggtatggttagctctctctcatgcttctttatagtacccaatgataatcactaattactaataataactactttattatcatttcccactattcctttattgaatgaaatgcagatgggtggtgaggtgtggaggtaattaacactctcacatgaaagtccaaaggtagtcaaacatgactgccacttaaatcccattgtccagaagggaattacttggccatacccagctgcaaagaaggctaagaaacatagctttgatatggggcagccatgtacccagatggacaccgggactttgttaatacagactaagcggaaaatggatttgggggagctactagcagtttccattacactccactccacacattttaacattgtattaatagtcaaatccattgtgcctgggttaatctcatatggaccttcattgttttcaaacttctgaattatatttcatgcagagaaaaaagaaattggtgtcaaggacaatacagaagaaaaaaattctaagcatcaagttaccaagaatttataattagacatgctcatagtatattttagaagtgaagaaaagtatgacaaattgaactataggaaaatctcttaatttaactaagagcttggctctgatccttttgtcagtgacttgtgcaggatctcaaaatcatattaagtgtggcattaaagagatagggctcagtcacaaacttagctttgtttaggaattctaaacatggccagaccacttcaaagtgcttcacaaaagatgtacaattacttaaaaaactaatgcaatctgtggtcccaagataaggattgaaagcagaaggaaacaagtgagtcattacaactattggcttctatttttgatgagataaaggaattgcctgcttgagttctagctgcttcctatgtgaatatgcacaaagaatgtaggtgtggtaaataaaacagaagaagctattttaatacattttcataatattttgcatgtagttttagactgggttcatttgataaaatctgaccttcaaaataattacatagtaaatttttaaaattttaaacagacagttcttatttttgctaaaataagttcttgatttggtggccgccaaactcctatttgcattctatgtcatatgacttaaattatctataattaatctttcaatatttaaatattttctttttctttttggctaggactattgatcatataataattaacacttccaggctttggggctttgtatagcagttagggaaaaaatatatataaagatgaatcttttttcttccttcaaaattttgtgcctttctgatttactgtagcctggagcagaaggtcactgtctgatcctcaaacttctgattgttcacatcttcattttgctgctactgatagactcgccttcctggtctccgtacattttgacttaactctttgtgtcttttgtgagcatacacacataaacctggaggaatgttttaaaaagatgactaatagctgggcgcggtggctcatgcctgtaatcccagcactttgggaggctgagatgggtggatcacaaggtcaggagatcaagaccatcctggctaacacagcgaaaccccatctctactaaaaatacaaaaaattaactgggcgtggtggcgggcacctgtagtcccagctacttgggaggctgaggcaggaggatggcgtgaacccgggaggcggagcttgcagtgagccgagatcacaccactgcactccagcctgggcgacagagtgagactctgtccccaccacccaaaaaaataaaaaaataaaaaaagaagactaatagtcagaatggtaaacacatatctgggatttccaataaggatatcctgtgacaaatttaatttaagttcaaactaggaatctctaccagcacctagcaaatacattggacaatgagggttaatagacaggaatgacaagtgctatactgctgaattttatgctcagtgttcaccactttttctttaatggtaataacaatatcaatagctaacattttttgagcatttactaatgtatggacactgttacacatatcttatccatttgctaattaaatcctcttaacaatctacaaggcaggaatcattttcttcccaattttactaataaggtagctgcatcacaaagagctcaagaatttgcccaacatcacataatcaggatgtagcagatgggaaataccaacataggcagtctcatactagaacccaggctcttgcttagcacagggatccatcttcctcttttgttcatgacctaagccatagctgcaaaaggatatttctcctaaaataattgaagacacattggaaccacttgtaagttctgtaattatatttgaataacatttgtgttgctatttccttctctgataattatcctctattctctttccatctgtatggctgtaatagaaacatccatatgaccctgtcttctagaccatagtttattgaaccatgagtgggcatctgactcaagatgagccactgagatctcttctaggctatatggtgtaggtagaggtttcagttttcgcctatcttcttgaacagcaaaaatataaacttgggccgggagcagtggctcacacctgtaatctcagcactttgggaggctgaggcgggaggattacctgagctcaggagttcaagaccagcctgggcaacatggcaaaaccccgtctctacccaaaatacaaaaaattagccaggtgtggtcgtgcacacctgtagtcccaggtaatcaggaagctgagatgggaggatcacttaagcttgggaggcagaggctgaagtgagctggggtcatgccactgcattccagcctgggtgactccatctcaaaaaaaagtaaacttggaagctggtagcagtggccatttactacagtactacatggaccaggtaaaagagaaagctggtctgcagtaaaagaagaataagcaacccttccctggtttactacaggagacagattccataactgtccccaattctttattccccttcctgtatgccactcccttaacattatgactgcaggtcttcccaacaagaggtggagccagtggcccatcgcttagatctggactggacttgtgacttggcaaaagtgacagaatgctagtttcaagtcttaatcacaagaagcttttcatatttacagtttttatctttgacccatcttctccctaagaacatgcctggctggcttgctggaaggataagaagcatagctatggtgccatagccaagatcatcctaaaaagccaggagatagctgacccaccaactgactaaagagacaaagagatgccccctgagatcatccaagcctagtccagatgagcagaactgcccagccaacccatagacttgtgaaaaatagtaaattgtggtttttataagggtggcttgtaatgcagcgttagctaactgatacagttacctgcagttttcccatccattaagatactagaggcctggatatgctgcagtagcaggtttccataactcacacttatagtcttttaataaattttccatttgtcttaagttttctcagttgggtttctgttatatgcaaccgtaagaatcctaagtgatgtgagttttataagatctgagaataacaagaacagcatcttacttttacagagtcctgttaagaggtaaccagtttagtaatagtgtattaaaaagagatacaccgtgagctttgttctgactgcttcaacatgtttggggctggatctctacttttgttttgttggtagtgatattggcagtttttttttttttttgagacggagtctcaatctatcgtccaggctggagtgcagtggcacgatctcggctcactgcaagctccgcctcctgggtttccgccattctcctgcctcagcctcccaagtagctgggactacaggtgcccaccaccatgcctggctaatttttttgtatttttagtagagacagggtttcactgtgttagccagtggtctcgatggtctcgatggtctcgatctcctgaccttgtgatccacaaatgccactaatatataaatatgtctacactgcaacaacttaaaagtctacatatgcctcaagcattaaaatggaaaagttcccctttcctattcccaacctatagtaaagaccctcctcagaggaaccagagttaatagctcagacagctaataaggagcaagaactttaaacttgtacctttactgaaacttggacaattgaaacctggatggagaagataagaacctacataattgtcaaagcagtgaactggattttactgttgtttcttttgcagttattggatctgcttttagggcagattgttgcttgtttgacctgaaaatcctccataggccatttaatgatgtaagtattacactgatctctcacctggatagatgttggagatggtgagcccccaaaacttgagtgttttagcacaaagaggttcacacaggaggctggctgtatgggtaagctaactgttcttattgtatgacaagtattagtctcttcgagataaatgttttattttatatatttagcttaagatctcattgtcttaaaaatgtcacttgttcttacaaataaacattcgtgtttgtttgcaggattgctgatagggaactgagctctaagaagctaaaggagagtcatggcacatggcaatgctgtttcgaggcctgcaagatatttgccagccttctaagccccatgagaaccttcacacaggtaggggacaccatcaacaatggtgatgatgaggttccttcaggaaccgcaatagtaaacatggacccagaggagccagggcagggaggaaagaaggtgatagatacctgttggagatcaggatagatagactacacaacaattggaaataatctgggtgtcaaatattcatacaagcctagtttttaattatagactgttaaagcttgcaatataccagctacagtttatgtaagtatacaccaaaagaaatatttggaaggatatacaccagaacttatacataggatctctgaataatagcatcaagagatcttataattcttgtacttttggctttatgtattttctaatttcttgtagtgtacacgtactagttgtataatttttaacaattaaaaattatcccaaaggggagaaataaaagaatgtatatcacatttcccttaagataaacatctgctttgatttatgcttatgattgtttttaaaggtcatgtgaaagcatcttttgattttttagaatatctttagttaaaatataattttctttccttggtgacctgattatttggagcagcagtatttgggtgtgtactgataatttggtaacatgtcttttatagtcattactggggcttggtttatatgttcttagggatacaatgatagcggtgtgattagagaacttatctaaaagtaaataggtctgcaggccactgaagttacttgtttgatcctgtttgctacatattcaatatccttctaggtttctggagttctgtggagccataacaggaggaataaagaaggcatctgtgtcttcctgcgtgccctaatagaagaacatatatccatggaatcttaaggttggactttcttatttaagtgcatagggtggccagatatcttgattcataagaacagtccccaattttagatactgtcaggccatttgtcttgaaaaataaagtttaaaaagagaggctttagactttaaatgtgtgaattgtataatacatgaattatctctcaataaacctgtttttttttttaaaaaggggatactggtcaggttccaagatggcagaataggaacagctccagtctgcagctcccagcaagattggcacagaagatgggtgatttctgcatttccaactgaggtacctggttcgtctcattgggactgcttggacagtgggtgcagcccatggagggcaagatgaagcagggcagggtgttgcctcacccgggaagcacaaggggttgggggatttctctttcctggctaagggaggccatgacagactgtacctggagaaacggtacactcctgaccaaatactgctcttttcccatggtctcagcaaccggtagaccaggagataccctcccatgcctggcttggcacatcccatgcccatagagtcttgctcactgctagcacagcagtctgagatcaacctgttatgctgcagcttgacagcgggaggggcgtctgccattgcagaggcttgagtagctcacagggtaaacaaagtggccaggaagctcgaacttggcggagcccaccgcagctcagcaaggactactgtttctctagattccacctctgagggcagaccagagcagaacaaaaggcagcagacagcttctgcagatttaaacgtccctgtcagacagctctgaagacagcagtggttctcccagcatggcgttcgagctctgagaacagacagactgcctcctcaagtgggtccctgacccaatgtatcctgcctagaagacacctcccagtaagggacgacagacacctcaaacaggcgggtgcccctctgggatgaagcttccagaggaaggatcaggcagcaatatttgctgttctgcagcctccactggtgataccaggcaaacagggtctggagtggacctccagcaaactccaacagacctgcagctgaggggcctgactcttagaaggaaaactaacaaagagaaaggaatagcatcaatgtcaacaaaaaggatgtccacaccaaaaccccatctgtaggtcaccaacatcaaagaccaaaggtagataaaaccacaaagatggggagaaaccagagcagaaaagtggaaaatcccaaaaaccagagtgcctcttctcctccaaaggattgcagctcctcaccagcaagggaacaaaaccgatggagaacgagtttgacgagttgacaaaagtaggcttcagaaggttggtaataacagatttctccaagctaaaggagcatgttctaacccatcatgaagaagctaaaaaccttgaaaaatggttagatgaatggctaactagaataaacagtgtagagaagaccttaaatgacccgatggagatgcaaaccacagcacgagaacttcgtgatgaatgcacaagcttcaatagccgattcgatcaagtggaagaaagggtatcagtgattgaagatcatattaatgaaataaagcaagagacaagattagagaaaaaagaatgaatagaaatgaacaaagcctccaagaaatatgggactatgtgaaaagaccacatatacatttgattggtgtaccggaaagtgacagggagaatggaaccaagttagaaaacactcttcaggatattatccaggagaacttccctaacctagcaaggcaggccaacattcaaattcaggaaacacagagaacaccacacagatactcctcgagaagagcaactccaagacacataattgtcagattcactgaggttgaaatgaagaaaaaattttaagggcatccagagagaaaggtcaggttacccacaaagggaagtccatcagactaatagtggatctctcggcagaaaccctacaagccagaagagagtgggggccaatattcaacattcttaaagaaaagaattctcaacccagaatctcatatccagccaaattaagcttcataagtgaaggagaaataaaaccctttacagacaagcaaatgctgagagattttgtcaccatcaggcctgccttacaagagctcctgaaggaagcactaaacaaggaaaggaacaaccagtaccagccactgcaaaaacatgccagattgtaaagaccatcgatgttatgaagaaactgcatcaattaatgggcaaaataaccagctaacatcataatgacaggatcaaattcacacataacaatattaaccttaaaagtaaatgggctaaatgccccaattaaaagacacagactggcaaattggataaagactcaagacccagcagtgtgctgtattcacgagacccatctcatgtgcaaagacgcatgtaagctaaaaataaagggatagaggaagatctaccaagcaaatggaaagcaaaaaaaaagcaggggttgcattcctagtctctgataaaacagactttaaaccaacaaagatcaaaagagacaaagaaggctactacaaactagtaaagggatcaattcagcaagaagagctaactatcctaaatatatatgcacccaatacaggagcacccagattcataaagcaagcccttagagacctacaaagagagttagactcccataaaataataattggagactttaacaccccactgtcaatattagacagatcaaacagacagaaggttaacaagtatatccaggacttgaactcatctctggaccaagcagacctaatagacatctacagaaccctacaccccaaatcaacagaatatacattcttctcagcaccacatcacacttattctaaaattgaccacatagttggaagtaaaacactcctcagcaaatgtaaacgaacagaaatcacaacagactgtatctcagacaacagtgcaatcaaatcagaactcaggattaataagctcactcaaaaccacacaactacatggaaactgaacaacctgctcctgaatgactactgggtaaataatgaaatgaaggcagaaataaagatgttctttgaagtcaataagaacaaagccacaacgtaccagaatctctgcgacacatttaaagcagtgtgtagagggaaatttatagcactaaatgtccacaaaagaaagcagggaagatctaaaattgacacgctaacatcacaattaaaagaactagagaagcaagagcaaacaaattcaaaagctagcagaaggcaagaaacaactaagatcagagcagaactgaaggacatagagacacaaaaaacccttcaaaaaatcaatgagtccaggagctggttttttgaaaagatcaacaaaataggccactagcaagactaataaagaagaaaagagaagaatcaaatagacacaataaaaaatgataaaggggatatccccactgaccccacagaaacacaaactaccatcagagaatactataaacatctctatgcagataagctagaaaatctagaagaaatggataaattcctggacacatacatcctcccaagactaaagcaggaagaagtagaatctctgaatagatcaataacaggctttgaaattgaggcaataattaataacctaccaaccaaaaaaatccaggaccagacggagtcacagccgaattctaccagagatacaaagaagagctggtaccattctttctgaaactattccaaacaacagaaaaagagggaatcctccctaactcattttatgaggtcagcaccatcctgataccaaagcctggtagagacacaacaaaaaaataattttaggccaatatccctgatgaacattgatgtgaaaatcctcaataaaatactggcaaaccaaatccagcagcacatcaaaaagcttacccaccatgatcaagtcagcttcatccctgggatgcaaggctggttcaacatacacaaatcaataacataatcagtcacataacaaggaccaatgacaaaaaccacatgattatctgatgcagaaacggtctttgacaaaattcaacaccgcttcatgctaaaaactctcaataaattaggtattgatggaatgtatctcaaaatattaagagctatttatgacaaacccacagccaatatcatactgaatgagcaaaaactggaagcattccctttgaaaactggcacaagacaagaatgccctctctcaccactcctattcaacatagtgttggaagttctggctagggaaatcaggcaagagaaagaaataaagggtattcaattaggaaaagaggaagtcaaattgtctctgtttgcagatgacatgattgtatatttagaaaaccccatcgtctcagcccaaaatctccttaagctgataggcaacttcagcaaagtctcaggatacaaaatcaatgtgcaaaaatcacaagcattcctatacaccaattatagacagagagccaaatcatgagtgaactcccattcacaattactacaaagagaataaaatacctaggaatccaacttacaagggatgtgaaggacatcttcaaggagaactacaaaccactgctcaatgaaataaaagaggaaacaaacaaacggaagaacattccatgctcatggataggaagaatcaatatcgtgaaaatggccatactgcccaaggtattttatagattcaatgctctccccatcaagctaccattgactttcttcacagagttggaaaaaactgctttaaagttcatatggaaccaaaaagagcccacagagccaagacaatcctaagcaaaaagaacaaagctggaggcatcacgctacctgacttcaaactatactacaagactacagtaaccaaaacagcatggtactggtcccaaaacagatatatagccaaatggaacagaacagaggcctcagaaataacaccacacatctacaactaatctttgacaaacctgacaaaaacaagcaattgggaaaagattatttaataaatggtgctgggaaaagtggctatccatatgtagaaagctaaaactggatcccttccttacactgcatataaaaattaactcaagatggattaaagacttgaatgtaagacctaacaccataaaaaccctagaagaaaacctaggcaataccattcaggacataggcatgggcaaagacttcatgactaaaacaccaaaagcaatgtcaagaaaagccaaaatagaaaaatggaatctaattaaactaaacagcttctacacagcaaaagaaactatcatcagagtgaacaggcaacctacagaatgggagaaaatttttgcaatctacccaactgacaaagcgctaatatccagaatctataatgaactcaaacaaatttacaagaaaaaaacaaacaaccccatcaaaaagtgggcaaaggatatgaacagacacttctcaaaagaagacatttatgcagccaacaaacatatgaaaaaatgctcatcatcactggtcatcagagaaatgcaaatgaaaaccacaatgagataacatcccatgccagttagaatggcgatcattaaaaagtcaggaaacaacagatgctggagaggatgtggagaaataggaacgcttttacactgtcggtgacagtgtaaattagtgcaaacattgtggaagacagtgtggagattcctcaaggatctagaaccagaaataccatttgtcgcagtgatcccattactgggtatatacccaaggattataaatcatgctactataaagacacatgcacacatatgttgactgcagtactattcacaatagcaaagacgtggaaccaacccaaatgtccatcaatggtagactggattaagaaaatgtggcacatatacaccatggaatactatgcagccataaaaacagataagttcatgtcctttgcagggacctggatgaagctggaaaccatcattctaagcaacctatcacaaggacagaaaaccaaacaccacatgttctcactcatggactcagggaggggaacatcacacatgggaacctgtcgggggttagggggcttggggagggatagcattaggagaattacctaacgtaaatgacaagttgatgggtgcagcaaagcaacatggcacatgtatacctatgtaacaaacctgcacgttgtgcacatgtgccctagaacttaaagtataataaaaagataataaaaataaataaataagtaaaataaaataaaaagaaggggatacaacagaggggtgacatattagtacaataaagaaagcacattgccctgagctcaataattaattgttgaatgaatgagtgaacaatagcttgaatacagataaatattaaattgacctgtttttgtttaaagtagtctctgtgctcaaactgtaaaattagagttgatttgtaagattactgtgagtatcaagaagaaaaataataagagttctaaagatgtaaatacatctcaagttatgagaacaatttttaatatctgatgatggtatatgtgggatcctacccctaagatgacctccaatgattcccacctcttagtattcacatcctatgtaatccctcccacattatattagggttgatctgtgcaactaacagaaaatggccgaagtgatggtttgtcactcccaagactaggccataaaagacagtgtatcttctgctccatcccctcttctctctcagataatctgttctgggggaagcccagctcctgtgccatgagcaaccccatagagatgcccatgttgtaaataaatgagccttccttttaacagccaaatgagtgagttttgaagccttcagatgactgcagccacagctgacagcttaactgcaattttatgaaagactctgagccagaaccacccagctaactccctcctggattcctgaccatgagaaactgtgtgtgataaatgtcgattgtcatataagctgctaaatttgggggcaatttgttatgcagccttagataactattacattagagaataggagaactgacaaaatgtagagattccagtcttatgtaacaatgtaggcatttctagaaaacagaaaaccaatgaaattctataacacctgatttgccttgggccttctatcctattaattcctttccctccacaagtttttaatgtgcttgactggaagattttactctcctgtggaaacatttctagttgtaaaatgagcatccatagaaaattcagatttactttaagttggttatgatttattctctgtaaaaattaatgtcctttcttaaacactagaattacttttcctataataaccataaaatttattatgtgagaaagatgatgttacacagaagtaagtttagttgagaacaatcaacaaattttaagacctttttctatcatataattttctattatggttttgggggagggatagcattaggagatatacctaatgtaaatgacgagttaatgggtgcagcacaccaatgtggcacatgtatacatatgtaacaaacctgcatgttgtgcacatgtaccctagaacttaaagtataataaaatacatctatataaaaaaaagaaaatagataattttccagttgaatcaaactagagtgcttttgacagatgatatctcttttgtagatccatagttcaaaaacacaggaaggagttacagcccactgtcagataaagcaaatttaatcttagaaaaaactatcctcactaatgaatgaaccaaaaagaatttccttttactagtttaactgtaccaatttattgcaacaaatatctccaaaagaatgagtgtaagtgatgagaatgtgatagtatttataggttgtttgtccatcctctcctttacttctgaacagcctctcctgatcacttgcatggccataggttaaaacgtggcagccatgttcatcaaacatcagcccttggacccagatgattgtgccaaggtgaacatctgataattctgaaaatttggaatagtgagtggggaagggagctaagaaagaattgggattgattttgtttttctcaggataactggacctatgacatataaacttgggagcagtcttggccatgttttcatcaatgtagtaagaagcagaggaaaactgttggttaagaggaagggaatgaatcagaaatgcagagaggagcatacatagaagtcaagagaatgtttccagctccatctttgtcctttgattcctcaagatattcctgtgtttttctaatatatttgttaagctcaagggggtttctgttgcttgaaaataagagttttatctaataaagaaataacatagtgctatatcctaaagggttagttaagaaattgggaaagatttgactatacagctattcatcacagcactggaaacactctaaacattcaacagtagaggactagtacatccattatgtgcccaatatcaatcatattataggagaatattagggtaggattacacgtatataatagatgttatgaaaaaagcaagtttgggaaggttatttgctaaccttcccaaatgataccatttatgttttaaattatttatatataggcataccaaaaaattatagtatcatgtaaacaaaaatgtcaacattctctctgatagaattgcaaaacgttttattccctccttttaaaaacgatctcatggctatcataatatctggtttcaattgatattaagcaatggatgagttctctgttgtttttaaacttttatatcttttagttttgcttactcaacttgcagattgacaaatatttcatatattattttaattttctttttggtgtgaatctttatttgtcctaattttttcttgttcctcatcttggtgcctacgtagtctttgttcttaatgcacaagaaatccaagttccttattgataaaaaagttaaaaagcaacagagaactcatccattgcttaatatcaattgaaaccagatatgatagtcatgagaatgtaaaacaagaaaaaaaccttctgtaaattatagtttgattgtcacagttatattatgtggataaacaaaaggtttataacaaggcattaaataaacaatacttagtttataaggctcactcattctctgggcagctagtcactgtctcaaatttcactcatatagtaattgtttaatccaaagtgaaagtccaacagataataaacacaccctggaaggataatggatgctaaaatctaagcacactatgataaaatgtcatctatatttaaagtagatggttaaaaatgaccagaaagaaaatattcaatggaaaaagtggaaaatgaccagattgcatattgaaaacatttttgcagaaacagattgtctaaaccagaagtccccaacctttttggcaccaggaaccggtttcattgaaaacaatttttccatgacaggaggggcaggggatggtttcaggatgaaactgttccacctcagatcattaggcattagattctcataaggagcgtacaacctagatccctcatatgcaaagttcacaatagggttcacactcttacgagaatctaatgccactgctgatctgacaggagccaagctcaggcagtactgcttactcgcccccactcacctcctgctgtgtggcccagttcctaacaggccatggaccagcagggggttggggactcccagttcagatcaagggtttgcagcctgggggttggggatctaaaccatgatttattcaaatataaaaaaatcaaattcaaactctctctctaaatacctgcttggcatctcaccccctaacctgttttataccaaaaaacttcaatcacaagatggggttggcagtatttcagaaatgcttttcaacagtacaacaacctttttttagaaactaggattagcttaacacaaatatgggtatgtaaaagtaggcactgagttatgcaatatttattcaagtggaattcttccaatattttctggaagagagttacttttcaataatgctgttctgtggaccaacatcttagagaagagtgttcatcttttttaaaaataagtgttcttatgtataaaaaatgcataagtgtgtaaaagtaagatacatattagattttctatgtaatcgatgattaatttcagcaaattttatttgaaaattttaaaattaggatttttttctatgaaagttctctccattcgtttttatttccattttttaaatcctgacaaaaatgaccatactcggatctacatgcttctaacttttctcctttagttcattattaacaagcttgttacttgtcaagagtgaactatctccctctgcattcgtctgctcagtaaaccatctccattactgtctccatctcttcacttgtctattctttatttccatcttgagcctattcattctggtctctaacctgatggtggaatggaactgtatgttcttcccactcatccaccattacacatagctctaaacttgtctgttttcctgagtgctcagtagctgtcctttctttttcctctggacttctgaaatctgaccattgtctgaaattcagtctatagcccattggtcatctcttcataaagtcttctttctcaagaactcattcatggcctgccatggtggttcacacccgtaatcccagcatctcgggaggctgagatgggaagatcacttgagccaaggcattcaagaccaggctaggtaacatagggagactctatctctacaatgttttttaaaaaaaaattagccaagagtggtggcacgtatctgtggtcctagctactcaggaggctgaggtgggaggatcgtttgagccctagaggtcaaggctgctgtgagctgtgatcgtgccactgaactcacttctcaaagaaaaaaaaaagaactcatttatcctcaaggtttcaactgtcacttgattcctgcatcttagctccaattgcctactgggcatcccactaaagttatggcctcatctaggatagaactcattattggaccatctgagcagattattgtcagtcttcattgtttcattactaagtcctatcattcttatattgattcttttcttttctttttttttttttttggagacagagtctcgctctgttgcccaggctggagtgcagtggcacaatcttggctcactgcaagctccgcctcccagtttcacgccattctcctgcctcagcctcccaagtagctgggactacaggcgtcagccaccacgcccggctaatttatgtattttttcgtagagacggggtttcgccgtgttagtcaggatggtctcggtctcctgacctcatgatctgcctggtttggcctcccaaagtgctgggattacaggcgtgagccaccgtgcccggcctcttatattgattctatctctcaaatctatcttttcacttctctttgcaattactgttcttaggctatggcttcattatcacattgatttctccctcccctggtctgacattagtctttcaaaataaggctaagacataggcttgcatattggtagtttatttgggcaataatcccaagaagcataactgacataagagagtaggacagagaaggagggagaatgagttcaaaaatgccttattgaattggccaccactatgggtaactgatgctaggtctcaccaggatcttataatgagtcttacgaaattcatctcagaaaatccacctgagaggtgaaaagaaaaaatatttatttatgagttcttggcctccattgattaaagatgaccctactggcaatacctcccctgcacttcctgattgcacatgtgtgtgtctgagcgttcttctggcctccaccacggcattagagaagttctgcacaggcaagagacaagcaaataaaaaacaaagacatgggaagttgtaggtaaatgtttggggcttaggtgactgttgtccagttgtatcaacaagatgctggtccaaacctattatagcagcttctagagcaagacatggcagaaagaggacttgactggttcataaaaggcatttaatacaccttttatttagtttgttgtgtgggtctcttgtttcttcagcaggactctaaatgtctcagtgacatatatccattcagtagaattaagacacttgctaaacgaatcattcaatcattcacattcaattttctcatgatgttaaaatcttaaatatttccagttctattttctcaataaattgcctaatttagtaaaattcatgtcatatagttaactctctggaattttaccaacaactaccaccagccctctctggatctgctcccagtattgatgtcaaagcattcccacccactattattaaagcttatattttgaactcttttctcctgattatattgtgtttcatgtttctattacatcgttttcctcaagaccatggaacctctgtgtaggaagtttgaccagtttagcaacacagtcactggctaaaaaaaaataaagaaggtgaatggactatctaagtttggaacactgggctcattagccctcatagtccagccatctaagctagactatattttgaaatcttccatctgtagattaagatcaaattgttccagtaactttaaggttgcttttcattacatttacttatctttacaccctacagcttagatagacattttttttttgcattctcttctctaatctattccatcaagatagttcagaaaaactgtagcaattcatattagttcaggttagatgatgacactcaggctgtatttatgtcctacatgcaaatagtgtttattttgagaatgttctaaaaatgagaaggggaaaataaattcaccttctttatcctttgggtacaatataacatccacagaacttatcaagctctttacttatcatcaggggttttcaaatgttgaagataaagttttcagaatacctcccttaaaggaaatttggggagtcatttagacctaaaataaatgcgcttattgtttttaaagacactaggaaaaaagttagagaatttgaaaaatatactcattcatttaacaaatattcactaagcattctattctgaaaaagaatataagtccttgtttatcactttaaaaaatctttattttcccacttatagaacattaaatacattttctgcaaaacaaacaaactaaaaacttggaaaatataaaagcacctttaatcacaccactcaaaggaatactgttaacctccaatggatgtctccattgcttcttcagtagaatccccccaaaaatgtttttatgggttgaaagcattaaaaagagtctctatttgggtagactcatttctaggtagtgagattgtatcttactcttcatggtatcaaccccaagagctgacacatactatgtgctaataaaaatgtttaggggatagttcatcagtcttattagaaatcagacaaaatcaaaatatattaccaaatgaactcaattccccatagtacctgctgtgaagcaggacatttagaatgcttagtctcattaactaattctaattacaagtagatgtgcacctatcttgaatagagtttctctatgtttatcacaagatgataaactttggtgttttattaggaatgatatttggtggcacaggcaagaaaagtccatccttatctggttattgaaaatcaggaatatgctatcatttggagtacaaatggtagcaacagtctaaaattctctgcaccactttgtttcacaccaaccagaggaataaggcaaagactgattgacaaatgtcagtaactcatttttcacatatgacaaaaagtgactaaactgataaaattatcatttcaatgttcttgccagaaggctcaagtaattagcaaaactaaccagcaaaaaaagagagcaaagcccattatttttcttatgtttagaaattacataagtactttccttcaaaaataaaggttttccagccggtatctgtctgctggatataaacaattagcctgttttaatatggaattttcccttttatttttagtattagaagggagattctaataaatctatgaggaggagcatcaccccttatttgtaacctcaggacataaaacaaatatttccgacccccttcaaagtgtggagatgggtcccatatttgtaaaactaagttctttttacctttaaggaaatgaaatcagcttttagtctgccagtgtttttgctacagttttaatatgcagtcaaactttattatgaaagcctacagcagatatttggagctaagagacaaaaaaagtaacatgtctagcatgggagacctggggaaaatggacggtggtgccatttactgaaatgggaaaggcagaaaagcaggtttggggaagctggagaggagttctgtgtggctccttggcgtctgtggtaacagaattcaatcttggttgagtctgtggcactggtttgtttaactgagcttctgccttggtcctgtttttcattctattccgataccccaagagaaatgaatcttgcctcacctttgccaggcctccttactgggctcttgcctcacctctccccttgaatagcaggccagtagagacaggccatccaggtgtcacttctgatcaggctttcaaggttagctacctgccttacctagagttcatgagacccttttatgtcaaactctctttgctaagatatggatcatcagtcattcagaagtcaggccccttcctgacttgtctgtcttgtggacaattggctttatcccagtgagttctgagagagacagttgttcaattaagagaacagatttttcagactattaatctgttagctggagaaaataaggtgctatgggacaaatggttagttgtgtataatacgtgaacctaggaataatcatcaggctcttgaagacctcatcaagccaggaaatatatgctagttagcttcagtggtcttcaagaagaggctctgcagctttaagtaatgtatctcaaagcttgcaaaggcatttttttccaaaataagccttaaaattataagtatggagttagagtcaccatgtatatttgaattgtacagtgaaccactgggataattcaggctgagtccataacctcttaattatctttgatagtttagaaaaatttgtgcttcctatcctgaattaccagttaattacagctgtaaaccttacctactgtcttttattgtaaatgatgttctaatttgagttggcactcttttaaatgacattttagggttcaacgtctttcctaggagatagagaaaacttaagaaaaaggtcttctagaaccccaagtcttgaaatagctgccagtaaaccaggaacaaattccatatcaaaaagagcctaaagttcatctctattctgatacacatagtcacaattctaattttctagtatgaaaaacttaatcaaatgaggaaatatcctggttttaaaatgaattgatggtttgtttaattaaaaatattaaaattttttataataatcatatttcccaaggctgccaaactagttccttcttccatattgtgccaagctatttggccagctacatggacagtgaccttattttattcaagtatactacagaatcagtgagtggttttcagctctaaatttactccctctggtgatcctgctaattataaacttactagccttcagggaatggtattaaatattttcctcttttggcaacttagtctctgaattctaaatcgaatgatgctttcatgtcaaatgacccattcgagtgttttttaaatgtattttcataagatgcagcatatatttttagcaactagtaaataattatattaatatacttataccaattgtttaaatcataatgaaacacttactgacaaataaaatagcaattactgatataaaatggggaaataattttactctcctgcatttgtacagagaacatttgagtaacagttttcccaagcaaagtaaaccaaatatttatctggtggatttaggcagcagaacacaacacagagagtttacatgtttcaagaagttacatacctcctgcaagcgatataacctaatatccaaattatcttagtcaatttgagcttctataacaaagtactataaactgggtgacataaacaatagaaatttatttctcacagttctggagactgaagtctgagttcacggtgctagaacggtgagggactggtgagggtcctcttctggttgcagactgccagcttcccattgcaccctcatatggtggaaagacagctagctagctctctggtctcttcttttaagagcactaatcccattcatgagggctccactgtccaaaggcccttccatcaactactatcacattgggattatagtttcaacatacgaaatttgggaagcacacaagcattcactccattgcacaaatcttctgacccatcctaaacttattaggatttttctcattccagttacagaaatctcatttgaaagtccataacattattaagtagcaaaaaatgatgatatccatccataagattcattttccccactggcccttagtggtcctttaaatactaaacatttataaacaattgatgacatgagaggattccacaagcaaagatttcactcttttgtttcacctctgataggcaaaaagccaaatgaggtgaagtggatataggtttaaaaagagacttgagtgacatcccagggtactgaaagggaatgaagagaaacttaggaaaggtagaaacagatctcagcagatgttaattttcttgagttgctcaaattatttaggacaactgcaatgaattctaagtcaacagtcaggaagaaattgatttggaaaagttagatggggagtttaattgaatatgagaaaaagcaatgaatcagcacttgggtaactgcataggaaatgctgacccaggaattaagcagactggctgatctgtaaaatggatcaatgttagaaataaaaatcaccataatttcccatctgctactggcatcaaggcagaaagactagttttcaaataataataaaagcaaatatttatggagtgctaacttaacagttttgccatattaccttagttattctcacaacaacctgtgggaactcactgagacccccagagttgatataaagattattctaaagacatttgaaattcaacagatgcagaaaaaagccttctcagaacttaccttatctcactaaatgcagaaactactgggagtgaggctgccataaatctcttctggagaattttactggccataaagaagacagagaagaccgcttgcacctgcataaacaaacattatcacaaaccttcttctttttcatttcttcccctaaatactcatttgttcttccctacatagagggctttactccccccttcttctcccccattaagtaacctctcccctattaggtatataaacccccatctttagttgtttagagtcacatttttctgtgtgctcctgcgtgaataaaaatctatgttttgtctaagtttaattcccaggccctcaagaactgaacctaagagggtagaggaaaagattttcctctccaacaaacattacttacaaaggtaagtaatttcatcttcattaaaaacatgagaaaacttagactcaaagaagttataaaatttgcccaagttcattaaaccagaggaatgaggattcaaatcaggttaggctaggcacggtggctcacacctataatcccagcagtttgggaggccaaggcagacagatcacatgaggccagcctggccaacatggtgaaaccctgtccctactaaaactacaaaaattagctgggtgtggtggcacatgcctgtaatcccagctactctggaggctgaggcacaagaatcgcttgaacccagaaggcggaggttgcagtgagccaagatcacaccactgcactccagtctgggagacagagcaataccctgtctcaaaacaaaacaaaacaacaacaacaaaaaacacatgcaagctatattatcccagagtctacactagtatcacttcattaaattgttcttacatggtctagaggctttagcagcccatgcaaatgggcagatcttaaaagtgattcttcttagtccttaccatcaggtgtcctaattctgaatgttttggtatttaccaggagggacattatttgggtgactgcaaagtttacctaaattatttggtaaaagcaaagataaatgaagcatttgactttattttacttccttcacaagccagtttctaaggttggtatgtttaattcattggaaaaaatttcttacatacaactgaaaactgactcaaggtaaaagaatccagcatgaataagacttgtaatttctcacagtcagtaatgaggaaattgaacaggcaataaacaggacatttaccaaccagaaaccaatgccgttgaactcccaaacatgttccaactttgcacagctgaagaaacagccactgaattgtcattactagcagccatgaaggaagaagacagccagccaagatcatggtgaatcgactgcagttcaaaggatacgtagtaaaggagtaagctggggatgcaggtgaaagggaagtaggatgggggtgtaaaggtaaaaagaacgtctctgtgatagacatagacaggaaagcaagcactgaagtaggcagcaccacagagctgtgttaaagacaccaagacagatattactacctccctccagttaaaataatcaagatgaattaacatgcatagatttcctggatatttttgagaaaaaaaacaagatataaatcaatacgtgtaacatttttgcttttaaaagtccacaaaatggtatatatttcccagggatatacacatataaatgtccatctatatttccacaataaaaagactggaaccataccatggaaataaacagagaccacccaaaatgagaacaatcagaggctatttattcattgcttactaaaacaagggagtcaaacaccatcgcttgtgtttggcagatactcacaggcagccaaagcagaaatgaaaagctttatagtgaaaagagggaagattcacaaatgctacaattggaaacttggtttgggaagctagaggtgggtaattacaagtgagccatcttatgtgattggtttggggagtacatttggctttgtctggttggtcctgagttaaaagctgacagtcattgaccaagcactgacacttcagaaccaattgtatcagagcttgtggtttggcttcccaggctggttgctgcagaggttgtgtgtccgagttctattgacatatatggtctggtccttgtccgtttgtatatttagtctatcagtatgcaccaaactaacattagtggttactactggcaagatgggaagggatagggtcagcaagtaatttcatattttgtaattctaaatttgtttgtaaggagaatatatttactcatttttttacttgtataattttgtaaaattctgaagcaaaatggcagaagattgatagctgtcattcctaatcctcacaacactgcaagatgggttgtattcttattttacagtggaggaaagtgaggcactaacaggttaacctgctcaagaccacacagttgataaatagcaaatggaatttaattccaggcatatctgatcctaaaagttacttttcactatgccatgatcctgcttacaaatgtatagttatactaacattaaaagagagaatgggctgggcatggtggctcacgcctgtaatcccagctctttggggggctgagacaggaggatcacttgagcttgagaccagcctgggcaacaaagtgagatcctgtctctacaaaaaatttttaaaaattagctgggtgtagtggtgcatgcctgtgatcccaggtacttgggagactgaggcagggggatcacttgagcctgcagtaagccatgttcacctcactgtactccagcctgggtgacagagcaagacccggtctaaaaaaaaaagatcaggcgcagtggctcacgcctgtaatcccagcactttgggaggccaaggcaggcggatcatgaggtcaggagatccagaccatcctggctaacacagtgaaaccccgtctctactaaaaaatacaaaaaattagccaggggtggtggcgggtacctatagtccccgctacttgggaggccgagacaggagaatggcatgaacccgggaggcagagcttgcagtgagctgagatcgtgccactgcactccagcctgggcaacagagcaagaccccgtctcaaaaaaaaaaaaaaaaagagaatggccatttttactccttacaaagggtgagcataacatattggattaacccaatattgcatctattagtacaatattagcatctatttactaaagtggtgttagaactcagaaatggctgttgccattgcaagttgagttatctgaagttacagaacttgacacgacatcacatgacagtcctgcctgaagtctgattctttgtacttccagaagggtagctttggcttttgagaaagagatagcatttaaaatgtagttataactaatgagaaagtaggtatctttcagaaaattccttgtagagcaccatctatcacctatattgttgataatggtgttggccaatttctaatctaggaaatgctaatgaatcaatttcctataagtttaaagcagttgtgtgaaccagctgattgtttttcacgtggtaatgtagctaacttaactttgattaccttggtgatcaagaacttgtaaaggtacctctaaattaagaagggctaaccaattgttgcaggattaaactcttctctttaaaatctttaattggaaccacaggttgtaatgatctgtaatttaaaaaacaacagtttttatgttgggtaactacaaaactcacatggaaaaacagattaatatctataaacatttttgctatttactgccctaaatattacctcgagatttacatagtaactcagggcttctcaacactgaaacagcacattaaaatcacctggagagcttaaacaataatatcaaggccctcctcccttcctccaagattctgatttaattggtctagggaaggtctctgcatcagtatttttaaaaagatcactaattgattctataaggcagcctaagctgaaaagcactgctatagatgaagatgataaaatgaaaaggacttcatgatgcggttcagtttgtttaccagcatccatccctttggagaatcattatttcctatgctgtgaggtcctggtaaggctgaccctgactcttctcatccatagcgagtcctcatagtgtgcacatgacccagttcagagtaatgctttgtatatgttgatgctatataattagatacacatacattttataccctcatggtggcttagtatttttgtcattatgaagcatacattttatttttacaaatgcttttaccttatagtttgctgatatggtttgaatgtccctgccaaaactcatgttgaaatttaattgccattgtgaaactgcctttgcaaaaattataactgagagaattatgacagtgaaagagatctgagctaaccaacgccatcttgcctttaacctcaaactgtccttgatcattcctgggtgtaggccaagctaactttgggataaatttaatttatagtttaaatgaaaataacacttccccaaaactaaaccacctttataaaactaatgaaaggccaccagattaggaagatgagaggggcctgaatcctgctaaaatacaggtataaatgattaccagccattattccagaagtcaagaaatttattaacttcttccattactcctgtattgattttttgagatgtcttttcaggcttttgcacttctgactaccagatagccccatctggacctgcaattcgggattcaaccagtcatatggcccccacacagaagcagacacagtgcaggagggctgctttccacacccctatgattgcatctccaaccaatcagcatttcctaatccctaaacccctgcctgtcaaactatcctcaaatagcctccgaattttcagggaggctgatttaagtaataataaaattcctgcctcctgtttagcttgatctaacatgtattaaactctctattacaattcccatgtcttgataataggctctatctggacagcgggcaaaatgaacccactgggtagttacaattgtaatagtgttatgaagtggggtctttaagaggcgattaggtcaagagggcagagcccttatgaatagatcaaagccattatgatgggagtgggttagttatcactggagtgggttcctaataaaaggatgagtttggccagatttcctctctgtctggagtatcacaatttaaacatcatgcttgtaaacagtacagcattgactttgtcacttaatgaagtattttcttcttttacatttaatgtagttattgatatgtttgtatttaaatctaccattttatgaagtgctttctgtttatattgtcttcctttcttgttttctttttggatgcaattttaattgcattttgccctctgaattatcttgaggttatataaaaatcacttaggaagatactactgtttctttttattatctaattaattttgcagtcatattttattttcaagcagacatgcaacaatacgtgtttcattttattatagtcatgagaaaagcatgtttgaaaagcaagccattataattttgagagaagttctggggaacttcctgggggaggtgaatagtcatttgatcctgtgatctacattagaggctggcaacctatatcccatgcacaaaatataacccaaagactggtttcagatggcctgtaagctaagaaagggctttacatttttaaagggttgaaaaaaaattaaagaaacatatgtgacagagaccatgtattatcgatctggccctgtacagaaaaagtttgctgatgactctcctatatcatcttgccaagacctgtaaaggtctgagagttttcccctccttgcagaccaataaattagcttgctacaatttcatggatgctagtgggagacaggataacccagtgtaagaaacaaaggactttgttatttacagcaatagcagtcatcagaacatcagcattagtaccaattccttatgccctaatttccaccaggtaataagaagagagccaggtgacaccagcatgcacagtagctgtgttacaggagaggataatgagcttagggcacccaaatcttttataatggacagtaagcacacctgctctttgctctgcagggagacattatctcaatcttccaaggctgtttgctattacaaattacaaatatttaagaaaagatagtttggaacaaagtcaatgcctctaattacaagatatagagaaacacaagagaatcatggagcactgtgatccaataatctaaatttgtatctatagcggccttcagattttataatagttatatcatttcaaaagttcatctgagccaagtgctaaaatattttcagtattatcttaaagggtggaggaaataatagttacatcacctcatagggatttctaaaggcaatttaaaatcttaacgtttaaaaaattattactcagctatttaaaaaattctgatatgcagaaggactgatttatggtatgggccaggtaagtgataacttactctacagtcatcttctaactaatttggtaacttgacattttctttggtggatgcataaactatatcatgttctataaaattttattactacagtccaaaatgttttaaaattatcccagaatttggctaggcacagtgtacagttagctgtaatcccaacatttctggaggccgaggcaggtggatcacctgaggtcaggggttcgagatcagcttggccaacatggtgaaaccccatctctgttaaaaatacaaaaattagcctggtgtggtggcacacgcctgtagttccaactactcaggaggctgaggatagagaatcgcttgaacctgggaggtggaggttgcagcgagaaaagagcgccactgcactgcagcctggacaacagagtgagactctatctcaaataacagtaataataaataaataaataaataatcaatcccagaatttaatagtacacattttacagaagaaacttaaacactttaaggacattttaaaatgtattgatttaacaagtattatagttgatatttaacatctagaagtagagctcactaagtagttttctcgcagcattataaatggaacagtgtttctaaaaattatgacttttttaaaaagaattcttttacaagataaatgtttacaaggatgtaaactatgtaacatttagttaaatatttaacaagctgcttctattagaaacagtaaggtgtaaaattgggaatctttgagaaaatctagatcatctttaaatgtctgatatgggacagttagcagaattctctaatatgaaacctttttaaccctagaaactcaaagtatgaaatccagtcagaactgatctgatgttgctttaatataggcctgagctggagagctctggagaaagcaagattactttggggacaatatggaatccctttagggacaatatggaatctcttgtgtccaactaagtatggtctagtagctttgagtttctagcctactgaacaaaagctgcagctaagatctgatgttccactacataattttactgagtaattttaacataactttataacatataggaaggaagaatataaactaaaaaagtcttgcatgattagttgctcttcactacttagtgtttctatttagatttgttcagtctctttactatagtttgggttaaactataagtcattttagctgaggactaagtatggactaggttcatgtggactatttttatatattcatatactaactcatttagacatccttaagtgttttgataaaatcatattttaactgttctattaaaatatctattatatgctttccaaggcaaatatagaatatagaaaaagtccgcataaataaatttcatttcatttcatttatcacatgccaacatttaaccaaataaattttatagagatgctggaacatctgctagtctctgatagggtgttctaggtgaggtgaggaccagcagtttgaaggaagtttggagaaaaggattactttatgtctggtaagataatgttctttactaataaaactttcccacctattgacttttaggacgcctgaaggaaaaagaaaataggaatcatttaaatgttaaacacattgttaaacacattttttttgacaacccaaactcattagatttatcatattcatctgtctgctgtgatttttttttccctaggtgtgttctcacagacttctttgaaaaaaagaaagaaaacgggctgagttatatgtgaactaaatttacctatcattatacatttacaagacaaatggcaacacaggaaatgggcttctaagcaatttggaaattatatataacctgaaagtcacaaagaagattaaaatttatgtacaaaaagttataaacaaaatataaaaattaaccacaaaatgggaaaaatatttgcaacacataatagacaaaaacattaatttaatttacaagttttacaaatcactaaaaaaatgcaacttagaaaaataggcaaaagatattaacaggcagttgacagagaaagaaaagcaaatgaaatcatgctaaacttcactcataattaaataaatgcaaactaaaataagttatatttttcaactatgagagcagtaaagataaaatattctgacaacacacaatgttggcaagtagcagttcatagaaatgtaaattaaaacaactttttagagggcaattttgccatacccatcaaaattaaaaatgcttgtactgtctcaactgtaattttatagctaggaatttaaatgaataaactctcaaaaattgcaaggttcattttccagtgtactcactgatccattactggtaataacaaaaaatggaaaataatctaaatctccatcagtctgcctgaataaattattatatacccaatcaattcaatattatttagcattgagcagaaagaatcatacatcgtgttaaaaagtgaataaaaaaacatgtgcattatgatccgtttacttatatgaagaaatatatataaattttttcaggaaacgaaacaatgaggcaactaaaacagatctttagggagaggaattagtagacttcatttttcattttatatctttatgcctgatttaaacttttattttgccacatatatgtaaaaaatttgtacatatataacatattttaaataatagttattgtagtactattaaataatattttagagaaaagaaactacacagataattgttcacaggcccagtcattcaatatatatggtatagaattcatctcatccacattgagataccttttcaaaacaatgactgcaaaaaaaggggtttccattctttttagatgttatttttaaattcatttcataataaaatccaataccatagtataactcatttttttccctttctccagaaactttaagcaaatacttgaagttatagtaaaggatcttaaaataataccattcttggttcaaccacttggggaaacagtgtgtctttatctattgaaggtgaagctatacatactccatgaaccagcaataccgtactaaatatacaccctagagagaaatctactcatatattcaccatggtatgtgtatacaaatgttcacagcagagtgtttataatagcaaaaaacaaaagctaacctcaaaactactaaaatagtaattaacattagaatggctatattaattatggtatatctatacaatggtatatctatacaaagaatcatccttaggcttgcagaacaaattttaaggtttgggcatttataattcaaaaataaagtacaaagaggctgaatatggaactgtgtccaaaccatcataataaaaattagtaccagtacagagaagagattctatatttagattagaagatggaacttctaattacttcttcattattaaacctttaatattcattcctaaattagatttagccattccttttcaagaacattacatttcctgatatatttcataaattgcaaatgctcttaaacaatcagactaatatatccttcctatcatcattattcatattaacctatcctcacagaaagaaacctctaagagatgaaaaaaaaaaaagtgtaagaagcatgtcaagaggctaaaaaccactacttaacaaaacaatctttttttctttttcttttttttttcttggagatggagtctcactctgttgccaggctggagtgcagtggcatgatctcggctcactgcaacctccgtgtcctgggttcaagcaattctcctgcctcagcctcccgagtagctgggattacaggcgtgtgccaccacacgcggctaatttttgtatttttagtaaagacgggatttcaccatgtttgccaggatggtcttgatctcttgacctcgtgattcgcctgcctcggcctcccaaagtgctggaattataggcgtgagccaccacacccagccttttttttttctgagatggggtctcactctgtcacccaggctggagggcagtggcatgatcttggctcactaaaatctcaaaatctctgcctcctgggctcaatgaattctcccacctcagcctcccaaatagctgagacaacaggcgtgtgccaccatgcacggctaatttttgtattttttgcagagatgggttttcaccctgttgcgcaggctggtctcgaacgcctgagctcaagagatcctgccacctcagcctcccaaagtgctacgattacaggcgtgagacaccaagtgataaggtttgacaaatctcatcttgaattgtagctcccataactcccccatgttatgggagggacacggtggaagataattgaatcatgggggcagtttcccctgtactgttcccgttagtgaataagtcttacgagatctgatgggtttataagtggaaacacctttcacttggctcttattctcttgtttgccaccatgtaagacatagcttttgccttcttccattattgtgaggcctccccagccacgtggaactgtgagtccattcaacctctttttatttataaattacccagtctcaggtatatctttatcagcagtgtgaaaatgaactgatacaccatgcctggccaaaaccaaaatcttcttaactcatgttccacatttaaatatatggtagcagtggtgaaggagagtgaagagaagttttgaattgttatagtatacatgcacacacaggttcacacgcacacacaaaccattttgtaaggggaacatttattttaaatcttagccatgtgttaattttcacttaatatttgtaggaacattttcagttacatgttcaacataataccattttaatactagtattaaaaatgttttataaccctttataacacaggaaaacacaggtttctaccaatgggcagaacttgtcatcatgggggattccagtaaaagactatttcccaatctgctacgtacagccgactgcctaaatttggaccaatggatttggtgtgtgtgtgtatggtaggaagttgttttctcctctctaggttttccttctcactgacgagataatagcaacaaataaaggctcccatctttaattcagatgaagaagcctcctgatgagaaggacagagctgcctggccagcttcagacaggtcatttctagattgctgtctgagtagaacagaaatgtctgttatttcagcactgaaatttgaagatattgttatagaaaattttaacacaaaagtctaaatattcagttaaattatttgtaggaaatagttcaatcaatgtcattagtcaaggcaaaaatctttgtcataagaattaggggataaaaacaaaatcttaaaaatatgtacacatgaatttttatgtatatgctcatgtgacattaaaggtctctccaggcattacatcagcagtccccaacctttttggcaccagggaccattttcttccatggattggggtggtgaaggtggatgactttgggatgatacaagaacactacatttattgtgcactttatttctattattactacattgtaatatatagtgaaataattatacaactcaccacaacatagaatcagtgggagccctgaacttgtttttctgcaactagatggtcccagctgggggtgttgggagacagtgacagatcatcaggcattagattctcataaggagcacgcaacctagatgcttcacaggcacagttcacaatagggttcatgctcctataagaatctaatgccactgctgatctgacaggagatggagctcaggcagtaatgcgagtgatggggagtggctgcaaatacagatgaagcttctcttgcttgcccactgctcatctcccgctgtgcagcctggttcctaatggtaccattctgtggcccaggggttggggactcctgcattacatcaaagtaaaaatcacacacacacaaagaccaagatacttacagtaataaattttctaaatagttgaatgtcaacactatgataaacaaaattgcaatgcaactaactggagaaaaccaatttagtttagggtttttgtccataatacatgaaaaagctcttaaaatgggtaaaatgacaaagaacattgtattaatagatttttggttgcaagccacagaaaccaagactctggttaacttagatgaagtgaattactgtaagagtatgggaaagttaaatgaaagaagaaacagatgcagaaaggacaacggaagtagttccagagggtgctgctggcaggaactaccatactgtcttccctgagtactgccactggaatggacagttccttagaaacagactgaggtggcatagagatggcatagagaaagcatagagaaatggcatagaggaagtttgattgagagtatactcaggagacacaactataaggaaatgaggaaggcaggattgggcagaggaagcagcagactcacagtgaggatgcagctgaagcctcagtccatcctacagggtgttctttgaggtagtggctctttagattgtcccaaatacagtcaatgccctttatattgaccatcagctagtcagtggccttgggttgccctcaggcaaggcagttgcccagggagggaggaagtgagatataagcaactaagagtcccacaactggacttacttttctgactttgcatcacaccacccaaaattcaaaacacttatgagagccagattggcacatttggtcatatgctcacaatttggctggggcaggcaagctcctctattatgtccttccaaaactacacacagagaggtaattccagtaaaagaattacccccacctcaccaaagaaacaaaacaaaacccaaacaaaaacaacaagaaaaatgtgtatgctattaccacaacaagagagaatggaaaccccacttctaggatacagtaatggtcttctatagatatcaatgggcaattcagaaataaaaatatataaatgattaagaaactttaaaaactataacctcactagaagtcaatgatctgcaaattaaacttttgttgttttttttttttgctaatcagattgacaaagattaagaaagattttactctgactttataagggtggtggaaggcagaaattcaaacacaatgttgacagaaggataaattgataataacctttctgaaaatcaattttgatatgtatgccaaaagttttaaaaatatacataccctgctatttcacttctaagaatttatcctaaggaaatactcaattaagaaagatatatgcacaaagacatccaatgtagcactgcttgctcttatttaaaaatgaaataaacagggttcaaaaataggtgatagagtcagtaaattatgataaatctacatgatgcaatattatgaagccattagaaatcatgcaattgcaagatatccattttcatatatagagaaatgttcacattactggttttaaaaactataaaacataccataaatcattttgtaataccataaacaggaaaatgttatttcagggtgatggcattataagtgttacttccttttgcttttttcctatgacttctatattaattattactttataaatagaaagatgttataaataataaatatctacttgacttatagatattaaattcttgatatatatcctattatatatcaagaattatatattatatcaagaattatataatatggaatatatatcaataatatctatctatattatataatatatattaagaattttatgtctctagaaattggttacaattcaaccaggcatggtgggtgtctcagcctgtaatcccagcactttgggaggtcaaggccggcagatcacttgaagtcaggagttcgagaccagcctggccaacatggtaaaactccatctctactaaaaatacaaaaattaaccaggcctgttcgtgagcacctgtaatcccagctacttgggagattgaggcaggagaatcacttgaacccgggaggcagaggttgcagtgagccgagatcatgccactgcactccagcctggacaacagagagaaactcagtctcaaaaaaaaaaaaaaaaaaaaaaaaaattggttacaattgaggtggaattttagttcaaatctcttaaaaaacaagaaacatttcttgactaatcagaagagctgatactcagggccatattcaaagtcagctggtacttcagttttaaatgaaaacaattacatgaaccgtaataacctgcctttaccttcatactcatgtttttaaaaactgccatattgaacctaatagttttggcccacatttaaaggaagattaaattacttggaaagggcccagaggacagtaataaaaataattacatacttagaaatttggtcctataatgacatgcaagaggaaatcatttagaaaataaaactgaaaataaccttacacttttacgggttaccataacctctgaagaatgggacaagaagccaaagaattgaattataatgagaataatttaatttagtcattaggaagaacatcttattcctcaataagtatttgagtgattattaatgtccaatgctatggcataaggacttgtaaccactaggatgtgttactagaaattattttcttaaaagtgtcagaggtagaatattgtgcaaagtaggggcttattacataaccctttaagatcttttccatatttatgatttttacaaaatttcaggcatctagaataattataaaaacatatcttatttttatggctttttaaaagtgaaaatagattaataattaagaaatataagaggataaaaatattagagatttttcattaacattgaggaaaatataagtatacagttagttaggaaacgcattatattatttgactccataaaggggaagcaattaaactaattattaagatatgagtacatgtgtgttaagtgtcagtatttgtattttaaatctctttttttttaaagtatagtgcaatgtagtgaatgcagacaaaatgttcctataacatatctgtacagatttttttctaagacgggagtcttgctatgttgtccaggctggtcttgaactctggggctgaagcgatactcctggcttagcctccctagtagctgggactacaggcacacaccaacttaccagtaacacattagttttaaggggctcagatgaaggaaaataaaatggatttaagatgagtaaaaaagaatcctcctttgtctgggcttgttccatcttccaaatatgtagcagcaacataatgacactaaaaactgccctaaaaatctgtaacagaaaaaaaaaatagcttacatgctactcaaaaaattacctaaatacctctcaaaatcaaaacaaaaagcaaagtaaaaaataaaacaggacatacttgcaagaaaagatatgacctaaaggttgtatcttagccctgtttgttttttgaataaaatattaagttttaagcatttatttactgtttacatacattaggccttaccatattatcaggcactattctaagtattttacgaatagtactttatgtaatcctcatagctccacaagtatgagggtgtggtggctcatgcctgtaatcctagcactttggaaagcagactgcttaagtccaggagttcaagaccagcttaggcaacatggccataccctgtttctacaaaaaacaaaaaaattagccggggatggtggcctgcacctgtggtcccagctactcaggaggctgaggtgggaggatcacttgagcctgggagatcaaggctgcagtgagctgtgatcttaccactgcactccagactgggtgacagagcgagactctgtctaaaaaaaaaaaaagctaccattgttataccccattttatagattaggaaactgaggcacagaggtcacactaagccaagatcacacaacaaatagcggagctgatggagctgagattcaaatccaggcagtctggtgctggagtccatgtgtgtaatcactaagctattatatacaagtaattccttcaaatattaatatttgataacaattttgaactttgaagtttgcaaatatccacagcctgtatagttagaagtacaaaagtaatcacaaataacttttctaatacagattttaaattggaaaagatttctttgaatagctttacaacaaacatgtgtagacaaaagtagggataagaaagaaagactgttttttaaatgcatttgtcatgaatttactacctgggtaagcaaaaaacttgagctgtctcttttgaaagacataatttacaaatatgaatttatatattgtctagaggaaaagcacagtacaatttcaattaatgtttaattctatgactgactaaaatctttataatatttttaattaaagaagaaggtgaccgggacttaggtaagaaagcaaaattataacatttactacataacaagttttttgtttttttttttacataaacaagctttgtttcttacaaaaaaaaacaagcttcttcttttttttttttttttggatacagagtctcactctgtcgcacaggctacagcatagtgccgcagtctcggctcaatgaggcctctgcctcccgggttcaagcaattctcatgcctcagcctccctagtagctgggattacagacatgcaccactacacccaactaatttttgtatttttagtagagacagggtttccccatgttggccaggctggtctcgaactcctggcctcatctgatccgcctgcctcggcctcccaaagtgctgggattataggcatgagctactgtgctaggcctataaaaaagcttctttagggtaacttttttcttttttctgtaacagaataatcacattatttctcaagggaaataccatttactcaatttgtactctgaatgccatctaataaaacagcaaagccacaaccatgcagaatgtcagcacagcatgtctaactaaaactcactgtaagaaaaaaaaggaaaagagagctgatttcaaaggttctacatggctttgcacttcacatgctctgatgctgcagatatgagaagttgtaggtctaacataatttatatcttcttttaggatactttggcatttgtgaattgagaagtttggaaaacaactacgcaagtcacttctaatcctaaaattccaactacatgaaataaatattagtaagtactcagacacacacaatgtcaaaggctggccttgtggcaaaaaggaaatacagcaaaatcagtcaggttcccaccacggcactgatagcaagtctgttctcaaggttagtctctaaactgacacctggtaagtctgacaatgaaatatttgccaacaattaagtaaaggagatctctcctgataaatttttcataagtttcacataatacactttgatatttcctggaatgtttgtggccctcccctcactgcattgctctctcattttgttggctaatacatgttactaaagtcaatatatattcaactcatttttctctgcctcttggcccaatttaacacagctgatcctgttttcaaatgccttcatctgattttcttctcacctcctgacctttgtaggtcttttatgtgctcattaatgttggaattacttattttttccttaaccaagtttttcatctgtaaaatggatgtaatcttatgattttcttcatagtgttgcgagaattcagtaagattatgaatgtatagattttggcacagtatccaggacctaaattctctataaaggctaactactattactactatcaactcacagctagattagtgaaattgtgtcctgactttccatgcttattcttcctcttctccactcttctgctcataatataactagttttatttttatttatttattttttgagacagtgtctcactctgtcgcccaggctgggtgctgtggcacaatcatagctcactacaacccccacctcaagtgatcctcccacctcagcctcccagggagctgggaatacaggtgcgtgccaccacgccccactaatttttgaatttttgtgggtttttttggtagagatggggtttcattattgttgtccaggctggtctcgaattcctgagctcaagccatatacccgccttggcctcccaagtgctgggattacaggtgtgagccaccttgccaggcctagagagttttaataagcacaaatctgattatgtgcccctcaatctatccagaaacccattaatgcttttatagggcttttagaatacagacacatctcttactacttttgcccccaatccttccctatgctttaaccaaactgatttcaagcttcttgcttctttgatagtccctgctcactccatgagggcatttgtccacaatatttcccttgttggaaaccctctagtgacaatttggtcctaattttcctttagacctttgctaaaaagtcacttctgtcttgactaagtctggcctattttgcattttccttatactacgttcctatcccctagaacttctgtttgcagttacaaatttatatgagtgactactatttattattaatacacatttgtgtgtttcttccaacagacatctcagactaagctcctgatattcatccaacccaaacctgttcctttaacctcctttgccatctcagaaaatagcaatactattcttccagttgctgaggtcaaaacccttggactctcacacttcacatccatcagcaaattctattgtttccccagaattcaactacttttccccatttccactgatacccactgtggtcaaagcgctatcatcacttcctggattgctgtaatacctcttaacacatctccttgcttctttgacccaaccatttatcccttgcctacctacaagacagctagatgaatcctttaaaaatggcagatgtcattcctccactgaaaccttccaataacctgccatctgccaaggactgttgtgtaccctgctaaattaatatgttgaagcccgaatcctctcctcactcctatgtgactgtattggagacagtccttttaaggagataattaaggttaaatgaggtgatcagggtaaagccctgattccacagaactggtgcccttataagaaaagagacaacgctctctttatcatctgaggagacattgagaaggtactgtctgcaagccaaaaagaaaacccgaacatgatcatgctggcattctgatctcagacttccagcaggcagaactgtgagaaaatatatttctactgtttgagccacccaatctatgtattttgttatggcagcctgagctgactaacacactattctactaaaaaagtcaagtatgtctaacagccaaaaaaggtcctaaacattctgatctactacatcccatatcctaagctctctgatgtaattgcctttgattcttcacatctcttaagcaagttccagccaaactggcttacatgcaattccgtgagcatgctaagcatgctcctgcctttgggtctttggtttccctctgcttcagacactttttttcccaagaactcatatcactcacttccttactcaaatatcaccttctcagtgaggccatcctatggaaaattttatgatcctcatttcacacaaatatcccatttccctttccttagtactcactgcttggatgctatgtattttacctatttatcttgtctattgtttctctttctcactagaaagaactccatgagagatgggattgtccgttttgctcactgctatatcccgtaaatacagagtagctcatagtacctgttcagtatttattcaactaaatgaatgttgaattccaatagtggcagaattcgttgtggagctgaaaggtactgcacggatcaactactaatgcagcaattccctagtagaaaactgcactgcttaaaggaccacctcatttttctggcctcctctggttattactaaagctcaaaaggagctttaaaaatcctgatgcaacagctgttttcccctctcaccgtctttaaaaatagagataataaaatagcctgaaaagttgtcaagttcaagtaagatcatgtttatgacaattttttgaaaattgcctggttgcagcttttacttacagcattttcaaacagttctgccaactctgtggctctttcatcatgtttcaagtgttcagcaaacgatggtgttcgtctccataaagtcaaagtttaaaaatacaagggccgggcgcggtggctcatgcctgtaatcccagcacttggagaggcggaggtgggcggatcacgaggtcaggagatcgagaccatcctggctaacacggtgaaaccccgactctactaaaaatacaaaaaattagcagggcgtgatggcgggcgcctgtagtcccaactactcaggaggctgaggcaggaggagaatggcgtgaacccaggaggcggagtttgcagtgagccaagatcgcacccctgcactacagcttgggcgacagagcgagactccgtctcaaaaaaaaaaaaaaaaagtacataaataaaaaccaagtaattggaggacgccattcattgattttacttaggactttgggcataatctataggtttaaaaatttctgctgctaagaaagtgggaacacagttatattcccttacattttaccgaagagaaactagacctgcagaggagtacctttctgtttctatataagcagaggaattctgcacaacccaaatcacgcagaaacctcctggtaaggactccacgggtagttattgccggcattgtattctgagagatgagctgcatatcacttttggaaatgccttaaattaaaactcgtcttgaaacaacatgacgtctcaaagaagctcccttctcaccttggaacatcagcttttaaaataaaggtgtcatcagaagtgtgtagacacccactgcatcacaactggaactgatctctggttatgccaatctaggtctgcctggcagggtgagtctaccgctcgaaagctgcacagaggaaatcctccctcctccaggttcaggcccggagttacgagcggagattcgcggcggcgggtcagagcccagagcaaaccaggctggggaacgcacctcgcccgcggctccggaagcggctgcggccccgaccggaaagcccccagcatcgcccgaaggaatcgcggctggcctgcggctccggcccggcctcgggtacca

SEQ ID NO: 2025 - DNA, 683650 bp, Homo sapiens
  misc_feature (268290)..(368289): n is a, c, g, or t
cactaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggtaatgctgcttttgggggtccgtgtgtgtgtgtgtgcgtgcgtgtgcatgcgtgcatatgtgtgtgcatgagagagacagagacagagagggaggatatgtatttggggaagaattttgtattttgtattggtttatgactgtagccccctgagccaccaagctgggaggagacgtagagtgctgggtgctgctggagtctgcggctctcctctccctggcttctctctctaaagggcgccctggcttgatgattaaggtacaggcacagggaacctctgtcaaggtaaacttgatgtgaaacacctctggacaaaggcctctctctacagagccgccagatctaacgagttccctgggaaggttcccagctagtactttgtaacttgggggaagagggttgtagccagaaacatcagcgtattctgaccctccaacaggactttgctttggttctaagacaagtcaaagaaaatgagcttactgaaaggacttttctttggatacctcgtggccctttcctcctgtttccctcaagagcaaactgtccctgctagagaagccgaaggatagacggtcgggataaaggaggactcggccgagaaggtgcaggtttaaagggctgaccgcggacggggaaggctgcgtgggtcccacatggcacagggcggccgctcgccttgtcctgagaagaccacggtctgcagaggcccaaggggtgagggaggaaaggtgagtcagccagccgcttcaccacgcgtgtagacatcgtaattccctccttggaagatcttgagggttcttgtcttttaatcattgctcagttcacctcaggcagatcattaaaatagatcctgggagacaccaatagattcacaaagcagtttgctcaagcgtggtaaatcaacagcttaagctgacttctcctatttattttagggttgctgttggatctcatttgctaggattagggcaaagataggcgacctctttagagttcaggaagctgaagagcctccttgaggacactgtgtgacagaattccatgccaactcttcagagacttacacgaagatgagtttggatttgtatttagtggggtcatttcccaaagcccatttatcgataaaagggggccattttattagtaccatcattatcatcatctaaagaacttaaatgaagttttatgtcatctgggaagaagattctgtaaatacggacattaaaaatttttatattcagtgtgacagtgtgcataaggattgatgctcagtatagcttgacaggttcaaaacagacaaaccaaaccctcctcctttcaaaaattccacagaatatttgctcaataaagaaatatttccacactaaattagcattctgtaattaactgggtttctttttattacagttctcctccctcattagttatgaagtaagtgtgcgatgggctttcaggcttgaactaggactcaggtagcatccctgaccatgggagagaagtaataattacgaaagagtgcattgctgttcataggtctacacccgatacacccaaggattgggagtcagaagcccaatctgtgttatgtaaaagaaatcccttgtttcctgtacaaatttgctcttattttgcctgatacctgagcatgccaggagagtgggaatagttaattagggtgtgggttttggaggacctatgagctcttggtttgattttatacctttttgtcattggaaatcccatgtccttgaacctattcaatcggagaaggcttaaactgatataaaactgaagagcagaggcagccatggctacagcgagcaggtgggacacccagaagaagcagctgtcctcatcccatgcagttgtgaagccgctttttctccctcctcagagaggtgtcacctcaaccctaaaaaatgaacagcccccacccccaccatgaagtataatgaagaggggaacagcagagataagataagccagatgggacagggggtgaagaccccacatttcaagtgtatataccttgaggagaccttacctggggtctgaacacactgcttagaacataaagaggtaaataacctcctaaaataaaatccctaaagacagtctcttattcctgcattatatataattttgaaaggtattaaaactatgctgtgtgcttagactgcagaactcttaatgagttctccattctttattttattttattttcctggttgctaatgaaacttcagggatacctctattcccaggctggtaggcatgtgtagggagaccaggaaagaggaatatgtttctttttttttttttttaatttattttttgagtgagagagaggattgctgctttgtggattggttttgaagcagggggtcattaaactgtgctaactcaatgactgcctgcaaatcaccaagtgttgattcttatgagaaactcactggcacctcacatcctcatcttgtgaggcattaaccagagaactgggattgaatggagcctgatgccatctccgacatccttccagctgtttggttactgcaatagactacccattacttcttagcaagtgaacagaggaaagtgagtttctttaccagccttggtatttggaaaccaggcatatgggtggtgggtggaaataatttttgtgtgctgaggatggccacaaattaggggggaaattagaaaaaaaaaagattttactattagttagagattgttgttttttttctaccgtgtttgctaaaaaaaatgtgtaaaaagagtattttgggatttttggtttgttttttaaaggatactaaataaacaagccagagtaacaaggagaattggcttctgggagactatttctctttctctttggagatgctaaagtttatttttaaatgaagtattgcaaacccagagatgtttggaagcaatatatactttaatctgcatgaactgagttgatcctttggctctgaagccaatcaggtgatactgagactcctcggtgaaaatggctgagcattggctgcacctgacctctgctcctgcgcagagggaagcctggtgagggacccagaaaaaacactgaggcaagtctggcttaaatttactatattctcacaagccaacggagctcttccttagaaaaccaaattaagggattttttttcccttaaaataaataaaagtacaaatttattgtagtacatactgtctccatttcaaatgatttaaaattgaaaagcagtgatcagtaaagctattaagagaagacgaaaaattaattccctctgcttgcaatgagccaggacacatttttgctcaaatattaagcagggataagtttttcctagcatattgtgtgcatgtgtatgtatgtgtgtgcatgcgtatgcacacacaaacaaatgcacacacgtgaacagtcacacacaggcacacctcgtgtgtcacaaaatcagagttggaaaggaccccacacatgcactcgttggtcctagttcatgctctcgtgctgaggaatctcacaaatgtgtgagaatatgcctttcctcaaaagatctccagaaaaacctcctttcacatggaaatagcctacattccactggctaacttggatctttggttatatgttcagtcacatttttaacttccttagacctgaaaatcagctgttctcatcacaccttgtatatgtgactgctgttttttgttgcttctcagttttcttcaagttgtacaaatcctgatagataactccccatgtgtctgttcttctattaaattatgagccccaggacctagtattaacttaaatttggtgtctgaacatatataataatgccattacagaagaactttttgaaatgaatagaaatttttaaacaacagattccatagaacggacattgaaatgcatgtgaattctgggagaggttaggtggcctcccggaagggcacataggtaatggcccagtaagagaatttctgatgttcctgtccgctgctctctgattttgatcttgttgcttcttgcagtagatactgaaagagaggatctaactttgaccataatgagagttaaattttttatgtagccatattaaaaggcaatgtgagacatccgtatttaagataaatgtggtaacaggaaaaaaaagaagtgaaaagaacacagaaaaacaagattcaatattaggaagtgcacataactattgaggagtcccaatagggaaggtggtccttttgcagttcaaaaagggcatggggtggggttggtggccctttcacagttcacacggacattggatgtagcagccatgctcacgtacagtaaattccatctgtgcatggtctaaattatctaagactctgtagataaaaagaaaacttgaaggaactgctgaagaatagggacaccaggttcttaggattgtgtagaagtacatctgggactcatggacttccagagccgggagacaggatggagtttggctgcaaaataggctgatgtgtgaaggatttgaggagagaactgggaagtcttggatatcctacagagagcaggtccagaaccagagctccctactgggaacaccagagtgggtccttgagctgatggggagcagcatggagtctttggggaagggaaagagcttagctggtgtggtgctatcctcagaggagggatgttttgcttgttaccaaagagaacaacatgatgaggaagcaagcacgcaactagcctggaggcggcatgcgctgtgctctgagaactgacaggtagttcacaatcttttgggatccgtgtcaccaacttactaaaaagtgcaaatcagcaagtgccatttagcacatcaaatgaaagcccaggcaattgagagcaaggacaaatgatacccagattggcttttggtgcaacccaaactcaaaacaatggaaacagtgtttctgtttggttttgttttttaaaatgctttctctgtgcattaaatgcattttgttattttattctgacattccattaaaccaaatccagccccctcattctcaatactgtggttatcagggcagatatactcaaaaccttcaaatgctccatggagaacacgtgagggctggagggtgcttttcattaaccttcaccgaaacatcttagctccagcgtgcacgtggaaagtgttaagatgctaatcacttagaggaatgaacagcgtgcacgtggaaagtgttaagatgctaatcacttagaggaatgaacggtcaccgtctctgcctcatcgggaattgtagcgttattatcttttatggaaatgagctgtgcctgtgtttggcactcactgatctagttttgcagtaggcatcatgcaccctctgtcattgagaaagagagggcagagtgaatctgtggatccagagttctaaaacctgaggaagagtatataattcggggagaaagtgattctctataagctctgagaggtcaatggttgacatccttgcttgtaaaagatcggacaggtagggggtgtatcatcttgtttcagacactgtttggaaaaacaaaataaagtggttttatttgaagatgtaggcttggttaccccatagccttaaatcatggaagtaggtaaccatgtcaatttgcatggggagccgcgtgcagtggctcatacctgcagtctttgggaggccgacgagagaggattgcttgagtttaggagttcaacaccagcctgggcaacatggcgaagccccatgtctagaaaaaatagaaaaattatccaggcgtggtggtggcgcatgcctgttgtcccagttactcaggaggctgaggtaggaggatcacctgagcccagggaggtcaagtttgcagtgagccgtgatcacaccgctgaactctagcctgggcaatggagtgaaaccctgtctccacaaaaaaaaaaaagaaaaagaaaaagaaaatctgggtgggatgtaaattgcaatcctgtttgttggtgcaattctgcatgtggctgatatcctaaagtccttcctgactttgatagcatgtgtttcttgaagtggggagtggagaggtctcaacacacacagcccaggtagaatgatcaaatccagaaagtttattctctgtcctactcccatccccatttgttgttgacctttcaggactctttacttctacatcccgggtaggcccttaatctccactggtacccatggtttagcaccattttctcatacttgactcttctatcaaaaatgctccatgtgcttttccacctgggccttgctaaatgactgagacaaatccattcattaaacaaaaagtgtaaggtgggtgtcatgcagtactttcctgagagcatttgcaatttcaacagtagctattggtgataaaacccaatgcaattattaatggtggaaatttcaggcacaaagttgtggcaagacctgatggaagaaaaaatatttagtcacatcgttaaggaataatgaaggtgaggtcacagcggggacagtcttggcaccccttaaatcatcgacaggctgtgcacatcctggaggtatctgttcattctgtgttcacattagagctggtcttgtatcaggcaagtaccaaattacagatcctgttgctgctttctgctttcaaatcctgaaggatttgatagtaatagtgttgaaatgtgcagcgattccttcttaggaaaaactgccataatatgcacaggcatggagtcagtgctgtgggtcccctttgatcctggtggctgggatcctgaatgcagccctccaccaatggctttacaaagcacgttgctgatataatgaagtcttgctccgcaaatttttagtgacaatgtatgtaattattcctttactagtatctgatccatttttaagaaatttaacttcccctgccagaattcaagaaaaactgctttccccagtgtggaactgcacgagactcaagcgtcacctcgagctgctaagttattaatttggaacacaggcttttaaacaatatctgtatgtgcgcccatgtatgtgtgggcagagggggcgatgggagaccagccaaatctgctgattaaaatgggaacaccgtggtgatggcggggctctctcaaaacactttaaaaggccgaagtccatcttgtggacatgctcataagatttctcttggagacaatggtaattcattctcttaaaaaggattggttcaaccctttgagtaggctacccacagcaagatgtgagatcagaaccaaaaaatattcaaagcatattccatgttttgtcttttggaaataatatgtgacagaggtggtcttgaatagtaatgatatatgtttccaaattaatgaaaataagttatttctttattctctagcagtgattcttgaaattcttcattctttttagaatatttgaagttgttatagcattcactctaggaattccaaaattatgacactaagtatgtatctcaaatcaggcctctgagtgggaaagggaaggaaacatatttttaattttaatagtctgcctaatatcccatccacttattagacagatattggatccaaggaagatttttattttgataaacagtaatgggagagccaaggtagggggaaaggagagctggatgggaacagctcaaggtcaggagagagcagaacagtccacagccagggtgcctggacccaaggtgcagccagcggtctgctggagaaaggtggaatgtggctgcaggggcacacagagatggtttgggaaaacagaaacaggaactgtgatatgaaagtgttttgaaagcatacaatggaaaacagcaatgggcttgtaaagttctagaagggagggaggaagtctgaacgtggcacgagaggctcttgcttaagagaacaggtgtttgtggaataggtaaaaccagaggagtgacttggacatcaaaattttattttctgaatgtgattatttaatctaggcatgttttgataggtgaaaaaagggactagaaacttctggctttcaaagagcaaaaagagtttgttatttcacaaataaattcaagtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattttgccattaaaaaccatgaagctgtaacaacgtctcaaaagctcccttggtgcattttattaattctttctgctcattactaggcttgggatgatgaagacctgacccttgacttgccaatagctaacttacgggggagttgggagaattgctgtgctttggcatggatgcccctgacttctgatccgagctcctccacctgctagctgagggatattggacagttctggactgattctgtatctatgaaatggggatgattcctgtcacgctgttgctgtaaaaaacaaaatatagaaacacggaatgctgttcttggcatggagatttcaaactattgttcagtgaacacctactatgtgctgacatcccaatgctacttgaatcttcttattttcagcatttggtcagagctcatgtcccatttttaagatgatttgttctacaaaatcatagaatgtttgacttttaaagcttcttatagcccctcttgcccagtgatttttggacttttgttttagtaacgtaaaccccttttccaaagggcacgtcttttccaagattggcatgtgaaggtggtgaacgtgctggcttagtgcccctgagacgtgtcagcagagccccagggcatgggggagcccagctcacaaaccacacatctaattcagcagtctaatcttgcacaggagtaaaaccaagctcagagaggttgagtaaattaccaaaatcatgcagctggcaagctgcaaattcagaacacaactccctccttttttttttcctccaaatcaagcaatcctgagtgaaacgtgggaaatataatatgccaagaagattaacacgaaaactgttaactggcagctgcaaaggaaataaaggaattagataatatgaatgggttaacaaattctcgcctggaggtcagttaagaaaaggtttgtgtcctccaggtaaatcaaacctactgcggtttttcctcttcacatctcatggacaaacacagccatttcttctttttattgcaccagtgctggatgcatgaggttgttcgtagcaatctgtcatatttgagtaattcgttatttaatgagttgcttttgaaacaaggaaaataatgaggatgttaccgttgtgtatctccccaatttttaaaaggaagcaacaaatagtaaattatgcatgctttggaagtatgcagtagttaattttcaatctcatcttacagctgaataacctcaaaggtagtagttatacaacaggtgtgggaatatgtgagtgtgagggagaggaatcccaggacatcacctgtacacattgggggtttggcccagcagggcttcagatgttgaaacatctggaaattttatttgctcacaagcttaaaatgaaccaaaagtatgttgcttattaacacttttgaggatctgatgaaagccataggactgcttgccagaaaaatccctacaattttttgagttcctaaggttcacattcccttcatttctgtctgtggactccaggttgagcgtctctgtggtcaccatggtccccagcaagctagcacagtcttaagacacatcagtaggaatgtactcagtgctcaaagcttacatagatattgaccagcagccatcacctctggggggctgtgctagggaggcacagcatgtagaagaggctggaatgggccagggagagtggtaagggagcaatgggtaggagatcccagaagtggtaggtaatggaccgtgatccatgtcaggtgattaaaggctaaaggaatatggttctgtcctcaaccacatggtggcctcagcctgggatacatgactgtgtcttcctccataggggtcagtttaactaagaaccccaagtattgaagacctcaagactttaatatggtacttcctgtaccttgacacacatatataagcttctgaaggacacaaaacatgccacgttacttgttgtatctctgacgccaagcacaatggtgacccacttgcttgtgtgctaaatgaatcagtgagtgaatgaattgtgtcctcctctctaaacctcctctactgagttatacacaaagttgagggtctgtggttttactatttattcatcgaatgaaccattgaacaaagtaatcaaattttcagagccctgtagagaaatcaaatctccctctgaattgctaactcaccttgctttccctattgtttaaagtgtcatagccactcttcctttcccaacactccaccctcacctgtcctacccaaaaacatttctctgctacagaagcatgaactattcactccagccaccagccatgcatcaacattcagtcttgctgtgattcatctccataagataagtgaatattctctcatttaccaactgtatagataagaaaaccatcagaaatcaaagaactgttgaaaaatgggcattttacatcaccaaagcccttttttgttgttgaaacagaagcttcaagtcttctccatccactgaaatgagttgttgaagtggaaaagtaagttctaattgaaccaccttctccgatgcagagaaaaagcagacttgaacaattgggttgatcttctatttctcaggttggagaagtgctttgaggaaagaaagatggggaatcaagatcagaggaatgcaaagttctggaatgtttgcctcagttgccctctactgggtctggcttggggaagtttgtagaactttttaatgagtcattgtaggttcaggagagatttcagatgtgggggacagggtgaaatgctttcttacacagaagtgaatgagttagtgaaactgtagcacgtacagtttgggagaatgggggcaatggggggattgtggtacgggagaaggagcaccagcctgggattcagacaggtctgagtttaaattccagctctggcacttgctaggtaggcagcgttggacaagttgggtaacctcagtttccaccttgagcaagtgcttgactaataacagctgtgactgttaccagtatggtaattacagtatcccaaggtgtaaagaagcagaagcatgattatatgagttgggtcaaagatttggctgtctccctgtccccccaccaatctggctacagggcagactttgctaaatagacacagatttacttccaatgaagtgggtttgctgcactgaataaagtagtttacttttccttcactgcagctgtgcttgaaattggacagaaagccaggtgtggtggctcacgcctgtaatcacagcactttgggaggctgaggcgggcggatcatgaggtcaggagattgagaccatcctggctaacatggtgaatccagcctgggcgacagagcatgactctgtctcaaaataaataaataataataaattggacagaaaataagatagagttgtagcaattagtctgcagtttttgactttattaaattcacttagacatgtggctgcaccattatgctaaggtacctgaggctctactatggtgtattcattgtcgaaaatgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttcagtgtctagaatagagtaacagtcctgctttatatttgtataacgcttagcaccagtgctaacaaaatgcaacatgagactgggcatggtgattcatgcctgtaatcccagcactttgggaggccgaggcgggtggattgcctgaggtcaggagttcaagaccagcctggccaacatggtgaaaccccatctctactaaaaatacaaaaaattgctcaggtgtggtggcgggtgcctgtaatcccagctactcaggaggctgacatgggagaatcgcttgaacccaggaggcggaggttgtagtgagctgagattggaccactgcacttcagcctgggcaataggagtgagactttgtctcaaaaaatatgcaacatgccgggtgcagtggctcacgcctgtagtcccagcactttgggatgctgaggtgggcagatcacgaggtcaggagatcgagaccatcctggccaacatggcgaaaccctgtctctactaacaatacaaaaattagctgggcatggtggtgggtgcctgtaatcccagctacacaggaggctgaggcaggagaattgcttgaacccaggaggcggaggttgcggtgagccgagatcacaccactgtactccagcctgggtgacagagcaagactctgtctcaaatatttcaaatatatatatatatatatatatatatatatgcaacatgaactactatgtaatttaaaaattttactagccacctttaaaaattaagaagaaacagatggaaatgattttaccatgtattttatttaatctaatatctcaaaaatctattattccaacatagaagcaatataaaaattgttaatgaaatattttacgtttgttttttccactccgagtctttggaatggcatgtgtgctttacactgacggtgcctctcacttcaggccggccctgtgtccagtgcggtctccataaaggactctggtgtccagaagttcccatggccgctccattccgtacttggttttcacaaaaactgtctcctaccttctaatgtcctcaattctacaggaaaatgagaatcatctccagacagtagaaactgtatccataatccatattatgaagagataaaatagccaattgtactttgtttttttttttgttgttgtttttcttgagacagaattttcctctgttgcccaggtcggagtgcagcagtgcgatctcggctcacagcaacccctgccttccagggtttaagcgatccttctgcctcagcctccctagtagctgggaccacaggcatgtgccaccatggccagctaattttttgtacttttagtaaagacagggtttcaccatgttggccaggctggtctcgaactcctggcctcaggtgatccgcctgcctcaacctcccaacgtgctgggattacaggcgtgagccactgtgcccggcccctattgtacttctgtttgaacttatattggcaaatgtagtaattttctagagttttagaggaggtagtgtttattattataaatatttgctgagaactttctgagcaaagggtactatttattctatataaatatgtactgagcatctgctagttatttaacagacttctaggcacaaaggatccaatggaaaaaataagaatattcatatttaacagcttctttgtgctctaggcattgattattctctgcattgatagaatttacacttgcagctttcaccaaagaaaatgttccacagtttaggcagcatggcaaaaatccatctctacaaaaaaataccaaaattagcaggtggtgcatgcctgtagtcccagctactcaagaggctgaggtgggaggatcgcttaagcccaaaagatcgaggctgcagtgagctgtgattgtgccactgtgctctagcctaggtgacagagccagaccctgtctttaaaaaaaaaaaaagaaaaaatgctataattttacaaaacctgctctccatgtatccctctctactctccttaagatgaacactgggtctggggtgcaggggtgccacagctggagttgaagaggaagttaggagaaggctaggaaccatcacggagatttttcaccctggttccttcattattacttgttggggatcagtgaagattagaaattgatgatggcggccaggcgcggtcgctcacgtctgtaatcccagcacctttgggaggctgaggcgggcggatcacaaggtcaggagttcaagaacagcctagccaatatggtgaaaccccgtctctactaaaaatacaaaaaaaattagccgggcatagtggcgggtgcctgtaatcccagctacacaggaggctgaggcaggaggatcgcttgaacccagaaggcggaggttgcagtgagctaagattgcgccactgcactccagcctgggtgacagagcaagactctgtctcaaaaaaaaaaaaaaaaaaaaagaggaagaaattgaacatggctttacagaggagcttctcttccctgcaggtagcggccttagacccttgtctaaggcaaaagtgggatttagggaaagatactgtggtagctgacacagaattgcaaaaggctgaaaacccccgccagcgaagggcagcagctgctcccctcctgtgggcactctattgccctcatagagagaaggcatctcccagcactttctacaaccacacccccaacccccaacccccaacccccagcttagttctctagaagagcagaccctcaccctcccccacctcctcagcccagcctggaaaggcccacggaaggactctgccagccctggctaaagttatgtgtccacctctagagcagccacctggcctggggacgaagcagtatgagcccacattctgagttgtaaaaccccacaattaggaaatagacttaaagtgctcccatcacattaggatgcaatgtgcatttttgtttgtagaagcttgttctccatttcttcttatttgggcaaaataagctcagtttgactaactctgccatctctaacccagaccccaccatgctctgacactttgacaagcacactggatgggcaaaagagtcaactaccgaaggaagacaattttcgtttggtctaaaactttatacctgtgatattctgtgccatggagagactcgtgcttaataattcactttccaatgatcttaggcaatgtagaagattacaaatactgtgagacctgaactcctccttcagggaacttaacagttttcagtggcgggggaaataagagtagattcctgaaaccatagcagcatccgatagaacagaacatttcctcgactctagcaaatctcttaattccaggtgtactcgggaagatagtagcatttattgggtatatactatgaagagagaagtgtcatatcctgagagggggtttataggcagtaaacattgtagtctttgccttcaaggtgtttgaaacataaaacatgctcacattagctaaatatgcctgcttcaatgcctgtacttatatcacacaaccgacgttatcaacctggtttcaaacgccatgagcaaaaatcaaatcaggtaatgtgtgtgaaagttcattatgactgtaccaccatacaaaccgagatggtattactccagtcagaccttctgttttatagtgtgttccagaagctggcctggttgcagaagagagtgagctcattagccctgttcaaaaaaaaaaataaatggaataataaagaaacttcaaaaccaaatgaaataccattccatgcacatcttggaaaagtttataacgtatttaaacatgaagagctattgtaagcttgacaataaaactgtgaggatattgttcatttccgagattcacttttccaagatagctctatcgtgaaagtctcttttggagtttatgtatagttctttaaattggcacagttggcttaaagctaaaacactgtagtttgcattaaaaaagaaaaaaaaaaagcaagtgcttttgcacaaaaggctgtaagaaatgagggctgcatatgaagcgagtgttccgttgactgtgtgagtgtgagatccttttggctttagtcatttatttggggcaagctccgaccttgatgacagatgatttcgtcaagctctccacaaaaggtacatgtctattttcatcgtcaactaacttctgtggagcacttgctgcttttggtcccctaaccatgaggttttattgacccatttgccatctctggggtaagtggatggaatcatctttcttgagaggagaactccaggaataatattacacttgtctctgagccatttgagcttgctatttttacagatttcagccttagttccttttcctcttcctctgtcaccctcagaacactgggacaagggggagccatgctgtttcataaacttcccatagaggttctgagtctcctttttagctgattcccatgagtttgtaatattttgatctgagctggttgcagtttgaaataaataaaagcaatctgatttcattctagccaacatctgatgggtttgatatggatgaaagctaatgagaggtacaagtgagacagtacaggtgaaaactacaaaatctctcttgtaaaatacacatatacgcagacccatattttccaatgacacttaaaaggagtgataccaagaggaaacactgagtcccatgaaacatttcttcaatcaggacagaaccatgagcagaggacatagtgggtggggttcgtggaaaaatagaatatatatctaattttctgtttgatgatggtctacggattgatttaattatgattactacagtaacttgcctagtacttcctgttcacggttgccttttacatgcacagcaggttgcttggggagctgatgtctgctcctagcctttctgctccggtaccctttgttctgttccattatgtttcagataatttaatcaaagttgtgtttgcttgtgcgctcccccctttgaatcattctcactgcacttctgccccttccatgcagatgcaggctgatgccggatgggtctccactggcctcttctctggacttctctggggcccgtatcagaacccaaaacctagcctcagcttgacttcttcctcttaccacggggtgaccccggtgtgatctcccctcccaggttccatccagcatgaccgccgggtctccctctgccctacttgattgcactcaccttttgttaccagtccaggcagcaggctccatgtctgggttgggggtgtttcctggcctgacggggcaccttgttcgtttcacccaggcaggaaatcacgtcttgtttcaacatcctgaatcttgtcctgacgtggaaaccgtgatgctagctgacctgacctgcagcctcaggcatccctcggccctttcatggcctggtgtttatgtggtccgtcctcacaaactcttaggatgggatttattgtctccattttcttttctttctttctttcttctttccttttgttattttttttttttttttgagtcttgctctgttgcccctggatggagtgcaatggcaccatcttggctcactgcaacctctgcctcctgggttgaagcggttctcctgcctcactcagcctcccgagtagctgggactacagatgtgtaccaccatgcttggctaatttttttatatttttagtagagacaaggttttaccatattagccaggctggtctcgaattcctgacctcaagtgattctcccaccttggcctcccaaaatgctgggattacagatatgagccaccgtgcctggcctacagtctccattttctataggaaatgaaagcttagtgagagaaggtgcccagacccccaatggctgcgaatcggcagagttgggccccagtgggtctcctcactccatcccccttgtaccacccagtgtctcaccagccattctgctcagatgggatgtagggcctatatagcaaatagaagttttctgggaaccccttaatgacaaaaaatacttgctttccagagtattcatggcaggccttgataatcttgagcctcaagtgcccacaattccttctgggactgactttaaacctttatttcaaatacaagctgggtcttcattattctttgttgcaatggatctctttacacgttaccctcagaaccacaaattagcaagagtctagctggaatctctcctgtgatggaaatttcattccctaagaaatagagcaacctttcttaattaggcatttactctaatgattcagaaagttggttctttatttttgctttattttcattagaaactaaagatttggatggtgttttcataatctattgagaactgcaccaagactgtcagtattcaatacatatgattaataatcagagggaagacacttatattttctgtcatacacacatacctaaatgtttaggccaagggcacatttttaattgattcaaatagcaaatataaattgtgcctctctgttacctgaatgtcttacttttttggaggttttgttgtcaggaactgccatataagaggcatgcatcattttaattgaatcttaaacctgacacttttattgaccaaaaaaaaggatttcaagttatttttcatgcataaagcctgcatgaagcctgtacttctttagtgaaggctatctcagatatgtatgaccttacctccttgcctttaggaaaaattaaacctcactgtctgagatccttgagatttggcaaatgttgatcaattaactcttcaaagacttatgatgaaataactgtaggcaataaaacatactgaaatatgtccaaatgaccagcacagcaaaatatgcatgaccctgtgcctaaggtctgtggcatacaagccttgggttctgtttatggggatgtcaccttctatgactcaggtccctgtctagaaacatgatatggccacgtcttggtggttccttatttatgcggtcgagtcttttgtattcttaagtcatctctggaggataaaagtcagagctcaaagtctatatatactgtcacaaaacaaggatgcagatataatgatgataaaattgaacctatgatttaagaaatgcgatatgaatatgatatgacaactctacctgccaccagtggactaatttcccttgttgccaggggagacctcatcctcatcctaatttacacagtgttgtatgtttgtcaagaatgcataattctgccagtctgttgtatttctaattttagcctgtatacatagaaacactttaaaacatttgcaggctactgcaatcatcgtcatacaatctgtatagttgttacatagaaataatatcagttggtttccccataataattttttctagagagctagctgttcaatgctaattcatatcctttcttaaggtatatggcaagtaaaatggatttcctcggggcctggaaggaattcctgttcaatgattggaacatttaaaagatttcctcttgatttcctacaaggaaggaataggaaagggaggtgattggtcttgttagcctggaaatagtattcactgggtcgctagagggtgggcagagagggacgcaaaaaggcgtgtgtcagagttcctgtctccggggaggtcacaggatcgttagacagataagagagacgcctgtgtctaggtgtctttggttcagtcctaatgttctgcttggtgtctggttcccacaggtcatttggggggtctgaatggtgatggatacctctcagagaaaaaaaagatttaggcttccaggcaaagtggagaatgaagagtaaagacttggaatgatgggtggcaggataaaatagaagaatcattagttattagaattattagggtaaaaagccgtgttaagtgctttgtaggtaggaggaccgtatatcccaatttgcttaggccagtcctggtttatggcaattgccctgacttgagttttagtaacattcccttttattctcaatagcgtcccagtttgggcaataagtcatatggtcaacatatatattgatgaagaattaggatcttaatataggaacagattgcgagtgaagataaaggtaaaatcaattttgaagtccccttatactacaccgtaatttgatatctatatcaatctctaattttacttgaggagtagtgttgacctcatgtcttagaagaaaaaaatgaaggtaaaaaaataataaaattttgcttaggccgttgtgaaatttcctttcaaagacggaactagaatttagaactcaaaaacctcatttcctatactaacccccaccctacattgccggggaaaatggaaaaagcaaaagaaataatgggatataaaaatgtatgggacacattctttcctctattatgagcttgtctcttaattaccaccatttatactggacatgtgatttgggtttccagaatagtaaaaacacagatattataagccctgtgatcatttgcaaagaaatctcatttgcccaggctattacatttctgttctgccttcagtggaaatacacatagaatggaatagaaatatgcattactatgagtaattccagacaccttaatgcttttagcgggagtgcatttggagtttgtttcctgagacccctctggtggaggtggttgttattcatgcttgctggaacagtcctccccacgtctgtgagctcaagcaggtcctggcctcagaaccacagaactccaatagccagagactaaaagaaaagggaaaaatggtttgctcggatccctgggttgcttggcccacaccctgagtgtaatatgtgatcagggttagaaagcaagtggtgggagcaggtcttgcttctgtgggcatggcctcctagagaaatagtccagcgctggaggcacagagaggggaggacaggcattccaaggctcttgaagaactgaaatctggaatcgacatgaagctacatcccgaagcagggaagtaacgacgggcctggaagggattcctgttcaattagtggaatatttacagaagtgttgttttgaagatgaatttatggatgatgttcatgtaaagtgagatagaatgaggggacagacagggatagggaagcaattaatttgccatagatgtgggtctgaaaataatctttactggcttgcctggtgttgtctaaagtagcaggggaagctttgagaatcctattgatttcaggttactatccaggaactataaaatattaaagcagaaaggagacttagtgatcattaaattcattctgaaatgagaaaaatcaagcccacagaaatggagggtttacttaatggagggtgtacatggtattaggggcaggaaccaggtctagaacacacccactggctccttgtcattaaccccgttgccctggagagaagagaagccggtggtcacactttgacagacacagtgtgggtgatgccagagccaaaaccttgggaagggaactgtgtggcttcatggacatgaccagatccacagtcatccactgggttactgtcttcccagttctcatcagccagggttgtttagaaacattgaaaaatgttgctaactgtggatagctctgtaagtagggttttccatctttctaacacttattacatttttttattcctggaacaattttgaatgagaagtggaaaccatggttttagccctacttatctcttaaggaagaatagattggaacagtacaggtgttttgcttaagtttgtggatttacttaaatattccctatgaaagctccggtgtacacatttattttattcatgatttcaacaaagctttactgtgcaccacatacagtccagcatggtcccatagagctttcagcaatggtggaattgtgttgcatccgcactggccagcgttgcagccactagccacatgttgctgtcgcagtcttaaaatgtggctggtgatcagggacgatgagcttttctcatatatctgttggctgcataaatgtcttcttttgcgaagtgtctgttcatatccgtcacccactttttgattggcttatttgttattagagaaatgcaagtgaaaaccacaaggagatactatctcacgccagttagaatggcgatcattaaaaagtcaggacacaacagatgctggagaggatgtggagaaataggaacgctttcacactgttggggggagtgtaaattagtttaatcatggaagacagtgtggtgattcctcaagggcctagaaccagaaataccatttgacccagcaatcccattactgggtatatacccaaaggattataaatcattctataaggacacttgcacacatatgtttcttgcagcactatttacaataacaaagacttggaaccaacccaaatgcccatcaatgatagactgaataaagaaaatgtggcacatatacaccatggaatactatgcagccataaaaaagaatgagttcatgtcctttgcagagaaatggatgaagctggaaaccatcattctcagcaaactaacacaggaacagaaaaccaaacactgcatgttctcactcacaagcgggagttgaacaatgagaacacatggacgacacagggaggggaacatcacacactggggcctgtcgggcggtggaggggaaggggagggagaccattaggacaaatacctaatgcatgcagggcttaaaacctagatgatgggttgataggtgcagcaaaccaccatggcacatgtatacctatgtaacaaacctgcacgttgtgcacatgtatcccagaacttaaagtaaaaatttttaaacatgtggctggtgactgagagatgcaattcttaactgtagttagttctaattaattgaaattgagatcaccacagatggcagaggctttcatgtcagtttcagactctggtattgggtcgagggagaaaagaaaaaagacaagtcatgatctctgaggacaaggtattcacagccgagagtggcagggatgaggagagacaggtaaacaattgtcacactggagtgtggccagttatgtcactgtgggaataaggtcctgtgagagcacggaaaagatgagcgtgatatgattcctctttggggcgggcaagcatcagggcagtttgacaaagagcagatgttcctgtctttacgaacggactgagaccgctccagacatctgagatgaacatgaagagaaaggaattttcaacaatggagcaaacatacattctcagcagtgtaaagagcagagcgccagaggcaaccgtgtacttctggtgtacttctgcgtgcacgttggtgtacacaccctctggggaggtgaactagcaggcagcttggcaagaagtcgcctgcggtgttctgcgtctcagcccttgttcaccatagtgctctgtgtgaagttggacaaatgcatctacctttctggacttcagtctcctctccactccccgaaggcagggcagagcagctgtatgactccttctcagatctgggcttagtccttacaagcttctgttgcattctccagctcctgcagtggccttccctcaagacaatgagaagcttcttggcctcctctttaacactgggtgctatttaatgagggcacctcaagatcctcccagttaccacgattgctggtggcagtcatctcccctccgacaacagttttgtgctctgagtgcctgtgctgtttccacatttttttctccccctcaggtattttagaccccaaagatacatgggtactctagggatactgtgtaaagactgggtagtatttggaactggcagccagagagacgacattggcaattcattcatctatcattacctcaattggcagtgttctcagtacgcagggactgtctctgtgtggctttttgtgagagggatgtaagatttatttttctctatgacctacctgctggcatggtacaaaaggtctctgccgaggtctgagggacctcacttgagctgcactaatagacggggggataactggtagaccaggagagtgtagacaggaagaaagaactcacctttgtaaatgagccactcaggcttttgattttgtggcccttgaattcccacttcagctgatggtcacactcatctgtggggaagctaattttacaagaaatggaacaggagggggttgctgttggatcaagaagatgcagctttggaaggtatccacgagggaatagccatcaatttgccacgtgtgtgagctctaccatcccgcagcacatgggagcgtgctgtgctgtgcctgtgtgctctcaaggtagacgaggtgtcactatatggtcatccacacagcaggtgtggccaaatatagagatctcgtgaaaaactaatagcctgccaaagaatacagccactttttcagggtcgtaaaaacactctgtgactttcccaaaatacagttactatacatgcactagcaaatcccaggatgttctcttcttatggtgcacatagctaaatacccacctgtggaatgtgggtttatttgggaagaagctaatcctattaggagtttcatattctcaccaatttgggtgatggggtctgtgaccaaagatcatagaaagtaagaaatacaggactcaaaaatgtgttcttcattatgtcttcacctcgtgctttttaaacttttttttttttttttgagacagagtctcactctgtcactcaggctggagtgcagtggtgcaatcccagctcactgcaacctccgtctcctgggttcaagtgattctcctgcctcagcttcctgagtagctgggattacaggcacatgccaccacgcccggctaatttgtgtatttttagtagggacagggtttcaccatgttggccaggctggtctcaaactcctggcctcaggtgatccacccgcctcagcctcccaaagtgctgggattacaagcgtgagccaccacacccggccatggttttcaaactttaatgtgcatggaaattactggaagtgtttgttaaagtacagatgctgcttcagctggttgggcataggtcctgagatcccgcgtctctcacgggctcccaggccatgcagttgatgttggtccatggatgaccctctgggtagcaacgtttggggtctttgtgtgtccacacatggtgtgtctgtccattaggaggaaagtgccagcgcatttgccaaagcgtttagataggagcctgttagagtttgaagttccaggaccaaggaaatctggtaaataaaggacagttgtttgttcatggatctaggtttataaagtgtgtatacattttgagattctgtctcccccctccaaccttaaaattagcaaaatgtagtctttctttgtcgagctctaggaataatttttctgcgtcagatgcatttttgggaaggtgcgtttggccatttcccactcaccgtgcccgcccagtatccctgcagtactttggaagcaccataattgggaaagagtagaaagttcttgccttggaaatgagattcttatctgggtcttgggcactggaggatctcaggcgcgggaggctcgcgatgggtccggggaacagctgctgtgttcctgtaggaggaaatgcctgtgatggaggcttctaaagccagctcccgtctcagagaagacagctctatgcctccacgtcgtgatagcaaatgttcccttttggctgttttaatagttctgcttcaagcgtatttgtttttccttatttcctagcatctttgagaaagatctgttctatactctgtagcccagtttggagagatatgacatgtttgactatgtgaggaaatatacatatttctcagggcttttttttttaaattgagtgttattggactttgatgtttgatttccaggcagtctttaatgtgaaaggcaaacacattcattttctatcagttcctgaaaatgttcccaattttagaagctctagactggtcttgccaatatagcaacatagtgacagttactcgtctgtaattctgtacttaaatcgtgaactgctagcactatcgattaatgctttatacagtttcaaagctgtactcccaggctgcatttagatggtttaaagcattgatttctctctctgacaactcttaagttattggctgccaaaaaaatgaggaaaggttggttaatctccatggctcatatgttgcttgctgtagagaatattggtgaagcatagtttttcttcattgtaagatgcactagggatgtgaagactgttttgaatcattgtgaaaactggaatcagaaaaacaatctcctcattcaattcaagaattcgagatccaaaacaacattcagtttggtatttggcagtttaaccaatatctgactttatgtaattttaattattggggtcagccattggtattgcattataatttgtaatgatttatatcagccttttaaaaatgctcacagtcatggacaaaactggaaaaaatgaggaagtaacccaatccaaattacttaatatcatctgctgtaattagaaattagattttagtagactgtttccataatacatttcagaattatttttataacttaatagtataaatacaaaataatttcagctttgttattttattatgtgctgtgctagtttaaattattccggttataggtgtatcatcaacaccttatcttcagcaaggattttaaatatgggctgaccaaatttatgtggaatttgcattttgttattcgtttaaaaacatacagaaaatggaaaaaaaaaaaaaaacctttgcaaagattctcttttgagtgctagcttttcctgatccctaaggatgccggctgctctgccaggaatgtgcccttcatattatatcttctagaatgaatgtttggaagggaaagcagtaagatgcaaaagcaagaaggacagatgatgttcatactcacagtaatagctgtctcccctcttatcagttgtgatgctggaacaaacacctctttcctgactgcagggtttggaggtccccaagtccaccctcacttctgccatcaatggcaagcggcactggctgcgtggaaaagccaagatgcctttcaccataccatgtctggagtctagttgctgctcaataaaccctggtggcgatcactctcgagattcagtaacattatccagaatttaaaaaaaatacaagcctgggcacagtggctcacgcctgtaatcccagcactttgggaggccgcggtggcagatcacttgaggtcagaagttcgagatcagtctggctaacatagtgaaaccccatctctactaaaaatacaaaaaatagccaggcatggtggcacgcacctgtagtcccagctactcaggaggctgaggtgggcgaatcgcttgaagctggtaggcagaggttacagtgagccaagattgtaccactgcactcagacctgagcaacagaggaagactctgtctcaaaagaaaaggaacagaaaaaaaaaatacaacaatgtgtggtccttgtattcaagccaagcttatttctgcctcaaagcattgtgccaagtttgtatgttacttcaggtttcataagccagcagatcctcttcctgggactgaaatgatgatttcagttttttcaatgcttaagcgtggaaaacaggcaggtaatttgtgacccataagggaggggtgagaaccacatgaagatgaaggtggtggaaaggagcagctgatgtcacgcactgtctacttaacattgccacgttaatgttaatgccggttatagaaagcaatgggtaattgccatatttttgttacggcttattgcagtgaatgcaggatgcttctcacatctcttacacatcaagtaagagtatttcttaaaaaacaaaacaaaacaaaacaaaacaaactctcaatgccacatatacctgaattgtgagtacttatttcacctaacaaatacctaacaaatattgatattttgccacttatgggttgtataaatgaccattaatatgatttgtcaggcacagtacacacaactaacctataaacaatgtgcagacgtaggtcataaactgtgacactcgaaatccaagtagtgcccctggtgggagatgtttcacatgttaataagcaattaccgtagtagattaagagtacagaatcaatccaagaagccaataatttagagttggatactgtagcacaagattgcaggaacctgagtgctgtgtgccacgctgcacatcagaggttgcaagatgtcctgcaatgcaggctcaggaaagtgactgatgcgctgtgttctaatgtggaattctacaggtattcgtggaaaaacatcaatacattagcaaaacctggaccgtttctggtgttgctggtgctgcatgggatgagtctgtggggcactccatgggatatatttaaagaggtgttattttgtctcaagcggctagggcggagatagagcatgctatttgccacattgcattctaggggttgcaagacatcctgaaatgtgggctccatgaaagcggttcatgctgtgatctgtacccccagatctcttcccaggcaggtctcatccaccaccagaaatggtccatgttttactactgtattgatgtttttccacaaatacctgtagaaatccatattagaacacagggcgtcagtcactttcctgagcctgcattccaggacatcttgcagcctctgaaatgcagcgtggcacacagcactcaggttcctgcaatcagcatgcccacatggtcataatacagacttagcaacctggaaggaagtctcagtgatctgtgacccagccctttctcctgatagaccgtggaactgcaggcagaagatgcacggcgtctcatctcagatacacagtggtggtgccgggatggtatgtgctctccattctccctggagggctcttggtccatcttgcttcagtgactagcatgagaggagtggtgatagcagcaggtgccgtggccactgggcaggcggggtatggagaacgcagccacacggccgccactcctgctatggaggcaccaggtcccgcaacactggtaccataggacagggcttcctggtatcacaggatttgccagagctggaacgtaacgcccacttcacaccttggagtatgattcaaagtagagtttgtagtgaattccaaaaggcatgtgattcaagctaactgccaagaccattcagagttgtggggagaaaaccccactgtgggcacgtgagtcagggaagcagcatggaagcggcttgggtaggattgtggcaactggaagggagttgggcgggccatggttacagatgcgggaagtggtcggagtggggaagaggacctgtctgattcccaggaagtgggcaggctccatgcagagcaggatcccccgtggagcctacacagccttgcacacctgaactgaggggcaacgaagaaggggtctttgtagttcccttggttaggcaagtcaccagctggaagtggcagccgagacccggcagggacaaccctgtctttcccagtgagcatctgatgatattatccggggcccgagcagctagggtagaaaaggagaagcatttaaacatcagtgcctcaaatctcctttccaaacatcccaggtatagaaagttacatcactcttgcaatttggttcatcaattgtcctcactgcaaagttgaacctaaactaactcctgttgggaggcagactagggacaagtgactttcagtgatgctgaactgtgaggctgaggcactggccatactgcctcccaaatggaaccctcgtttgtgcaaatgcccccggccagggtggtacccacacacatctgcacatgactttctcagtctcctcctaaattatccctattctttttgaaaacataaaattaacccaggtggaagtttgtgttgtaaaacatggagtagttttcaatattgtaataggctcttcaagaagagcagcatttgcccacaatctgaatttttagaaaacgtctaaaatctcgagttatcagcaggacgatatccacacagtagatacatccctaccggactcagtggcaaattatgacacaggccaaggtctatccttgcaccatctgtcatttctgagtcttcaaagagctcagagatgtcctctgtgtgcctccttacccaggcaggcagcctaaactcccagggttcttcccaggcagatctcagccatcctgggctcaggaaggcattccaggaaaccagaacgcaagggataaaagatggaggaagtcacctcttttagcagagtttgcactttgatgagaatgaaggctcacgcccagggagaaggtggataagagagacgtttaagcaccagctctaaggtagttgcagtttgctgggctgatttgggtgctcctgaaggatttgttgtctggggactcttgcctggtgcccaaggctgtaccttcttgcgcgtaagcctgttcagctctcggcccgtgtggcatgcaggccacaggagaaggtgactccagcccctcctccgttgactgcatttctcactgagcgtatatctgtcttgccttctcgcagattgttttcacgtggcatttcacttaactttagtctggattcacattttttttttccagaaggtgagattcttcttcaccaagatgtcacagtttgggcaaagttcaaagttgcttaaatttcttcgaagggctccatgagcagttgtactccagcaggactgtcactccaaattggactctccagctggtcaggggcggctttccaagaatcttgatgtcccagagcccctctgatacagtatctgaaaggccttttttgaatgtttggaatgctcttgtctgagagatatcttaatatgaaagcaaatacctgaagcataataaaagcttgtaaagcatcaagaaaagaaacgatctcaggaaaacctaatagtaactcgtgatccagggacatataaaactggagatacaccgtgaaataaaaaatgtcaggtacttaacagcatgcaaatgactgaagccaaaagaaaaagaaagaaaagaagaagaaccaattaactatgagagtctgcatccttccccagggccagtgttaatttccatcgctgtctttaagcacatcgttttgaaagagtgtgctcgggttcatccatcttatttcttctgttagcctcagaaagggagaaagtaattttcctacattgtcagcttctttacaaatgtctgggccttttctaaacagaacccccattgaatagaggaaaacaaccattctcacactgaatgccctctttaaccctaaatgcttattcagtcatttagcacctctcttcctcgccttttttcccttctgaacatgacctgaaagaagatgttggaacccccctgcatggcggcgggtggcattgccctgccccattcatctgcgcgttcatccgtttctcttacggagcagcctcaatgctctaccgatgtgcgggtgccaatctgtctccccgaggttattcagcatctaacgttgctatttaatctccagatttctaaacttgcagcagactggctgtgaacaggccagattatttgtttcctcttaaaataagtgcttgatggttgggttgtgtggggccggtccttggtggtcactgcatgtaatcaacattcatagactgtaggaaaatgtggtttaatgaaacattctgccactttttcttctttggcacgcgttaagcagtgcgtgcaatgcattgcaaatgcaagtaattcagagtttacaaggaaaggaaggagagtgaggaaccccagaggacagggacgtggggtggtgggacagggcttcaggctgatttatctttcatacagtagtttggccagtgggaacgcggagtgggaggaggctgtggctgcctgctcttcccaatggggaggaggctttacggtcctctcagcggagctggtgtttactaaaaggtctttcctaaagagcccaccgaatagaaaacgtctacttcccgtaggctcctgagaagcttcctgaagtcagtgagcacgttctgcataaaagctcatttgaactctgcactaatttgcctagcaattcataggaatcaatcatctaatattcagtccccatctaatgaatggctgcttaaacacactagtttttttttttcattgcattgggttaggaagtttgcagctggtaaattaaaataggaagcagtctttggtatgaaagtggcatattttaagtgccttggaatgcacttgttacaagtgctctgctgttatgtgagcagtagtttaatgtggttggctgggcgtagtggctcacgcctgtaatcccagcactttgggagcctgagatgggcggatcacgaggtcaggagttcaaaaccagcctggccaacatggagaaaccccgtctctactaaaaatacaaaaattagctgggcatgggtgcacacgcctgtaattccagctactcgggaggctgaggcaagagaattgcttgaacctaggaggcagagtttgcagtgagccaagattgcgccactgcactccagcctgggtgacagagcaagactccacctcgcaaagaaaaaaaaaattaatgtggttgaccattagaaacacaacatcaaaattgttttggagccatcttagttggttaagattgatgtgcaaaaatcaaatatttggcagttataaaaggacataccatagattttaactaatctcttttatgtagagagtggcaaaaaatcttaatgctttaatgaaacctactttacaatcacgaatgttatttgtattctgtgaacatattgcaatgtacaagcagctgaacaatgaaataaatccaaaatccccaaacacttcccagtcagctcagcctcacaggtgtccattgggtccttggttctttgcttcctctccatccccagctttcagcacattgctgtgtggccgtcttgaaggaaagcccttcattctcttcaccttcgctcaggtttcctggctcactggctatggtgaataatttatccctctgattttaatgagtgtattttattgtgtttttaaaaagtagggacccaaactgatcttcatgctatctctttgtttaaaactatatttgaaaaaaatacttccattaattttttagatattgaatccagaagcactggtgatagcagcaataactaacatgtgtttttcatgaataggtggcaattattgcaaaaaaatgctttacatacgttattgcaattaatacagccaccaccttagtcgctgttattatacctaccttgccccagaacagtgaggcttgagcagctaaaaccacttgcttgaggtcttctaggcagggagtaccatgaaacccgtgtccactacagaatgcctggcgctgctctttttggctctgagtgtgcttacgattttttgaaaaacatttcccttgagacatccttttcttatagtatttgtagttttttcagcatatataaatatataaattgaattattataacataaacttataaattacattctctaatgaatggattcaaggctcctggcagagatactagtttttatgcttgtaatcaatcacacttaaatatcatgcaatccaaatgctaacaaaattactctgtccccatttggcatttagaaaacatcaaaaacatgctgatgatgccaaatagggtttttaagaatggggcgaaaggtgaaggtgtcaagtgcagcgaggattcctgcagctctttccttgtgtgggggtatgtcagcgtcagtgcaggctgcggtgtctggctctgtccttctgacatctgcggtggctgtggtccacctggagaggtggttatgtaggactcagggaaatacataattgtgagcattccatttattcaggttttagaaatgaaatctacaatcgcatgtgcctttctcatactctgtagtcgcagatctgatgagaaaagtgagagacagaacagagaaaaccctcactcctgggtcgggctttacttcttgactgtccaaaaaaggaaagatataagattttgattctttcttggaagctgcatcattactttgctttattgttcaagaaattgaataataggattatataataataatatgtaataataatcctattattcaatttcttgtcccttctgtttagtcttggggtgtgtatgcatgtgtgtacgtgtgtttgtgtttcacttttctccttgatgacatttaagactgcacccatttttatgttccaggtgttgtagatcttgtcaaaatggctgtctgttccttggttaccttctcctataatgacgcaagaagaatggttgaatttaaaaggcaatacatttagaaccaattaaagagaacatttttagcacagggtgtggcgcttacaagagttcataaaaaccgaagttgctgggaatgagttgccattcacctgcactagaaactatggacttgtgtcaacgatgggtcctttggggaggaaatcatctcatcacctgtgattcttttcttgttatcagagggagaaaatgttggcacagcttccctctagaaaaagatattgttaataattggttaattatgaagactgatgaagaaaagacattacagctgagatggttgggagggagagaatgtctaggctgtgaagcaaaaggaactaatgattagccagcagggtctgacaaccaggttacggtcagcagccccaggatatctgatcgtgtgggcacagcatggaaaggaatgcctctgaattggcctactaagctgaggcagaacaggcagacacactgggatttgagccggggatagggtgtggtcaggtggagagacagaactgaggccttcacatgtttgggggttctaggagggacagattctgtccagcctaccttttctcaatgcattaaactttggcaaagtaatcaggttgcagaagcaacattagagtatcctcctttagctgctgagttgggggtgaagtgggctgtaagccccggggcagttttcagaggacaggctttgagactgcctgaaagattcatcaccttaaggataaatttcctggaggcgaactagaagatcctgtgcattaacagaacagtcaatgcctgttatccaggaactgatgtgaacatctgacagcttctgtacctttcaatcttcaagcactgcatggtgaattttgtgatttaaggaaaccataaatgaattagatcacttttttccttccaaatgcgagattccaaatgacagcagaatttccgtccacttcctaaaagttaaaggtagaactgcttgagtgaggctaccagtgctgaactggcaagccaatcgtggccaaagctctcaaggtaaactgaaatgatcaatgtatttatagtaggataatcaaaatttatttattaaagaaaccaagatgagaccaagagcatccagtggccaatattgatgtgcctcacttgaaggcatttcaaaccatctcgccgctaaccaaggtacagcaagattgttcagctttgctgaaaatgacttgaccgtagatttgcttctggggcaaatggattgtaaattgctaaaatgacactggtttgaatggcctgaaaagaggaagggaactgctgcttccgtgttccctgagtgccttgtgtcattacctcatttactcactgcaacgccacacactttgtggcttcctgattttacagatgagaaaaccaagattctgaaggagtatgcagattccccaaaggcacacagctaatcagcggtggagcgaaattccaaacagctccaaagactgcctgtctccaaggggcatctcactgcatcttcgcaagtgcacaggcagcgtcagtccgggcactgaaactgacagctgctgcggtcttgattttgagacagtttgggtctcagccagtgctattcagcggcttgaagtccaaaatcacacccgtgcacatgtaggattgttgtctcacgtatcagtggacctgtcccctgcagggaagagttgataaatatggcactctgcttcacttttcttgtttttgttttagtttttgtttttgaaacagagtctttctctgtcaccctggctggagtgcaatggtgcgatctcggctcactgcaccctctgcctcctgggttcaggcgattctccggcctcagcctcctgagcaggtgggattacaggcgtgtgccaccatgcctagctaatttttgtattattagtacagatggggtttcaccatgttggccaggctggtatcgaaatcctgacctcaagtgatcctcccgccttggcctcccacagtgctgggattacaggcgtgtgccaccatgcctggctaatttttgtattattagtagagacggggtttcaccgtgttggccaggctggtatcgaaatcctgacctcaagtgatccgccagcctcagcctccgaaagtgctcggattataggcgtgagccaccgtgccccaccctctgcttcacttttctactctaagttcttttaaaagaaccatgacatggcagaagaagagactgatgaaaggtaggcaggaggggcactgccctgtctttggtcccaagccttttcctctcttatctgcagtcattcctgttaaggttatttccttgggaaaattccacacccacaattgtctgttcccaagcacaccctcacgtctgtgttctaacacccgcttcttacctactttctctcaataacaataaggtaagaagtaaattttctaactggcagacaggcgtatgaaaaggtgctaaacatcattgctcatcagagaaatgcaaatcaaaactgcaatgaggtatcatctcaccccagctaaaatggcttatatccaaaagacaagcagtaacaaatgctggcgaggatgtggagaaaagggaaccctcatacgctgttggtgggaaggtaaattagcacagccactatggagagtagtatggaggttccttaacaaactgaaaattgagctaccagggaaaggttttaacaagagtactgctaccagctgtaccagcctgcgatacatgctaaggactcaggtgctacgtgagagagatccagttaaaaccccagcttcaagatttaggggctgtggaagcttgtacgagtttcttggcaactctgattcacattttccggtgagacccccatctctactaaaaatacaaaaaattagctgggcgtcttggtgcacacctgtagtcccaactactcgggaggctgaggcaggagaattgcttgaacccaggaggcggaggttgcagtgagctgagatcatgtcactgcactccagcctgggtgacagagtgaaactccatctcaacaaaaaataaaagatgaataataacctccaagtgctgttgtggggattaaatatgagaatatgtttaaatgcttaatagctggcacttaaacataagtggaaaaagtgatcatgtgaccgctcggcaaatatcgctggtaccgttagttggtttgggctgctataccaagataccatagactaggtggctcaaacaacagacatttatttcctgaagtttcctgaagttctagaggctgaaagtcgaggatgagggtgcgggcagctttggtgtctggtgagggctctcttcttggtctccacaccgggcaggaggggagagagagtggaaagaggctctcacctgtctcttctcgcaaaagcactaatcccatggtgagggcctcaccctcatgactcaccacttcccaaggtcttaccacctgataccatcccactagggtgacgatttcagcatggaattgagggggcacacattcattctatattttagattgtgctacttgcaaataatttcactgctggaaaattctgaggggctggtcaataggaagtgcatgtcattgcaattcttatttgcagtccattttcccatgggttggaaagtggggaggaaggcatcctactggtctgggaagatccatttgctgatacaggtaagcagatagaggtggatttcccaaggtggaaatcctaaggtggatttgcttagtcttgggacctgttgctgtccacgcccctaccttgggctttgctgttcctccttccgccccacattggctgagagcccagaggtcagctatgcttcccattctgtgtggactctgccatatgcatccataaaggccactgccagccacactctgcatccctcatttatggtccctggaactgggaccctgtctgtgctaccccttgcttccttctcctgatgtttccaactggagagggagaggacattctcattccagagcaagccctgctgctccctcgttccatccatcatttcttcgcatgcaaagtaccttctaaatgccaccagaaaactttctgtcagtcagacagacatgcttttgaactgaaacatactttgattagggagcaaggtgagccgattctttctgttacgtatcagcaaatggatcttcccagaggggtagaagccttcctccccactttccaatccttgagaaaatgggccgcaattaaaaagacaagcacttcctgtttaccagcccctctgaattttccaatggtgaaattatttgcgagtatatctcactctttctcagaggttggcccagactcccaggataaaggaaagaccatttgggtcttcacatactgggaggaaacaaaactgaagacttttcaagcctctcaaacctactttacagtgattctctctttcatctttctttttttttctttgagatggagtcttgctctgtctcccaggctggagtgcaatgaatggcgcaatctcggctcactgcaacctccacctcccaggttcaagcgattctcctgcctcagcctcccaagtatctgggattacaggcactcaccaccatgcccgtctaatttttgtatttttattagagacgaggtttcaccatgttggccaggctgctcttgaactcctgatctcaggtaatccacccacctcagcctcccaaagagctgggattacaggcgtgagccacagtgcccaggccctccttcacacttttaattgggaccccccctgtgtcttgagggactctgagtggcattacagtggagtcactttgccattaatcctatcactgagagcaccaagcaggtgttcatgcccaggtaggctgagcatctgtatcaaggcttcctgagctttcctgtgccttccatcgtcacttattttactgcaaaataacaaatgctttttggggatacactaaagctaccacacatttaatattgactctggagtttcaagtaacttaaaatctactaatctcagtgaactttcgcccagagtataatgttttccattttctatttttcctttcatgtagttctactctagagatggatgtgagaaagataatacaggaaccatcctgtatctcagcaaactctactgaaatcagtaggtatcatgtatgtgcatgcacgtacacacacacacgtgcacaaattagccctgtaatgttattccatgtcagattgttgcctttggccaaactcagcgattgtgaatgacatctcctgctcggttcatgtaacgtacaggagacctgttcttagcatttaccattatccttccagtcttgactaaggttgggtgcacattcacagagactaccaactctcgattcagggtttgaaaagtctgaatggttgtgtattaaatggaaaagatcagaccaatattccctagccttggatgaaactgtttgtttgcaaaatgatgttttagacagaagtgagttttcagaacattaaaagattccagtgataatatttgcaaatcctttcatctgcatgaaaatttagcaactaaatctggccattaaagcataatctttatttgaccaaagcatgatataaaaatggaataaactataatttatctttgctgacagctaattacctggaagtctgattaaagggaaaactaaatttacttaattagtgttttggtgtttaatctgtatacatataaatatgcctatctcctctcctacatgaacatttctagaaataaattaccatttttattttgtccctttcagatgctgccaaactgagggcagcattagaagaatgggtattttagcaacaatggtagcaggtgtttgtagactgtgatcccattagaggagcagagtgaggtaacacaagaatgggatgcttaccacaaagtagttttcttttttccccaatggctcctcctttaactgtgaacaagaagagtgccaacttgtggagtgaaccagccctgccaatgaatcctggcttggtggtggaaaaatctgcatataattaagccccttgaggcaagtggactttgatagacaagaggtggctttgaaaacgttgaaatcatttgttttttagcagcagtatttggcagtgttgccttttgacggtttgaggaactatgctgtaagtacagccaaaggcagaggaggttttatggaactctcagctcccacccccacctcctgatgctgcaaagttctcccactagatgcaatttaaacaggagacatatgtaacacacctcaggtggtgtaatgaaatcatcctcttttctgagcttctgaaagtcaaatatacttatattaattttttaaagtgatctgaaagtcatacgattctattcttgaaatagagaggttttcgttacttaagtggcagacttactgacagttcagttataggcttacaaataattggactaaaatatgatttttataaagcattgtaggttttaatcaaaatccctacagaaatgaaagtcttaattaaatctgaaatcctacttcccagacctgaagtttccaatatcattttttattctcgcccaacatcctctgtgattaaaatagaacataagtggtgaaatcgctgattatttaaaggatagcatcatagaaacaaacccaaagcacgtagaagtcattttagactcatgaaaggtagaagatgaaagaggcttgcacagcatcttcatctcaggaagacttttgggtcaggttctgttcatttcattatcgtcactcttctcggttgcataattggaagttctctaaaataactacttctgacaaaatttctaaaagttgctgagtggaggcttaaaaaaggactaatatccttaatgatttgataaagattaaaatcacagtttcaggaagggttactttttgcctacttcacagacattcaccctcttctctggtagcctggacagtcattttctagaaccatcttccttctttattctgccatttggctgaatgacccttaaggtgacacaaagtaaagggactatgacaaggttaacaaatgtgcaacacaagttgcctgttctctgttgtttcgatgaagcattcagctcaatataaaaaactatatctcattaatacaccttccaactgggcagaggatgggagcacagaggggtccacagctgtaagtggaggcaaacatatgccatgaaacccaggccagtgaggaagggggtgacatgtggattttaatagttaatttttgttgttgttgttgtttgttgttgttgttttgttttgttttttgagacggagtctcgctctgtcacccaggctggagtgcagtggtgtgatcttggctcactgcaacctccacttcccaggttcaagtgatgcttctgcctcagcctcccaagtagctgggattacaggcgcacgccaccacacctggctaatttttgtatctttagtagagatggggtttcaccatgtcggccaggcttgtctcgaactcctgacctcaggtgatccacctgccttggcctcccaaaatgctgggattacaggcatgagccaacacactcggccaatttcttttttgatgtccaggtacagagaagttgacattttcatttaaacacatacttgacccaaggacacaattcctttaatacggctgggtatgctaagctatggatcatcagtgccacagtaaaaatggacttgtgtttataggttgtctcctggagattgttgtgaattatatgcattttaggaaataataaacttgtaatatgttcgcctgtgtgacttaacgccgtgtcagctagagtaagtgtgcagcacatccaaaccggaccttctatggctttaatacttctgaagacctctgtaaagattcttccttctcagtacccaagtgctgaaaaaaaacatgtattattataggtcagaattagcattttagtcagttattctagaagtagagtaaaaaacaaattttcagactcacttatgtatttttcacatgggtaatcctttgagtcaggaaactggctagagttacattccataaataaaatgttttgatgatgatgccaacttgggcatggccttgtctcttaacttaggaggaggacaggcagacctggggggtgatgattaagtaaaatatcagtcagacagatgaaccgtaggacaaaaccaccaccaagggctgtggggatggagatgagaccctggtcacctcccctggagaatgtggagaagacttcaccctatggttgatggacatgtggtctggggctggaaggttcagtgggattttaggaaggggagaaggaagcaggaacaggggaaacagtttgatctgagacactggtgtaaggttgggataattttcagtgacatggggaggaacacggccttgaagggtgggagagtggtcttccattcatgacttactgagcctgtcatatgtgtgatgcagtggaatccacagaggattctgtcctggatcacacgcaaacccagccttcatggagcttgtgtgtggtatggcgtgctaagtcgtagacccattacttaaaatgactgtgttgttaaatgtcaaccgagtatcatggagacattcatgatgggggactactgtggtctagatcagcggtgtccactaaagacatttgaagacgggctgggggcctgtggtctgacccaggccaggaagatgtgtagttcagagtgagttgggtatcactgctctgccttgaacaggtgcaccctggtgttatgggactatcaggttcaactgcccgttgcatggtaacagaccaccagtacaccaaaacagcaggatgtggagcagacaatgtgtttaataatcatagggcagctgaacaaggagacaggaggaaacctcaaatccgcctctctgaggagctttacatgggtgtttttaagggaattttggttagggggcttaggagctggagatcactgactggacagtgtgtgggaaatgaaatcataaggatgtagaaattgcactcctgcgctgaggctgttcctcggagggcattttcagatgggctggagtcagtgggcccattggactgtaggttctggaaaatatctccaaatggaaaatttgaggtttcttaacatttaaggtgttacctagagaagttaggagcatgtgacgggggcacgtgacttctaagcagcaagcagctatcagaaagtgggccaaaggacaagctggttaatgcgtcactgtgcttctacttaaagcttatgcttttgttaaaaatttagcaatttggttttattaattttatgaggacggtttccctggtgagcatttggctccacagagagggatccaacagctaagagtctgcagtagaggcgggatcccacagcttcactgatcaccccattttcctgtggccccaccaccatctcttctcttctcccaggaccctagctcgggtggaaacagtggggaggccttggtctccagctcagaacccaggagccaaaaatagcagctgagtgtaaattttcattaagacaggggattagagatcaaaaggggtggcctcccactctccagaccccaactcctccctgagtcagcacccccacctgcacctgcacctggagggaccctgcctgcccacactcggtggtggccacagcctgcatctagcagggtgtaccctgtgccaggtggcaggagagcctggaatgtgctgtcagttctcagctgatctacaagggtaaccacagtcaaagccattttaaggaggggaaagttaagtaaggaagaggccaattaatgtgcccatgaggatgttaacaagcagccttggaattggagccaagacaggactccagagcctgcatggggggcctctgggtgtatcatctttgctccagctgagcaccggcttgtctcaagaacaggctactgcatggcacctctgctcccctggggtcctggaaaggttccctggtctggggcatctgctcccagccctctggaaggtgggagtgaggatgatgacatcccagcagggcactggccgaccagcctgctcctatagcaatgccttcctgtcctcctgcccactgcccctttgggcactgctggtggccagcactggcggccagtgctggcctcttctccctgctgcagagctgcttccataggcggacctggtcagagctcaagtggaggggaagcaaaccttttggagtgtcttgggttacctccttaaacattaaagacaaggccgggcacggtggctcacgcctgtaatcccagcactttgggaggccgaggtgggcagatcatgaggtcaggagatcgagaccatcctggctaacacagtgagacatcatctctactaaaaatacaaaaaattagccaggagtggtggtgggcgcctgtggtcccagctactcaggaggctgaggcaggagaatggccagaacccgggaggcggagcttgcagtgagccgagatcatgccactgcactccagcctgggcaacagagtgagactctgtctcaaaaaaaataaaaattaaaataaaaattaaagacaaattaaaaatttgtccttaaaaatgcagggacatggatgaagctggaagccatcattctcagcaaactaaaacaggaacagaaaaccaaagactacatgttctcactcataagtgaaagttgaacagtgagaacacatggacacagggaggggaacatcatacactggggcctattggggggtgtggggtaaggggagggagaacattaggacaagtacctcatgcatgtggggcttaaaacctagatgatgggttgacaggtgcagcaaaccaccgtggcatgtgtatacctatgtaacaaacctgcacgttcttcacatggatcccagaacttcagtaaatttttttttagatgcagatgtttatgcactgacttaaatatttaataaggcatgctttaatttgtttgtttttacttattgttttaaaagctagagtcctgaccaatttgcttctgcctccacacattttgtttttagagatataaactacaagtatatctcagcaatatgaggccaggaaagagatgctccgagcatgctctgtagccgtggcccctgggccagcagcatcagtgctacctgtaggcttcagacctgcagaatcctagggcccagcccagatgcactgaatcagacctgtattttaacaggtcccctgggtgacctgtaaccacattccactttgtgaagttctgtttaaagaagcaggcctgggatttgcttactattcagtgaaactttcaataaagcttcttttctcttcctccgtgaacggcagttattttctcgtagcaagagtctggactacagttgttctgaatcttttgagtagatattgaaggggagatacatgagcatgcaagcagacgtgcccagtatagcgagaaccagaataatgaacccctgcaaagtgggagggcatttggaaagagtgcacgctgagttcatccccagcataaaggaaccagcccgttattctaatctgatgagggaattcttcctgacaattgagtgatggaaggaggcattttaaatctttccatgtgtgtctcttctggcaagtggacagggcttgtgatgaatcctaggtctgataccagggtctttaatgtaaaagacaaaaacatactagacatctagcctattaaacttgaactccagccaaataagagctgatttcctgctgcaaatcaacaaaagacctcctgcacatggaagacgactctgacactaacactgatttagggccaggaagcctgcagtttaaattaagctggaggatactagctttatatgaaaatggcaggcaagtgtctgtggctcacagaacaagtatgatatacttttgttgcaagacctttgcatagaaaatcatcttcttttagaaaataaattccgttgccaagttttgtttcccattctactctgccccttaatgtccaaggagaattctccctgaagtccttgaggatggggcttattcagcacatcatagatttatgaagcctttgccatgtgtcaagcactgtgctaagcccaggggattaagagcaacaggcaagccacagtctccctctgtgcaccagccctggctccgtgaaatcaggaaagcaggaggaaagaactcaaagtgcacgcctggggaagtatcactgccacctaaacccttcttctcagctatcttccctatccaaccactagacacactggtgtttctagtcgtctcaacttgctctctttctatgagttccacaattctcagtctagtaataatagccaacatttcttgaatattgtcatgtgtcatgtgataagcccagtgtggtgttttatatgcattttaccatttaatacaatggccgtataggaggcactatctttaccctattttattgatgagatattagggactgggacagacactcctcatcctgagcctaagccactgcaacagcttgtaaactttcccttccaattccaagctactcctttccagtatatcctgcaaatggcttccctattaatattcctaaattatgatttcgctgggtgtcttttctcttcccaaagataaacactattttgacaccttcaccatccattcggtttggcttgctttggaaccctgtataaatagaatcatgcaatacatattcgtttgcatctagcttaatttgcctaagattatgtctgaaagtcgcctcacatgtagtactggttcactcttcgcatttctgtaaagtgttttgttttaggaatgtagcaccatttattccttctgctgttggtggatgttcatattgcttccagacttgatcattatgcacaatgctgcgggcactcttgtatgttcagtgcataagtgcatgcgtttatattgatggttgtgagctatgaacatgttcagctttggttgattctgccagagatttccagagtagttgcaccaatttatactcccatcagcagtgaaccagaatgtcattttctttacattctctcctcacctgcccttgggaggggtgaggctgttttggtggtggtggtgtttttaccattctggtaggatcccattgtcattttgatttccatttcttaggtgacttgagcacctttttagatgctattggccatttgggtagcctccttagtcaagtacctattcaagttttttgctcatttttaaattgtattttatttgctcattttgtattatgttgttattgtatggctcccttatacttgaactacaaaagttatttatatattctaggtatgagaccttcatcagatacattattgcaaatatcctttctctgtagttggccttttcatataatatttttcacaatggtgtcttttgatgaacagaattttacaattttgatgaagtctaatttgttaatctttgcttttttagagttttaatgaaatatctagtgttattcaagatcatgaaaatgtttctgttatttgctagaagctttattattttaccttcaacatttagatctatgatgatccagaatatctttttgagtatggtgtgaggtaggggtcatgattcatttatttgtatatgaatattgagttcttacagccccatacagtgaagacaccatgctttcccccacattactgctgtgaaacatttgtgagaaatcaggtgacaggtggatctagttttggactttctatctgttcccctggtttgtttacccctggagagaaatcacaatatgtaagttactatatcttgttaactggtagtttaagtggtttagatatcatctttaagattatctttattattctttgccctttacgttttcattaaaattttagaatcggcttgtcaaattacacacacatactcactcacatagtggttgagattgcattctatgaaagattaaattagtaagaatttacatatttacattataaaattttccaatccatgaatgtgatgtactcctccatttgtttagatcatctttaatttctcttaacctcattttaatgttttctatgtaaggtcttgcttatttttatgaggttcattcctaagtgtttgagggttggtgaggctaatataaatgttttattattttatttccattttctgttttttctatttaatttctattctgttcattttctgtgtgtttatatgagtgaaatggaaatacaattaacactaattttatattgactttgcattttcttagtccttacttaaaacttggcattttattttatacagttttgtaattttatttggatgtttatttttcctgttctcacagtacttagcccaatgttgaccaaataaatacttaagtacttgtggatttgttgattaatgatttatttaaataacttttgtcctagctgggttaccttaaaagttctaacttggtctggcacagtggcccttgcctgtaatcccagcactttgggaggctgaggtgggaggatggcttgaggccaggagtttgaggttgtagtgagctgtgattgtaccactgcactccagcctggacaacatagcaagaccttatcccccaacccccccaccaaaaaaaaaattctaacttattatatcaatcttttcaatagtcagacaattctatctaagaagttaaatgtaactgaattccatgggcttctcaatcatttcaaaaattacaacttttaaaacaaaataataattccggaagtagatatacacattttcctgcaaatgtttctgtactatgtcacatcttgctgaaggtcattttagttaaattaatgtaaaatgcagactgcatgaaataaagaataaaaagaacaaaagaatagcaaatagaaagaattaaaaaaacatgggaaggcaattagcgaattttgttgaaatttgacactacttaattagcagctcaaatttcctgaagcttgaggctttaccatctagacaatattacattgaattttgggggtttaaaaatataattaaaagtttattggacaaaagttttacccacacctagcacatcatagacaacactattgataaaatgaaattaagctactgtatttgattatcctcataatatattttaaatgaaccatgaacaatgaatagctgacctatagtaaaagcaagaggttaaagtaaaaagaaatgtatctaaaatgaaaaaacatacacagtagttttctttgattttaaaccaaacatggatatgcctgtttcattaatgcattatctttagaaagtaatgtggggcttttttttttttttttgcaattgaaaataagattcatttaatcagctatcgtagttcatctgttaaattacagcactttgctgtccattttgtaaaataatcttcaaactaatgaagtaaggtcaattgcatgcaattttattctagccaaattgctgttaattgcatcaacggctttggtaaggtcaataaatgttgcctttttacatcctctcctgaaaatggcagaaaataaacaccttttctctgtaatgtattcaggctcgaggcaactcatagcaggtggactattcgattttcattacctgatttgaaaatgttccatttctaaagaattgtgggaggtattggagtcaccaaagcacttttagcaaagatatcttttagctgggcctggtggctcatgcctgtaatccaacactttgggaggctgaggtgggtggatcacctgaggtcaggagtttgagaccagcctggccaacatggtgaaaccccatatctactaaaaatacaaaaattagctgggcccgatggcacatgcctgtaatcccaactactcgggaggctgaggcaggagaatcacctgaacccgggaggcagaggttgcagtgagctgagattgcaccattgtactccagcctgggtgacaagacaatgtgaaacttcgtctcaaaaaaaaaaaaaagaaaagaaaagaaatctttctcggaagtgctcccttgttactcttgaattatgtcagtggtgtccctcaaatagagacaaacttatactgaacaactcagagtagattgtggaccttgacttgttaagattttaatttttatgataatcagtctagagcagatcatctgttctcctttaacctgtcttacaacaaacagtaaatgtttgtatgtcagctcaaccatagttatactgtgaggtataccagttggctcacctgctcagccgtgcagcctaggtcagtgtaaggaggggatatattacctggacccatggagggttaggacctcgctgtggccttattcctgctgcagacctgacccagtctttaggacttgatcacatctttacaagctttatgctttaagatatgcttttctaaccatctcaatttgtaaactgtgaacactctgtggtttctgaaatggcggagatgtgtctgaaaggtgtcatgtgcgccgtattacaaagaaaccctaaaaacagcaacaagtgagagatacaggtggaagtaagagcagtggctggaggcagagagagactgtggcaagcggatggcactcgacgtgtgggggcagttccctaggacctctgggagagttgcacttatcctattttccttgccttcacataaggtcacaatcactattagagtctgtttgatatactcattactaatattgattttacagttcaagaaacaatatttcttcttttgttttgagatgaagtctagctctgtcacccaggctggaatgcaatgacgtgatctcagctcactgcaacctctgcctcccaggttcaagcaattctcctgcctcagcctcccaagtggctgggattacaggcagccaccaccatgcccggctaatttttgggtttttagtagagatgaggtttccctatgctgaccaggctggtctcgaactcctgacctcaggtgatccacctgcctcggcctcccaaagtgctgggattacaggcgtgagacactgcgcctggccaagaaacaatattcttcttttaaaactgaatgagcagaaatactgttagtagccagctgaattcaggaaatgtgatgcatgtgctggtgcacatacccaagaagactgaagacagcatagaaggacagaacaaaaggccagtgccaagggtggcagagggagtccttggtgcactctgggacaagccccctgcgtgctgggtgtttcgggtggtctgtctccatgtgcaatatcagtcatgtgaagccttaacaaggcattcatttagttagtatttcagatttgccaaccctgttggtgttgggataagggttagagatacagagaagcacccctgccccggaggagatcactgcctggtgagaaaaccaggatgggcttctactcaccccttcaagtccttgatgaaaggttccttctgcaggagcccccagcccctgccttctgctgtgtcctgctcctcctcacctatgctcctggcccctcttcccctgccttattctttatggcaccattgcctttccagcttagtttcagtggcttgctcattttcatttctcctcactatcacacaagctcccagagagcaggaggtcttgtcattttttgttcatttgtttccaccaagatacttagaacaatgtctggcatggtgagccctcaaaagtatttatggagggaatgaatgaactcgtgaataaatgaatgtatgaagtactaatagatgggtgagcatggaactctatgtgatcaagtgtaaaaggcactttcccaaacacaggacttaatgagaggcagtcagatagtcaaacactacagcacttgagttagagaaacgttttgactaatcaaggaagcctttctgggaagtataaatgtctgcattagaactagaaagtctagaacgccgtaggaaggtacagaggacaagaacgatctccttgggcaggcagaaatgatcgagctgcgagctgccggaggaccgcatgcaggggaaattttgcttttctgagtgctgcttggctttgagatgtaagatttagacgttagacactttctagctcattttactatgccagtagtgatcctccctttcttatttctttaagaattgaagctggcatgaatctgttttcaagctgccatttagaagttggaatagtgtgttatattaactttatttattcttaaaatatcatcttggtgcccaggatgacactgcctgaggagctatcaaagagccaatccctgtgggatttgtgagaaaattcagccatctctagacctccaattccaaacctctttcatctcccaagactctatactttgatctaacctcttgagtgacttccttcaatttcttcctttcacagcaacaatttcagtcccagggcatacacttatacttataaactatttctggggccagcttgacctcaaacccgtacaagatgatcgttccagacagagaaattctcaggacatgaaaactttcttagaatgtgctgaaatagggttgtgaatgcgtgtgttgctacctctgaaaacttgatttagtgctgtccagcaaaagtcttgacatcctatgttagttggctcagctctatacaaagaatctgaaagcacggtagaagatggttggcttgtgttaggttagaaaggcgtaacaatgagttgttttctaagtgaccagcatgtgtgatttatgactgtattccagaaaaattcaattatatgagataaataagtacagagttagtatggggcttcagaataacaggaagcagcataaatattgccctcgcccaccagaattcatcactgatggcctgctctggccctgccttctgctgtgcatggaatttttattgagcttgatgagattctgtgtaataagatgctggattccgggggctaatggcctacgagaagatttgagtgttgagattctgtataatcagatgctgaactccatgggccagtggcctattgagaagatccgtataataagatgctggattctgtgggccagtggcctatgagaagatttcagcattgagattctgtatagtaaggtgctggattctgtgggccagtgggctatgagaagatttgagcgttgagattctgtataataagatgctggattccgtaggccagtggcctatgagaagatctgagtgtgcctactggatagttacctgctggaatgcaagttgtcactgcaagattgatttctagtgacaataacaagcagaagctgactaacagcacactgcccaccatctgctcaagatacccaataaagtgtatttgttcctcattttctcggaaaagtctccacctgaaggtcacagtgagatagaccaccacagtgaaaggacatttgaggtttcttcctgcctgcactggtgatgacatcaggaaacttgtgaaaccacggtcttttgtttacattagaaaatgcatgtgagatgacaggtcaacatcagcaaggcataacttaacagagataaaggtaatgctttctgttggttagaaaaagcaaaagttttgaaaaacacctgagcaaagaaatcttgagaataattgctagccaaaaaaaaaaaaaaaaaaaaagaattggggtcatagggaccaacattgagacactgttgttgaagcagcaatgaataggtattttgtccaaataaaaggacgtaatttaatcattgttaatgtattgcccatcattggtaagccctcgggcatacacttacacttataaacttatttaatccacacatagcattatgaaggaggcattatcatccctgccttacagatggagaattggagtagaagaagtagtaggtaacttgcccaaagtcatagagggtatcgacttatcgactgcactgctgagtttagggtctgcagtttgtctgccatgatggctcacatctggagtgtcaggttcagccctagaagccacgttgtctggtggtgaacactgaccatcttgcagtcactgggtccacaagaggggaaccactgtgagaaggtgtcctgtgaccaacattgttgaggagtatctaaagggtgaattcagggaggttgtgctacagccttaaaaacacataaagtaactcagcgtcatcctttcttgttcacactggaagaactgaagtcaatagctggtcctagggagatgaataccaatatgagagatgcaggctgcacagacctggaaacagcttctgtggcttcgctcaggaaagaagccagacagccttctctcagggctcctgcaagtgggattcctgccctgcgggttcccaggtgaacacaaaagtcagttccaactctaaaattatttgtcattcggtacaacaaagataccactgcctccctagcaatagagttttttgtttgttttttgctttttgagacggagtttcaccctgttgcccagactggaatgcagtggcaccatcttggctcaccacaacgtctgcttcctgggttcaagcgattctcctgcctcagcatcctgagtagctgggattacaggtgtgctttatgatgccatgctattttttttttttttttgcatttttagtagagatggggttttgccatgttggccaggctggtcttgaactcctgacctcaagtgatccacccacctcagcctcccaaagtgctgagattataggtatgagccaccatgcctggccgcaatagagttttaaatccttctagaaggtactccctgagccaaccttgcactctctttgcaccccatggttattctgatgaggcagccattcaaggccacctgggctggaggcctggctgctccgagtgcagccctgctccactacatcagcatcaactggagcttgtttggagtggagactcttcgtccctgcaccaaccatcactgcagttttgcagggtctcagatggttcccgtgcacatgaaggttggattcccacatgaaaggctgtcatcataacccacctggaggagctttcagaagactatggtctaggtccttcctcctcccctccacccattgttcttggtgagccctaggcattgccagtgagggtttccaaagctctcccagtggctacagtggcagccagcattgagatgccctggtataaggccacagaagccagccacagtgaccagccctcctgagggttggccatgaactgatctctagggctctgttgagccttttgaacattgtttagagtaagaggaaatgtagttgttataagaaatgctcaatgttccagaagtgctatgagttactagaacaggaattttcaatggcagttttattccagtttgtccccagtgcttcaagagagggttgggtagggctttatgtgtttggggaagttgctgaagaaagcagctgaataactgaatccttttacttataaaaaggttcaaagttgtccagctgaaatgctgaggttgggagccttcaaattgaggacctcagggttctccaaacagaaggcttgcaagttccaggctgaggctaggggagctgtctgtgtctgtggcccccatgggtgattggtcccctctgtctgagcacgtgcgcggaaaaccatgctccgtgggttgacagctggtggtttgcttatttgcttgttttgaaaatgtctattttttaagactctattgtagctgaatttaatataaatgctttcatttgaacatttggccatctttctttagctaacatgtgctcttatttttatttagcctatttttaaccattgagttactacaaaacattatctcaggtttattttcatctgttacatgttttaaactgtagccatctgtgtctgaaacatttttatctgctacaagttaatattttaaaatgttattaattgggtaattatttagctgtcttcaaaaaacaaaaacaaaacagcaatcctgcttttccagctagtgagcagaaagtcagggcggtggggagtgtgttgtctgtccagccctttgcttgggacgggagtggtctcttgtgcttccgtgccctggtcttacctcaaagttactttcttaccttgaagacccaccattaaatataaactaatcagcctatataaacacaaatataaccagtaaaaacaaacaaatcaaactcatcataagtataagcttttagaaaagactgttgtcccaactttgacaaaaaagtggcatagtacatcatttgaaattcaccatactcacatggatgatgtcaccatccccgccctcagactcattgtccatctgttaggaagaggtgcacccaccacaggcagagcacagctacaggcccacacacacttatgccgcactggagaaaccgacctgccagcccagctcatctccttgtttcttgaattacccagttcatgtatgagaacaagaggaatgtgatctgaaactccccagttaacaagctgtaaaactgcttgacgcctgccaggctgtgcgaacaaaccaaggggcaggaggtgagggcaggggcggtggggtggggggttgcattctggaagagtcccagggtttcctctgcatcccttcggtgagcttagtcgcagtaccttagtcacagccaggtagctgccgttctcccattcccaaaggacaaatgtactaggatttgttaaaaagggaaaaatcctctgcatctagaaccaaatacctctctcatctcttccctgatgggagtaatcattctgcacctcgagattgacttgatgtcttaacttttgcattggatgatgttacctatgttgggagttacatcggaaccggcacagtagttgtcaacttcagctacatgggaaaattcatggaagaagcttgaaaaaatgtaggcacccagctgacattcattattgaatgaagtcataggataagcttctttctattagatttttgccccagcactcagatgacctccacaatctacagacaacccagagaagtgggagggttctatcagtgagttacaccgggcttataccaccaaataactggctcaactggactcagaaaatgggctgttcatttgacttggtgtcaggctgaaaggaagcagcttcatccaccattatgtcaagacatagacgagttcagaaattcattgcaccgtaggttattgttgagccacatggaattaaagggcttgcccaaagcagatacttctctggattttgccaagctaggcagtcacacttcccccaaaaagaaaagtagaaattagacaaaaataaactttatagcactagaaccaattttaatgaaccacaatcatgatacggatttagtagagaccataaaatccacaggacaaggtgcgatctccacttgcctttggtcaaagctgagaaacaaagaaccggaagagctcactccattgtgtcctgttttctatggagagatgagccccccttcttctcttcctgtgaaccagcttgaatcggaggggaacgtgtaactatgaggttcagatcacactggaacacagcgtggtccatttatgctcagagtccgccaggtggcatggacttcagacagcacagataccctaattaccatgcctggtcttgcggttcacattcaccgtccttcttaaaagtggggaagggggccaggcgcggtggctcatgcctgtaatcccagtactttgggaggccgaggcgggcggatcacaaggtcaggagatcgagaccatcctgactaacacgccacggtgaaaccccgtctctactaaaaataccaaaaattagccacacgtggtggcggacgcctgtagtcccagctactcgggaggctgaagcaggagaatggcgtgaacctgggaggcggagcttgcagtgagccgagatcgcgccactgcgttccagcctgggcgacagagcgagactccgtctcaaaaaaaaaaaaaaaaaaaaaagtggggaaggggaaagggagccttgtctctatcttccggggtaagcctgcgctgctgggctcctgacaggttccatagactcctcttgcagcacctggggtgctatcttgtcacagcttataacctgctccagagcctggctctgagcaaaattgctgaggctgaaaaaagacagtaatgcaactcaggctgctagggtgttctcactgacaggactgcagattctgtttggctgaccacaagttacaaagatgaagacaaagtgcgagcaattcaagggccagcttgactagctggtaaaacgagtggcaaatgtactaggatttattaaaaagcggggaaaaagattccctgcatctacaaccaaatacccctcccatctcttccctgaagagaaatgattctgtaccttgaggttgaccggatgccttaacttttgcactggatgatgttacatatgttgggagttacttcagaatcggcacagtggttctcagcttccgctgcacgggaacgttcatggaaagaaatttaaaaaatgcaggtgcctagcttgcaactgcagagattctgacttcactggtccgcggcaggattcctgctcttagatttaggtaatctgagagttccccccaagtgattgcagtgtacaaccatggtaggcaccgctgcttaggttgaatgacatcagcagaatgttttaaatcaacaggtttcatgagtttgagatggaagaattgggtgaggtagaacccattaaaatagttaaatgggataaaaaaaatcagaaagttgaaacaatgaaaggcagatgtgactttgtaatcatcaggacatttagatttgcccaagtcccaatacaattccctccctgtgaagccttagaaattcctcagaactgtctttagtaatagaggcatgcaatatgattggcagatgaatttacagggaggagtttgagcacgcatggaaaacgttctgattttgttgtctttgagatgctcttcgatgtcacagaaggaaatgtatgattagtgtcggtgttcttgtcaagagatggctctcttcctttcttaggggaggaggcaacgacgagctttccatgtcccattggagttgttgagagacagggactgacaagatcaataattgtttccaaataatggggcgcattagcagcttcccagggtcatgctaaggtgacaggtgggggcagatgtggacagagacccggaaggatcctaactaaaagggaactcattatgtgtgatggtccccttgccagccataggagacatttctactagccttggttaacctggagccacagtgtgatggcaacaggcgctaggccatgttttgagttagtgtaatttcaaagtgtacagtttaccaaatttgaacttttttttaaattttattttttctagtctggcttttgcaagtgactctgacaaaatatttctgcattcaaatatctggcatttctataacaatttgagaagcttggccttataagaaaatctccaccaacacctggtgtatgttcatgtgctttataaatattaatttcattgaattgaaaagccaaaagtctgtttttatgatataggtttgttttcttgacttttctccaaaattattactagagtctcattttttaaaaagtctgacaggaacatacccaacatatatttttaagtaatacagcagaagaggaaacaattagaaatcagagtgtgtagcatgagtaagtgtaaatataatttcctgaaatcttcatttcaattgtgtgtgtatgcaattagattgtaaaatttattattgattgattgattgattgatttttgagacggagtctcgcactgttgtccaggcgacagtgggcgcgatctcggctcactgcaacctccgcctcccgggttcaagcgattctcctgcctcagcctcctgagtagctgtgattacaggcacctgccaccacgcccaactgattttttgtatttttagtagagacagggttttaccatgttggccaggctggtctcgaactcctgaccttgtgattcacctgcctcggcttcccaaagtgctgggaaggcatgagccaccacacccagccgtgaaatttactttatactgtggaatgtaagtgaaattctgaaagctattggataatggcgttgtttagaataataaccttatagcgtaaaccacaaacatgaagtcagccgactactgcgatgtatgccaagcacaggaatctggagaagtacgagcctcctggctccccactggactttttattggggtgctagaccagtggttctcaaagtgtgctccccggggcagcagcatcagcctcacttgggaaattcctagaaatgcagattctcaggcatcctatcccaagcccaccgaatcattatctctgggggtgaggctcagcaatctatgttttaacccttttcctgtttgctttgagaatgttctctggcagcgcttgcggctgcagtgtttactccggataattttgccacgaaacatctcacttttgttactgtttttgcattgttctagcatatcgtctttggaaacaaaagacatcattctatttacagcattctggttttagtagttgtatttccatttacaaaacatagtaattctcgatcgctgaaaatgtcaaatcctagaaaacgtagcattcctacgcatgatgttaacatcgttcgcaacagttgttgaccaaagattcattagatgaattaaattttcccaaagtagatgattctgatgttagtaacaagaacagtttttatatttcactttcaaattgaaaatcagatttgcttcagcttcaaagagcatgttaatataaaattaaatgagcattgacggcaagctgcatttttttcctaaacaggaaaagggttgagcctcgcaggtggttctcttctgatatgtggcctctgagagaatacctggccagccaggtatgaaggtggaccatgacctccctgtctcagctccaggcctgcgcaatatccatcaatcccataggcatttaggcctagaagctaatcatgatgggtgtttcttttgtttgttcattcgttcgttcgtttgtttttgagatggagtctcactctgtcacccagacgggagtgcaatggcccgatctctgcccactgaaacctccaactctgggttcaagtgattctcctgcctcagcctcccaaatagctgggattaaagacacgcaccaccacgcccagctagtttttgtatttttagtagagatgaggtttcaccatactgatcaggctggcagtgttttcttctttacttctgttgctgaagtttgtaactaactttgtgtcaactgtttatttatttatttttgagacagagttttgctattgtcacccaggctggagtgaaatggcatgatcttggctcactgcaaccttccgcctcctgggttcaagcgattctccagcctcagcctcctgagtagctgggattacaggcacccaccaccacgcccggctaatttttgtattagtagaggtggggtttctccatgttggccaggctggtctcaaactcctgacctctggggatccacctgccttggcctcccaaagtgctgggattacaggcgtgagccaccacacccagcctcaactgttacttgatcaacccttaacagaatgtggaagttagtgaattgctaacgctgcccttggcctgctatttcccagctggcctctctgtgcccagcccagctctgagctgccacatgtcccctgcctttcaaagaatccaccttctggcctgacttttctagctaaattttacaaaccataattcctagctttcctattttctcagaaaaatgtccaccaggtgtttattcaggtgtctcattgttataatccaataaataaacacatcatattcatgggatagcagatatatgcatttatttatttatttatttatttatttatttatttagatagagtctcactctgtcacccaggctggagtgcaatagcacaatcttggctcactgcaacctccgcctcttgggttcaagccattctcctgcctcatcctccctagtagctgggattacaggaacccaccatcatgcccagctaatttttgtattttttgtagagacagggtttcgccatgttggccaggctggtcttgaacccctgacctcaggtgatctgcctgcctcggcctcccaaattgctaggattataggcatgagccaccacgctgggctggatatatgcatttaatagggactctttgatgcctgagggctcatgttatcaattgtgaatacaagacaggcctatgggaggggtgtttattttttgggggggaggggggatgggcagctggatgggagttgagagtggtctcatgttcatcaaatcagcccaagtagatgattgatttctctgcctcagtcagattttgtgacaaggtaaagcagtagattcttgagtagttgataaatgatattacaatcttttctaaatttaaactcttcgttgatctttgtcctgtttgtataacctttatcttttttgaaaaatgttagttcagcaactgtttagtttaattagctgattcattaaacttgggtggtggctcaccaataaaaaagcatttgaatgtttgaatgtcactcagagctcttcaatttctttgcagaaatactcaacctagattcttttaaattctctacctcagaacctgatagaatacttgcatatttttactgatgatgtttcacctatacttaatgtaataagtaaacacactacacgagaagtcattctgtaggaaagtgagtgcggatttctaattacttaggcacagctagtttcctagcctgacaggtgtggaaacacctttcacactcgaagcatgcagaggcttgcatgagctcacctgagcattctgaggagcctccctatgcagttttggaaccctctgtttgattcaaaggtctgctcctgataccagggaggttttagctttctgccaaaagaaatgctctttcatcttcaaatcaaatgttgaagtgggccgggcatggtggttcacacctgttatcccagcactttgggaggctgaggtgggcggatcgcttgaggttaggagtttaagaccagcctggccaacatggcaaaaccctgtgtctactaaaaagtacaaaaattagccaggcatggtggcaggcacctataatcccagctactcgggaggctgaggcagaagaatcacttgaacctgggaggcagaggttgcagtgagccgagattgtgccactgcactccagcctgggagacagagtgaaactctgtctcaaaaaaaaaaaaaaaaaaaaaaaaaagaaagaaagaaagaaagacagaaaaaacaaacaaaaaaatgttgcagtgaaaaaatatcacctcctcctactctcaggatggtacttctgcccattctcctgagtaggctcaagcttctgaaaggagagaaagtgggagtggttgatatttcgtgactctcactggcgaaggcccacttgcagactggccctgcatcccgctgtcctgaatgcacacgtctgtgtgccgtgggatggcctctagagcgattcctccctgaatccctgcaacagacacctctgagtccaggcacagcaggatttcaggaaccagggaggagctggccaggtgtacacccgggcagatacctgtgacccgtgatttcaggggtgacagaaaatgcctcttttccaaacaccaagcaaaggaaccaaaaccaaatctacacaaacatgacctttccctgtaactctcctgattgctttcatcctgtgctttgaaacagggaaaatgcgtagacataccgggaagccagaggggccgtcgtcctggttttatgatgcgggcaggaggaagttatcaagggccgtccctgaaaacaggctttatttggacagtgtgagggatgtaaagaggagaaaggcagaccccagagagaacaggtgccctagcagagatgagaccaccccccggggagtggggagagcctcaatcagagtcccttactggaggtttgctctggggcagccccagtggaggttgctgcctgctttcatgttgtcggatcacattctccaggcagaaatggtttggaggatcctgggatttgaaggctggtgctcgctaatcatggctatgcatgaagcgtaacacagggcggtttgagtcatcttcctcggggagttttgagaggaacctaggatgccttattaggaatgaggttattgcagagcatggattttctgaaagacaaggcaagcacatggccatctggtcagcactcaccgctccctcccctgccccaccatgagtcgcccccaacacgcagtgcctgtgctgaacacactgtgcctggccgtgcgtgggcagtcacttcctagcccagctcccagactggggtcgccctggatgacagcatcacccttgtgccttgttcatttacctattcagatatgaagtcaagatactgtgggtgtccagagatgcttttttaaaaattgcttcctggggaataaaaaggaatggccattaacacattagttgacatgctcaaaatttaatttgcaaacagaagccaaaagagacagctaaaacttttcattggaagcaattaaaataggaaagcaacgggactgaacagttgatagtttgccagtgcaggttctgctctgtgaggcacgtccaggaccccctgcatcagtgtaagtcggcatacaggggttagagtgcaccatcctgggaatgcatgacacataggtgtgcttggttacagaccagcttccccaccacccaggctgaggcctttgcagacagaaatcaaacctacctggattagcacagccctggggactgaccctggaaatggagttcgcgtctcttcccctcttggcctgtctttatcactcacagctcagttagtgcctctcggcatctccttcctgctgtcttgccctgcaccatccgcttcctctctcgttttctttcttcctcacattctttcatttaaaaaaaattccaagtatgagcaaaaaataattttaatgggatgaatacactcaattatggtcttagttgtgtgcttaaagggagtaaacttagaatgtgaagagccagaactagaaggttcacagtctgtgtagtctcttcctaattaattcatttttctgtaagggccagccttcaagaaaatgtagaaataacgatttaattctattttattctttttttatttgattaataattactcaattagatccccatgactttatgtaaggagaggccatggtgtttgcttcgtgaggcggttgtgaggagccatctctgtgaacgggctcctggccgctgaggtgcatttcacaggtgctcatgctagctccctcctcagtgtgggcttggccttgcaaatgggcacaatttgcactaaatgcagactcctatggattttgcaggtagattctagtttttctgaacaatttttgcatttatttctgcatgcgctcatttaaaaattgtgttgttgtagtagagcatgcatactaacattgaccatcttagccatttttcagtgcccagttcagtggcatgagggcatttacactgctgtgcaggcattttccaccatccatctccagggcttttccttatcccgaacggaaactgcgctaattcaacacgcgctccccattccctcctcccgcagcccctggcacccaccattcaactttctgtctgtgagtttgatgagtctaggaagctcatctcactggaatctgatggtatttgtcctttgtgcctggattattccgtgtagcataacatcctccaggttcatccataggttcatccttgttgtagcctgtgtcagaatttcctacccttttaaggtggtgagtgctaagttttaaactgattgccttataagccaaaatgttagaaaccagcctattttcacacaggaggctgtgcttccagaaatctgcctaaccctgtcacgttgctgtgtcacgccatcaggctcttaatgagagcacatgaagaaaccacagattttggagttagacagactccagttggaatcctagctccacaaccacctgctgggtgaccttggggacattatttcatgtttacgagattaggacaggaatagtaaatacctcatagtgttttgtggatcaaatgagctaaggtttaaaaagtgcttagctagcaagggggagaggtcagcttcctaagtgtctgccctcccctggagtgtggtatcatcactgtcactgttgcacgtgagccattttaaggaaaaggtgtgtttttcaggttatctttcctatgccaagagccataggagtgcattgacacgtgcagaccccgcaggaactgtgcattccccgatggcaaccgtgttcactcatgcttctgtctttcccctccacactttgagagaatgggctgacattataggttttttttttcttttctgtttattttttctttttctgttttttttctttttttctttttttttgagacgcagttttcctcttgttgcccaggctggagtgcaatggcaccatctcagctcactgcaacttccgactcctgggttcaagcgattctcctgcctcagcctcccaagtagctgggactacaggcgcctgccaccaggcccagctaatttttgtatttttagtagagatggggtttcaccatgttggccaggctggtctcgaactcctgaactcaggtgatctgcccgcctcagcctcccaaagtgctgggattacaggcgtgagccaccgcgcccggccgacattatagttttaattaattctttcaacaaatatctctaagtactcattatgtgacagacactttgaaggcgctgtattgaagcataggaacttggtcctgagcaaatgagggacttaatgagagcacatgggcttgcaaaccgtgaacccatctcagggactggaaggctctgacaaaagaggagcgtgagtcccggggaagagagggcagacagttctggatgtggagggtcaagaaacgcttttttgaggaggtgacatttgagcggaggctggcgtgaaatgggggagtggattatgaagagtgccaggggaaatattccaagcagagggaagagcaaattctagaacccttgagtggctatatgcctggcacaccccaagggcaggaggtcgaccacaatggcgaggggatgttggcccgggtggaggggtaggaaatggagtgaggcaggacccggaaaggcaccatggctgcagatttctatcagctgacctttattcactacggttttagtatgagccttgttacagatgaaatgttgtggaggtcctaacctccactgtgctagtatttggaagtgaattatttgggaggtgattagggtgagatgaggtcatgaaggcgtggccccatgatgggatcagtatccttataagaagaggaagagacgccagtgctttttctctgtctccatccaatgtacagactcagtgagaagggagccatccacaagccaggaagtgagctctctgcaggaacagaagctgccggcaccctgacttggacttccagcctcagaactgtgaaatgtctgttgtttaaactactcagccattggtatttcattatggcagctggagcagaccaacgcaagccttttattctccaaatgattctggtgacctctcaagacctttctctatgacgcccgccaactttgtaaataaatcctaccctttcatgaatggacgcagagtgaggaagagtcacttccttcacactcaggagcacatatactcacctgctggcccacctcgaggggcccagctaggtcagtgccaggagaggcaaggttggtgcatttcacattacccccactgaccccaccactggtagctgcctgggccccaccagccttcccggaaaccgtgtgcatttgcacttagccagacagcacacggtgagaggcttatttgctcatatggtactttcaagaatctgcagcattgggtaatttgctggccatgtggagattcccatgtgcggggaagggctgctgggctgaggacctgagcagatggtggtcattaatagcaccaacatgtgaccagctgtaattgtgctggaaggactgaagccactgatggttgctccgtactttggttctacttaaaaaatacttttagcaggacataattcattatacaaggcagcattagcaaagaaatatcagactcccagtaagtgccattttcctacccctgtgttttaacaagtattcctggtgtttagaaatacatagtctctcagtcatcgtgtgggtaaaagtgagaagagttgtttttctcagtggatcaagactaagtcttatgagatttgaaatctagaagctctgctaaaattgcatatagcaatgcctgtgaatatgtgaaccgaatgagaaacacatttgtgtcctagagcagaaacttagattcagctctttatacacacaatgacccctcctggttaattgacttgcaatggtagtttcaggtatccagcagtagttctggctacagcagatctgtctacccactgcctctaaagctaatctctccagttaatagcttgcagcctgggcctcattaagtcaaagaacttctgcccatacaataggctgtaatcctctgtattagtatgaggtaatttggctcctaactggggaatttttctcgtctaataagaggagaaattgtttggtacagtagaaatcatatagtttcccagcatttggctcttggagaaagtcagggattctgtatcctgttccttacctctggagggattcttaagttgttttgggtatcttacagcaaacacttttagtgacaaacaagtcaaattaataataataataaaaaacctaacagttgttgactactgcgtgcttaagaagagttctgagccattttcttgcatgaactcataatgcccacaacaactctctaaggcaggtattcttatccacatgttgcatacgaagaaactgaggcccagagtgattaagcttcatttaaaaagcgtgaaatggggcagtgagtcatgaacagtgccggaggaaatgttccaagaagagggaagagcaaattctagaatccttgagtggcaataagcctggcacatcccaagggcaggaagtggaccacaatggtgagaggatgttggcccacacagagcggtaggaaatggagtgaggcaggaccagtatcgtaccagtgctaagataaaagcccaagcagtctaatttggagtccagactcttgatcattgatatgatttggctctgtgtctccacccaaatctcatgttgaattgtaatccctagtgttccaggaaggaccaggttggaggtgattggatcatgagggcagtttccttcttgctgttctcctgatagtgaatgagttctcataagatctgatggttttaaagtgtgctgtttcccccttcgctctctctcaccctcctgcttcactgtggtaagacgtgccttgcttccccttcaccttccaccatgattgtaagtttcctgaggcctccccagccgtgtgaaacgtgagttaataaaatctcttctctttttaaataaattacccagcctcagttagctcttcatagcagtatgaaaatgggctgatacaatcactattcaatatagcttctaaaacatacatttgtattatagcatgctagaccaggctgtgtgagccacttgggcactgcatggatttgggtgagccggggaagatgtcaaccccactgtcagttgttatgcaaaggggagccttgtcttcatcctaagttgaaatcttagggactgtctcttctggacataatagaagtgtgtcctgtgtccataattgtaaataaacttactggcatatagaaacagtgcctggtgagctctttttgaggatagatgctaggtcttctctttcattctcaggacccagcacaatggtggggccactcaaatgtttttgaatgaatacatgccatttttttggaagctgtgagagtttatacatcatttttcacctattgccagacatttgctgtctccatatcttactctatacatgaaagcagaaagtagaataagccattgtatgatttcagagggagaagtgaggaaatgggaggtagctgtgtaaaattagatataaactaccatcaaaaagtaattgatttaaggccctcttaaaaacacattgtcttagctttggctgctatgacaaatgaccatagactggatagcttaaacatcaaaaagttgagaaaatttatttcatacaattctggtggatgggaagttcaagatcaaggtgcccacagacctggcactggagaggagggctcccttcctggtttgcagatggctgccttcttgttgtagccttacatgtcagaaagagagagagaagagaaaactctcctgtctcataaggacactaatctcattcatgaagcctctaccctcatgacccaattaccttttgtattagtctgttttcacactgtcataaagaactacctgagactggataatttttgaagaaaagaggtttagttgactcacagttccgcatggctggggaagcctcaggaaacttacaatcaaggcagaaggcaaaggagaaccaggcaacttcttcgcaaggaggcaggaaagagagcgagtgaggggaaactgccacacaattgtaaaccatcagatcttgtgaaaactcactcactatcacaagaacagcatgggggaaaccacttccatgatccaatcacctcccaccaagtccctccctcaacgtgtggggattacagttccagatgatatttgggtgggaacacagagccaaaacgattcacctctcaaaggctccacctcctactaacatcacattgggtgttatgatttaaacatatgaattttgttgggggacacaacattcagtccataacacatgtgttgataattacaactcggttccaagaggtgcctccataaaaggtcacagagaccccaagaacagagctgcctagagttctattgcagaactccagggttgcagcaattaattttacatctaaaatgttgctgtaagaatttaccccacaaaaattgatcaatgggatcacttggacacagggcagggaacatcacacaccagggcctgtcaggtggtggggggctgggggagggatagcattaggagaaatacctaatttaaatgatgagttgatgggtgcagcaaaccaacatggcacatgtatacatatgtatcaaacctgcacattgtgcacatgtaccctagaacttaaaagtataataattttttaaaaaaagaatttaccccacaaaaatgtgggagatgtaaagagaatagaaagcttgtctttacagaagaatgctccctaataaatatagaaagcattgtggatatagaaaagcatgattatgcaattcccaatatcataattgattaaaccaaaaattagtgaatgctaaaaattattgtcatagattattggggataagatatccatagaatattcatgtgtaatttcacagattcttattagtttaacatgaaaatattacctgtctaatggagaggtctagtggacacaacttaagccaatagccaaactaagcattgccaatattgggtcaaaatatgcgcttcctgatatgaagccatctgccacccaaaatgccacttatgtacaattactgcccaaaatgtttaagtgaatctaatcatgaggaaacaagcagagaaatccagatgtgggcccttctacaagataactggcctgattcttaacatcaaaacaaaattaaaaaacaatgtcatataagcaaaaagaaaccaaccaaaaagtaatgaggttgaggggagaatatactaaattgaaaaaacacacacaacattaaccttaattgtttcattgattaaaaaaatagatgcaaaagacattttgaaaaaattggggaatttgaattggggctgaacacctgtgttgaatgtattaggtgtggtaaaagaggggtaagagtagggttgtgttagaataaaagaaggtccacattgggaaacacacgctgaagtattttggggtggtgtttgcaaattattttcaaatggcttagcaaaaagagtgtgtgtgtacacacaaatgtgtacatatatgtgcatatagagggagagagtggaggcataattgtagtaaaatgctaacattggcgacatctacatgaagtgcagacaggtgttcattgtgttctccattcagcttctcctggaatttgcaattctttagcataggtagcatggggcaggtgggaggagatcatacctgtgcacaccaggtgaatcccagttgggaaacggcaggtgagtcctggggacatatgtgtctctgctagagcatccttctctttgctccagtgctatggggtgcagacgggggacatccattcatgcttttccttcttcacacattcccctggtacctttttgctggcagggaacacagtccagtgtctgggctgcagatccctcatggtcagaagaggggtttggtgagaagtgggagactggttgctagtcctgtgagtgcatgccagaggccatctccttggttcatccctgtttccccagttctgggcacaacttgcctgtgtttgccaggaatgcatagcttatctgagcttcctcatggggtgagtgggtgaggagagatggtgttatcatcaactgtcaaagctggaggcttccagaaatgacactgctgtccagggtggatggcagatgccatctggactgtctcatctcagtgtgcaggcctctagggacatcctgccctgggcgtggggcttctctgccatgagggggatcctggtgctgtgagtgtatcacaggtgatgtggcaaaggtgggcgtgggcaccagatacagacatttccagtgggatctcgttgtactttcatacatgtcactgccggactctgtggtcttaaaagccatgaagccagcccaaggacccttgccgctccatgccaggcagcctcctggccccgtctgactcgccttagggggtgccttttactccgttgtgtacaaagcattttgaaggaagagaaggaactaacagttagtgttgtcagtattctcagaattttggcaatatcccataataagaaatctgtttgatcaactcatatacacctacacatgtaatgcctctatatgggtctgtgtgtacatatcggtatgtatagctgtgtgagaggatctatagacatatgtgtgtatgtgtgtatacacatctataatgtatgacaaaagtttcatcagaccatccgtacgctcacactttgatgtttactaacatcaaagcattagtaaatcagtatttcttaatgcgctgcttgttactggtttaggctacttatgatccgaaaaatgctggtttcagcaacacggaaaacataaaaagataattatagaacagggttaggaaaccaattctgtctgatgtgtgtgtattattacatgagagtatttgtatgtatccatgtatgtgtctgcatgtgtgtgtatttccatttatctttgcaatggtgcagggcaactgtgggtctgctgccattgtgacttgtttctgtcctctcctgggccgggcccttcaaaaactgtggagggacatttgtcattggtgtccgagcttctgtgctatttctccagaggggtcatgggatgacacagagaggccctgtgctgcaggtaaatctggaggacagcttgcgcccagggaaattacatgcaaaccaggttttcctgtcctcttgagtggggcttttttctttcagaaacccccctttttttttcctttttttttttttttcaatgatctctgcagaagcagcagcatggggctcaaatttgaagtgagccgcagatgcaggtttgcttgcgagtgactccctctgctcaaaatcgtccgcattttttttcttcttctgagacagggtctcactctgtcacccaggctggagtgcagtgctgcaatcttggctcactgcagcctccacctcccaggttcaagcaattctgcttcagcctcccaagtagctgggaccacaagcttgcgccaccacagggcatcctgtatttcaagcttcccccttttgaaatgaggattgctgacggatggtgtgcaaactttagaacttgttgtcaagatgtcagttgaatcttaattaaccattgaggcagcctgggagatacgcctattctggtaggaatttttattctttcaagttcaaggatttgtccttcatcattttccaatccatgggatggtaacaataaaaatagctaatagctaacaaatgtttactctgtgctgcgctcagcgctcagcgctcttcatgtgttttttctcctttatttgttagggaatgaatgagctcactagttgccttcttctgccataatttttcttccttgttcacatgtggttggtggtatatattttagtattcctttttgtttgtttgtttttgagacagagttttgctgttgttacccaagctgtagtgcaatggtgcggtctcagctcacctctgcctcctgggttcaagcgattctcctgcctcagcctcccaagtagctgggtttacaggcacgcaccaccacgcccagctaattttttgtatttttagtagaaatggggtttcaccatgttaaccaggctggtcttgaactcctgacctcaggtagtccgcccgccttggcctcccaaaatgctgggattacaggcttgagccactgtgcctggccaatattccttttaaaatctcaaacctgccaaaacatacaggagggagaattattagctcatcagattcagtatatcaaaatgaacctgctgacaaggtggaacataattcacagactacagctgttattaatgtgtgactatttctggcaaggcccagggtgcacaatcagaaaactattaatatataacaggctgaagtggaaatgtgaatgagccaatacttggaattcctatagtatttacactaactgttcctctgcccttctgaactgagtacttcgcaactcataaaatacaatttcctgttttccactttgcagcctcttcacatctcctatttcttctggctcctctaattaatggaaacacttgcatttgagttcgcatcgatttgcaaaacattgtttaatatgagaatattttcaccgtcgagggcatgttgattattcctaggtgtaaaacattctagtcaaatttaatataagaaagtaacatgcattgtcaataattacatgaaaaaatatggtggaagatttttttctctgattaatgactcaacagttttaaacatgtgttagtgggctgggcacagtggctcacgcctgtaatcccagcattttgggaggctgaggtgggcagatcacctgaggtcaggagttcgagaccagcctggccaacatggtgaaacccagtctctacaaaaaatacaaaaattagccaggcatggtggtgcgtgcctgtaatcccagctacttgggaggctgaggcatgagaatcgcttgagcccaggaggcagaggttgcagtgagccaagattgtgccactgcactccagcctgggtgacagagtgagactctgtctccaaaaaaaaaaaaaaaaaagtgttaatgaattctttaaaataatacccatctcttcgattcatgaaaggattctttaaactcctctgcaagagcctgagtctgcccagcatcacggtgatggcctccatggtccctcttgctcagggagcagctgctttgcacctgggactctgcacgctcaccccattcagtctcccgggtgctccctggcaggtgcaccatcatcctcatttgatggtcgagactggagcgctaagagcgttggtgcacactggtgggacccaagctcaggtgtctgtgagacaaggactctgccctccagtaatgaggaaggtggcatcccctgtccctcaggaagattattgtttatttgaggaagtgcggtgtaaagacctgaatcaggaaaggacaagtcaaggcattgtggcatccaatggcatcttaaatgcctctgggagaaggaggtcactgggattgagaacattcagaaaagatttgtgggaggaggctgaacttgggcagacacttgaatgaaaaggatgtggggagtggaaggagcaggcattccctgcagtggggtgctgagattcagagaaagaagaggtgcagggtggtgtcttgatgaggcactaagaccagctcacaggccgatgagggtgagatctcgaaatctgtctgttgtcacactgcctctctatactaacagttttttagtgaaaaacacagtgagaaccagataagtgagttcactgaattttatttccaaaaaaatggaaagctctagtaacgttctgcagtaacactttggctcatgtctaagttctttttttctttctttctttctttcttttatttttttttgagacagagtctcgctctgtcgcccaggtgacatttctcacaatagcaaaagtttgaaatatgagtgttcatcagtagtggaatgattaaattagggtacatatagacagtgggatactctgaaactgttacagatgatgatatagctctaaaggaaattgtctatactatattcttcagtgaacaaggtaaattagaaagtattatatagttttttaaattttatttatttatttattttgagagggagtctcgctctgtcgcccaggagtgcagtggtgcgatctcggctcacggcaagctctgcctcccaggttcacgccattctcctgcctcagcctcccggtagctgggactacaggtgcccgccaccatgcctggctaattttttatatttttagtagagacagggtttcaccgtgttagccaggatggtcttgatctcctgacctcatgatccgcccgcctcggcctcccaattttttttctttcttgcattatgcatttttcatcaaatgcttggcttcgtgccttctaccatgaagaccccacttcacagcgacacatgctcttgggtcactccgccacccgtggggttgtgaatcaagttcttcagggagagaagacaagctgacaggggtgggacttgagttctgtgcatctgtgatcagattccgcctccacagtgctgggtggtgggaggaagcccattcatctctgtgagactaaagtccctcatctgtcaatcaagatgctaaattttatttatttatttatttagagactggcccttgttgtgttatccagagtggtgtgatcatatgagatgctaaatattccctcgtgggttgtcatgaggttcagctgcaaccctggctggcacaggccatgacacttccagcaatgtacctgcccagctgggattaatcactgacatttaactcccagttgatggcacctgtgtacggatgaattcctcaaaacagtatcagaatcttacgtactcactggtctcagcgagtattcacagagaaagcaagaaggatggtatttgattactcaataagtgagtcctgaggggtcattgctaggcaggctgaggggtggtctctgcagcccctcacagcctttgaacagccagaactttgattgatgaacaggtgctttcctgtaaaaagcaagaagcactatggaatcacagtttttgttgattttttcccctgctggtagtctggtcttcatgatatcattcttccagaaagccaaccctttcttgcaaaagtacaaggtgtgctcaggaaaaatgctgctagtgccaagattcctctttccatttctgtggccctcaggtgtggacatcgctgccttattttccctaaagtgacaaacaggatcacatcacatatttaaactctgaaatcggtattatgaggtttaatctgtatccatgtaggttttatcttgttgcaactgtttccatcctctcgcatttccagtgcccccatattgaccaggagcaccatctaggcatccgtttgtgttcctcctgccccccacccccaccatgcttctgtctgtcttctccatgagtaggaggaggtcacttggatcgagaacattcagaaaagatttgcaggaggagactgaacttggagagatgcttgaagggaaaggatttggggggtgtgcaagagggggcattccttgcagtggggtgctgagatacagagaaggaagaggcttagggtggtgtcttgatgagacactaagactggctcacaggttgatgagaacgagatctagaaatcggactactgccatgtcagctcacttcatgaatatcatgaagaccagtccaccaggaggatccaacaggaaggcaacttttttaagcaaagggattctagctctccactggattaccctgtttcatatgtaaaagttaggttaactcggaacaggagatgcaaaaaccccatctacttagagaaagctgaggagaacaaaagtagcgttagctggagacatatgccatttgttggagtgtccactgagctcgtgcaatactggttgaagccacttctcacagagatgaagcaccccgtgggtgagcctggaaataaaagtgcatggagccaggctgtggatgacggaaatagtaaatggcaaagcagaggagggcttgagcatgggtgggcaggtgagcaagcgtgcagggtgcagaaaccacagctgtgagaaggggcttttccagagtgaggttacagaaagatcaagtgaggcaggacagcatgtggacctggaagagaacataggcaaggggcgaaagagtgtggaaagaagagaaaatgaagctatatagacttcaagtaacagcatcattgctctagaactaggtcattcttggtctctgagctccggacaaattctgaagtgacctacatcattcatagaggcagaaggaggctaccattcattccagcaagcagggaaggctttcttgatatgtgctggtcccagactaagcctggaacacagtgacacacagtccttgccctcagggaactgaaagactaggaggggagggagtcatgtccataaattcaaaggccatagttgctgcaagatggcaatgagatgctaggagactataggtgggttttctagccaagtcttgggagaattcaggaaggcttcctggaagaggagacatccaagccaaggctgaaagagcaggagcccagcaggtgggtgggcccaggccatggacatagcatctccaggaggatcatgtgatccacccagactctcatctatgttgtttgcttttaccatgtagggtccctaccatttattttctcatatgagtgaagctgtctccttcaccagcccccacattatcatgtactgttttcatccagtcctctacagcctccccccaaccgagccccacagcccctgctgccaaagggattactgtaggctttgggacattctggactaatcccacgttcttcacccccttttatgtcagtcaccaggagaagctggtgactaaccacagttggtagctctttgtacgccataccttccccgactttctcttctgcttattttttctgtttcttgtttcacaatctgacatctcatgtgtctggaaggtcagctccatgaggtcaggaattgcctacttttttttttcaactgttgtacactcagcacctagaagagtacatggcatgcagtgggtgctcaaaacacagtgattgtgctgagtgcaaaggctcagcctgtaatcccatcactttggaagaccaaggggggagtttcacttgagcccagaagttcaagaccagcctgggcaacatgacggaaccccatctctattaaaaatacaaaaaactagctggatgtggtggtgcacacctgtagtcccagctacttgggagctcgaagtaggaggattgcttgagcctgaaaggtcgagctgtaatcacaccactccagcctgggcaacagagtgagagaccctgtcaaaaaatatatagtgattgaatgaatgagttatactgctaaatggtttaaacaattatctaaacattgtttatgttcttttgagactttgaagacattgactttcaaatccagtagtttccaaatttaatcatcagaattacttggagcactttttaaaaatgcccaagtcttccccccaaaactcttggagtagttacttcaggatatgcgactctgagattttggttttgattcagatataatccaggcattgggaccattttgcaaaggagagagtagaccagagataatgagtgcattatctctgccagggtctgctggggagaacctgccctgatgcccaggccagcgtgctctggctgcctggcttatgtctaacaggagctggagggcatgagggtgggacgctactgttcacatcacagggaagatgtgaatgggggtggtttggggtggagcgttgaccaggcttttaagagaactgtgggtttatgcctggtaatgataaaggaaagtagatttcaggtgcagaaaacatatccgttgtcatttaagtaaagttagaatcataggtctgagataatttaatagacttttccatttgtcaaagatgtatgtcttatttcccagtgatctctttccttctcaaatatacttgctactacaaatgacattccaagagcccatttcagtcccctgagcgttttgatttttctttcgagcagtagacctgctgtagtttaagctggttgggaaagctgtcgttcaccttgatggattaccgtccccgcagtgagcacccagtctccagaaagttcacggctccctcaccttatgtatctgatttatgtagaaacgtcgataaattagttaggagggcattcttgctgatatcagcaatcccagagcacctgggaggaaagcagagtgaagattttgaaagtcacaggcgatgtcggccactctcctgtgtggcccaggaacctcacacaatgataagataaggaagtttaatggatggtgctgccttctgaaagattaatcgtgccttgaaatctagatattttcatttcaggctgaaaacagtaaattagaaattaataaaaaggagatgatttcatcagctcaacaagtgcttctgatttcaagaagttttccttaaattttttttttcactgctgaaaaaaatcagtgtcttgataattttatgaagtagcctgtaattatttcactatggctttgcatctgagaactgaccatttgtgttttgaattcatgtcaaacaataatatattcgatagcattttatgatttattttagtgcctaaatatttataaaacaaaggcagggttttttattttcaaatttatgagctagataatgtcttgaagatgtacaacatagtatactaattttccttgcattctggcagtcctcaaaatgtaataggcaagtttattcttagacaaaagcccatttaattaaaactcacacgataactttcatacatagcaattgaattattcctaaaaggattaaatacctaagctttgaagttggatgggtgattattacaaaagccagattaatacaattgacctaatttctagtcagtgacattataagcagccttgtaagaatagctgttactacaaatatgcgggtttgcaatgttcaattctaaagtggtctaatttgttcttactacctgccagaatgtatgcattcaagtgggtgtcctccatgacagctttaattggtagtacaatggtatgagtgtggaaaggagctggtatttttcctgtttattcattaattgaacaattgattggtcatctactgcatgccagttagcttattaggggctcagatgcaagtgggggaaggtaataatcaacaaggaaatatctgtcatgtagagaaataaaggaaggtagggtggagggttaaagtaagacaggttcagtattccactggggatcagggagggctctcacttaagtgaggtaggttgaccatggattacctgggggcagagtgtgctcaagcagcacctgcaggccacagggaggctttgagttttgttctgagtgagattggaaggtgttggagagtttgagttttttttattctttgagattggaaggtgctgggttttattctgtgagattggaggtattgagtgagattggaaggtgttggagagtttcaagcagaaaaactgtaagatctgcagatgttttaaatagatgtctctgtaaattgtaaaactgtaagacatgggtaagaagcaatcattttcaggggtgagactgcttgtaggacttcacatgagcaaacgccaggcagagtgtggaacctggacccttcaaagagaaacgcaggtggaagaagcagcaaggaggaacggggcttagctgggccatcgccgccgtcttctctggcactgcccctgtgttttccgttcagagaaaagcctttcctagcattcatgacccccatcctgtatcatccaggttccacacggtcctcttctgagagaccctcccgactactcctgtgcccgttgccatgccatttgttggatcacttgcaggccccgagtctcaaacacatgatttatcatcagatcgtacagtcgtcagaagggtcccaccgtttctaaccatgtgacctgggcggttgctttacttctccgcacctcaatgtccttgtctgtaaaatggggcggatcagcccacctactgtttgggattaaatgaggtgatgtgcataaagctgtcagtgccatccctgggctgcagcgggcgttctggaaatatcacagattaccatcactgtccgccgcgcggcatccgtatgcccttgattcatacacagtgccacgcgtgggggcggttctcagtcagaaaataccaagagcagccgccgcatcttagaatttgctgtgttttactcagtccttttggggtgtcagcattttgttttctgtgtgttggcagttgatcggtaatttccaccgatgcccctgtacctcctccatccccagtcttcccagtctgcatggcttcaggtgtcacttctgggttcatgtctgctaaatttatgttggtagttttagactctcctaatcccctacttggcgttcctcatcattggtaggcacatctctgaatgtgcgtctttccagacccaaattcagctcgtcttaaactgtactcctcttaaaacctatttctccttaattcaggttacagggaacactgcctcccttagtccatcatttgggcagcttcggtcaataaccctcccctgtggttcctcttctctcagatttcatcccctctgtcctgatgaagcccctgcttctagcctctcaccagctcctcttgttcatcttggctatagatgcttatcagcaaagatgttggttcttcccaatggtgaggataaagtgtgggtgctgatgaaggcaggatagtgacctgatgtagggttctctgggtaaaacacaatgtttaggattcccctctagcacaaggttgctttaggtctcggagatcagtgcaccaagagaacagcaaccagcagtgacctctcctaatgacagtggtcatactagtatgaccatattaccagaagaaagaagagaggttgttttttaaagcactggagattccatgtcagaaaatgtgctattctggccgggcgcggcggctcacacctatagtcccagcactttgggaggctgaggcaggcagatcagttgagctcaggagttcgagaccagcctggccaacatggtgaaaccctgtctctactaaaaatacaaaaattagctgggtgtgtggcacacacctgtaatttcagctactcggaaggctgagacaggagaatcgcttgaacctgggaggcggaggttgcagtgagctgagatggcaccactgcactccagcctgggtgacaaaagagagactctgactcaaacaaacaaacaaacaactgtgctattttaatagatattcaactaagaaatgggtgggtgtaagtgatttaacctgaacccatctcagcagaaacctcagttgatgaactttttcttttctttttaaacccactttaagaagaagtacatgacaataccgcagcccctggaggttatttcatgcaggtggagagtggattcaccacatcctccagctctgagaccggtgttcagtgagaggtggttgtgggctttgagtctgtgagatcttcagtcatccaagttggattttgtttatttgacttagggtagatgttggaccaatacctcgtaggaaggtttttgaatcgggagttgaagcaaagcagcatttcttgttagtcctcagttaattagaaaattaaattaactacaatcctcattcccagagctttctgggtaattgatgtcttactgtatttggattagagaaggccccaggaggcacaaggttataattgtgtagaattagagaatctagggaagaaggaatggcaggtaatttgcaaaatttcaaggcagggggccctccccaaagtcccatggcaaaggcattgcttggtgagcacgcggggctgggccagaggctgcctactcgggagacatcagctgtgggtcaagagctacttaaaagagaattcaggagatcaaagtattgtcttccaccattcatcagaagaaaatacatctagatttaaaccctggaattagactggcttgatgcttttaatttgcatttaaagtcttaaactttttcttcttccaaatatttaccattttctgtagtccttttaagtatttggactagacttatttagaaatgtacagagtgcagaacaatgtagactcttgagtggctaagagtctaaacggctgaggaatgtagatcatttttggacttaaaatgaagctttaactgcccccaaatggaggacctccttttctggaagcaaattgcaatctgaatgctctgtgctaaagcttaaagcatagcaggagaaactattagaatttgtatagtagcattgccttggacgagcctagtgcaaactgagcctggtatgtggaccaagtactgtttatgacttttctttaagcataagttactcagggaaagtattatcaaaacaaatttggttataattgtcttcagacttgtttttctgggacttgggacttaaaagaggggagtaggctgtggataagctttggagttggcccacacaatggagattgttcaatttttttttttttttgtcctctcagacccagtaactttgggatttttattgactacttttttctccaatttttaaaattatggtaaaatatatataacataaaattgtccatcttaaccattttgaggtgtataatttggtggtattaaatgcattaataatgttgtatgatgattaccaccatctatctctgcaactcttttcattttgtgtagctgaaactctgtacttactaaacaatctcttcattcctccctcccccaatcgctagcaaccaccatccaatgttctgtctccatgattttgactactcttaagtaccttgtataagaggaatcatcaagcatttttctttctggactgccttgtttcacttaatataagtcctcaaggtgcctccatgttgtagcatgtgtctgaatttccctcaatttttagtctgaatagtattccattgtatgtgtatgttacattttgctcatccatttatcagttgatagactcttggtttccatccatgttttaggtattatgaataatgctgtataccagaagtggaattgctggatcatatggttatttcatttttaatattttgaggaaccatcatactgtttgccacagcatctctatcgttttacactctcaccaacagtgcacaagggttcagtttctccacatcctcactaacttattttctgtttgtttgtttgtttgtttttaacagtagccatcctactaaagaggatctcattgtggttttgatttgcatttccctaatgattagtggtgttgagcatcatttcatatgctatttggccatttgtgtaccttttttggagaactgtctatttaaaagttctgcccattattgaattgagttgttttgttgtattttttgagttttagaagttctctatttgttaattccttattacatatatatatatgaattgcaaatattatttcctctcctgtgggttgcctttttattctattaatattgtcttttatgcaaaattttaaacaatttctcgaagtcctatttgtttatttttcctggttgcctatgcctttggtgacaataaatcaatgccaagaaatcatggacaaaccaaatgtcatgaagttttgccctgtcttttcttttaagagtttcatagttttagatcttacatttaggtctttgatccattttgagttaatttttgtatatagtgtaaggtaagggtctagctttattcttttgtatgccaatatccacttttcctaatcatttgttgaaagaactgacatttcctcactgaatgattttaggacttttaacaaaagtcatttgtccatatatgcaagtttcttggctctctacttaatgcattgggattgcgatagagatggtgttgagtctgtatatcactttgtgtggtgccttacttcatttgggctgctatgacgtaataccatggactaggtagcctctaaacaacagacatttatttctcaccattctggagtctgaaaagtctaagattaaggcactggcagatttcacatctgatgagggtgtgtttatcatagatggtgccttctctctgtgtcctcaaatgatgaaagggacaaacaggctctttcaggccttttgtaaggtctctaatcttatccgtgaacattctgccttcttgacctaatcaactcccaaagtccctcacctcttaataccatcaggttggaggttaggtttcaacatacaaattttggggggaaacaaactttcatattgtagcgggtagcattgacatcttaacaacattaagtcttcccatccatgaacatgggatgtgtttccatttaattatgtcttctttaatttctttcagcaaggctttgtagttttcattttacaagttgttcacctccgcggctaagttaattcctaagtattttattctttttgatgctgttgtaaatggagttgtttttatcatttccttttcagattgttcattgttagcatagagaaattcaactgaatattgtgcatggactttgaaattttgcagaatgtactgattagttttaacaggattttaaaaaatgggatccttaaggtttttatatataaaattgtatcatgtgtaaacagatcattttacttttttttctgatttaaattacttttctttctttttttatttttggtctaattgttctggctagaacttctaatattctgttgaatcaaataagtggtaaaagttggcatccttacgttgttctctattttaaaggaaaatatttcagtcttttgtcattgagtatgatgttcactctgggtttttgtatggattttatttattttgaggtagttctcttctatttctaatttcttgagttttttttttttttaatcataaagcgctgttgaattctgtcaaatgctttttctgcatcaattgagattattacattgattgctttttttaaagtccttatgacttcggaagagaatatacttacgaattgttatttttgaattgacctgatttaactctccagtcactcaaataatggcacaaataaaaattataacaatgattatgtgcttactatgtgcatgacactgtgcaaaacaattcatgttcattatgtagttactactcaaaatacctcctaggtaggtactgctattctttccattctacagatgagaaaccagggctgagagatgttcagtaacatgtccaagccaccaggccaggaaatagtgggactgtgatttaaactctatttaactcctgtgcctgcacttgtgagagctgtgctacacgtgtggacaggacccttattctaatactgtggagtggaaaggaaggaagaaagggagggagggaaataagtataatgatcctcttttcctataacttcagagagagtaattgtccagctagcaccttcctgaaccaagggaatgctatctcgtgctcatattgaaagaaagataaaaagacaatcggtgaaggattgtaatgaagattaaaggagcctggagcacaactttggtttccctgatatttttcattacacagagttattacgtgttagagcacacacaaagtgtattctcggccaggcacagtggctcactttgggaggccaaggtgggtgaatcacctgaggtcaggagttcaagactagcctggccaacatgccgaaaccttgtttctactaaaaacacaaaaaattatctgggtgtggtggcatgcacctataatgccagctactcaggaggccaaggtaggagaatcacttgaacctaggaggcggaggttgcagtgagctgggatcgcgccactgcgctccagcctgggcgacagagcaacactccatctcaaaaacaaaaaaagtactctttttttgcagaggaagaacattataataaatgatgaaatctatgaaacagaatgaaatgggacctgcttttggaataatctaatgaaatagattattttaaataatctagtaagataaattagatttataagataaatttagaagataaatgtaaaattataagataaatttataatataaattagatttataagataaatctaataagattattttaaataatataaaataaggtcaaaatgaaggcacttctgatgttttttttcatgagcattaagcagtgcgcaccaactgaactctagtataaagtggcttaccagaattataaaaagactgcacatgttcaattttaatctatatcttatgaaaatggtaatggaagagacaatctgcctgagaaaggaatagaagaatcacattttagttttaatttctcattgataaacctcctttagaaacgagagagtattctagaatcgtccaattgatagaaaataatgtatttccccaaatgcaatgtctttgttatgaagtcacacctgcactattgaataaaatattatccatgttgtgtgtgacatgatttcagtagaataaattatcagtgaatgacccacaataaatcatatgcctccacttcatgctgttaacacttcatgctgttaatacttcatgctgttaacacttcatgctgttaattcacttctgatggggaagctactcaaattccgatggaaatgttgatgttgcagcatttgggatgagttctaatatgtttgttcacttttaaacactcctgagatgtggatgaagaagctgaccagcaggtgtgtgatacatttgtttgcgctgtgctgtactgggaggaaagaaagcagcaaaggtgtcttctctaataaacaccactctttccccttctagatctccaaatctttctaggtcttggtgcctttgagcctttcagtcaatcttttaaataaaatggtttccaggtgtttattcgtgtcaatttaattttccctaaaaatacatttctagatttttacccaaccactgtgatgccgtaaaatatggcagaattctgggcatggtaaaactgttaggaagaatcagagcaccaaccctagatgtacataatgcgtcagggtgtgaggttgagggtgttaatgacactatattgagacagtatattgagcatctgtgaggcacaggcagtcaccagatgttgtgcatatgtagcttgttagttttgccaatacctctgtgaggtactcatttttaagcccatccctaaaaatgaggaaaccgaggggcagataatttaaataattgcctaagatctctcaactaattagtaacagaatttggattcaatccaagatgatcttaactctaagcattagcatgctacaccatcacactgccagatttacctttgagattcatttgtaggttgtatgcagtgatagtatcgcctttgttcatttgcacatcaaagacttcgtgaccaatctgaacacccttgtatttgggcaccaatgtgatcataagaagaaaacgttatctgccatcatcctatttctttttcctttctattttatggtcatatttttttctccatttcaagtagagggacatccttcatattttctctctctctctctcctggttatgctgttttcattttgcaaagtgaaacacacacaactagcagaaaatgaggtgtgccaggtgcattcacacatcacttgtctcccagagtaccagactctggtgtctcagaggcgtgattctcttgaggggggaaattatgttttgcagaccttgttcatttatcacttctatctatctcagacgttcttttcttaaaagaagcaagactcaggcacactgaaggtcatttccatgggacacacttgattgcttagaaaaacaaatttgaaaaatactttcttcagaaggaaagatattgtttctccagggtaaaatatttctgagggcttgactctttccaatgacgcctttatgtaagctgttggagcagggctcttaattgataagcagctgtgttaataattcacaatgaatagcatatttaaaacgtcaacccagtgttgattcttatggcagtatctgaggcgagagagaccaaagcaacaatgacaatgaatctttagattctggaaactcaggagaagccacactatctctagagtcaccaccttccttttttaaagaaagagggaaggttcccctctccaaaggaaagtttgcttcccaggtaaccgtgatctttgtgacctattactgatttcgtttaaacagagtctttatgttcaaatgcaactgtgtggtaaaatggccccagaatccagacatctagatcatgcctgtaacacttttcttaatttttgtatttatattggataactcatgcaatttttcaaagactccattattatttctataaaatgaagataatcttacctacacggttaacctcgcagaattgttggaaagatgaaatgaggcagtcatatatggattagaaattggaacctcctaaactccaatgccaggtgttagtttctttacatctttcttgtagtcaaaaaaaattctgggtaattgttttgagcagttatattgagaacatcctctgagaaaagaactgtgtgcatcttgccatggaaaagaagtctgtctctgcacgtaaattacctgatagggcatgagagttactgcagagaggtggatgcatgggagaacgcaggggtgggggagggacccatcagttggtgccttctgttctgccccatttggggtgtgcactttaaatggctaagaaaggatatcatttctattcaggtggagggtaggggtgcttcatggaagagactgaattttaacttagtcttgaataatagatacaatttactgaaatatgtatatatgaaaatatccttcaagggaagagagtttgccaaggtcaaacaggccgagaagtctaggtgtgttgggggaaggctgagaggtgcaccttggagggagtgcaggtgtgtgtgggaggagcatagagtcttgctggacagagacctccaggggcatttgaatactgctggaaattatttggtgtgtcctggaggtaagagagaccagggagcagtttgtctgtgcaggaagcagtggagtgtggtctgcatgccctggagaagccaaggcctgagggctctccttgcgggagacgcctcctgactctcactggccacagcaaagagaggtaggtttgctggctggaagcataaacacagccctaagtgccacatctccccagagatggcgtggagttcctctgagggaggacatggctccacgccatgttttgagcacaggtgaggcagtgacttatgagggacaatgaaaggtcaattcaagctttaggaagtaggtttggacccaagaatctttttaggtgatctctgaaattatgatcatgaatgagatcatgaggaaaggctccttggatttcccactggggccattttagcggctgcccaccagatgccatgattgactatgttattctttttatttggtgccaaccagagaatcattttatccagttcagatctcccattagtagctgatatgagtttggtttagaataagaaaactaactcttagccagataggcaagcatggaatcacacatacacatacaaaatacacctttggagatagatatttgcaggtaattgttttgaaacaaaatttttccatatattttgtaaaattttaaatttctcattgtatgacattttattataacagaaaagaaccatgaattcctcttaatgaagacctttcttgtcttcactgttattatcctaaagatatttatttagcatttggtgtagtgtaagatgaattgcacagctaatttaaatgtattactggctgggcgcagtggctcacacctgtaataccagcactttgggaggctgaggagggcagatcacgaggtcaggagcttgagaccagcctggccaacatggcaaaacctcgtctctactaaaaatgcaaagattaggtgtggtggcatgcacctgtaatcccagctactcgggaggctgaggcaggagaatcactcgaacctgggaggtgtagggtgcagtgagccaaggtcatgccactgcactacagcctgggtgatagggtgagactccatctcagaaaaaacaaaaacaaaaacaaaaaaaaaacaggtattactggctgccccctttggaaacagtacaccaaatttactgtgcctgattctaagaatagaaaattgaaggatgccttagagaagaaatagagacattttaaaataatgacaactttggaaaatagcacccagaatcccgtggcttaactttgttcagtacaaccccaaattattgatttatgattttttgaccctgagaaaagatgcagatgcagagaaaagatgtagaaatccctccccttcccctctcctcctgggagccacatagggtatgaaagtggtagagatcctttctgctgagccaatagtcgtctttaaaactctgggatccccttccttacaccttatacaaaaatcaattcaagatggattaaagacttaaacgttaaacctaaaactataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcggagtgaacaggcagcctacaaaatgggagaaaattttcgcagcctactcatctgacaaagggctaatatccagaatctacaatgaactcaaacaaatttacaagaaaaaaacaaacaaccccatcaaaaattgggcaaaggacatgaacagacacttctcagaagaagacatttatgcagccaaaaaacacatgagaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccagacgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaatttggaaatcatcattctcagtaaactatcgcaagaacaaaaaaccaaacaccgcatattctcactcataggtgggaattgaacaatgagaacacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatactaataaatttaaaaaaaagaaaaaaataaaaataaaaataaaaataaaactctgggatccaaaagacagactcagtgatagtttcccaatactgttattgggaaagcaataaggctgaataaaaggaaagacccttaaataaagtagaaaagatttgcatgtgacaaaactggaagcagagaaactttaaaagcacatacattttgttcaaggaacaactatagttcttagtctcagagggatttaggcatttgcccaagattatgatgtgtaaaacagagatgctaatagctaattatcagagttatttatatgactgtgtcaggtacctgcctgaaaatgctcaacactgtccatcagtaagtaagagcaccagagaatgactgtctcttttctttgtggttctaacgtgtcacccacgttagttccctggactcagcaggtcgccaccgtgaggccccagcatttgggtccatcactggcgatgtgctgctggcctcagaatgtctgcctctgactatgcaggaggttgctgtgtgatagagtgcgggggaatcaggacaccgcccaccgctgtccaaatgccaagtggcgattcaggtaccttaggaggaaaagggacatggtgaggactggagttgcggtagatgcctcctgggtgttgaagagtccgaaggatccagaatggcagagaggggaaatgggggcagccatgcatgaagacaggctggggggcgctaatgcagctttctctcctggagcctctcatctccacctgctgcggaagctcctgtgcatccaactctgggctgggaaagcaaagagcactgggcaatcacgcctttctctgctgtctgcacgtggcgaaaatgaaagcatttcatggaacctgtttggggcacgtgaagagtgggccagagtgccagggaggcagcaatctgcaggttgcgttcatgccgtgacagtccattcaggggtgcaggagctggtagctgagttccccttcctgttttacacttctggtcttttggttctcaatacctcggggtgtaaaggacagctctttatttggctgtgaatatccaccactgtcttcctacttctctttctttggaagcatttcatttccttttctagaaaatttggagctgaagtgctcggaaggccactgattttaagctcattaaactcacattcacctttgtcttttgttgaaaaaagttaatcttgttttccaaagggccacaggaggatattgtatggatgttatttattgtccttcacaaacacaccccagagattagctcattataggttttattcaacaaagtaattattgcagagaggaagctgagcttttagtgatggacttggaagtgatgggtgaccactctcactggactccagatagaaacagaaatcaaagccgctgtctaatcacacttcactcctccctctgcataggactgtaattggtactcaaggagaacactaaatcaaagatctcataaggcaaatattagcagcatgtatcatgtaaataagaataatgatcagaagctacgcagaggagggactattgtgctcaaaagcagtggaagaaatcataaaagaaagatccataaatgttccttgaagacaacaacattagactttataaaataccacacagaaaatcagaaaagagcctagagaaaatatttaccacaaataagaaggattaccatctttgagctacgggagtgcccatatgaatcaataagaagaaaattacaaaggccaaatgcataaacagccaaggacatgaagagatgaatggaagaaagagaaaataggaatgatgaccaggtcgaccagaaacattcaacttaaccagtaatgatggaaattcaaattaaggctaaaaggagacagtttgcttataaaatcagtacctatttcaatagttgtgattcgataaaatggactcctctcaatacttggtatggctgtaattggataaaagtgttctggagaggaaatcaaccttatgttgcaagagcagtaaaaatgttgatatgctctgatacagaaattccacgtctagaaatttattctaagtaacattatgtacagacccaattacaaaaaaaaatgcaccagtatgtttatgatagcaattttttaggttgtaaaaatagaaaaagacatccattaaaaattatgcttagaataagtttagtaataataacaaatgtgttttgtgcctatgtgtgccaagcgtcatacctacataaatatgtgtgtgtacacatatacgtatgcaaatgcatatatttatatgtatgtgtacatttctatgtatgtgaattttttttcatttgatttttcaccaaccctataaagtaagacccattattatcccagtttgtagatgaagaaactatgacttggagagtttattagctcaagcaacaatcatacacccattaaattacatagcgcttcctccagatcttcaggtccagatccagtgaaaaggaaatgatactaggtggaaatccctgtggtttgtttttggataaaagtttcccaatactaggtaaagatgttcaggtttaaataatgttttgtgacgtgcatgtactggtgttttgcttgtttttccttctagctacacatgaaaataaggatattttccttgttactataaaagtattacatattcctttaggagctgctttcccccccttgtttgtcgtctcttaaaaaaagcattttctaagcagactgagaaaggagtctattaacaagcaaattgcatttgtgagtaagctgaagtgtagggagtggtatttcccactggggctctggaggctcagctccccagtgcagtggctgaacagggccaggcagtgtgaggggactggagctgggcactctgctcagggggtggacagagaagggaacctgggaaggcccccggcaggcaggactcagaggctctcaaactgctctcagatctgcaggactggcttcccacaactctgttcatcctcctccatcgcaaaatgaatatgtaaaggttttccttttacctgccaaagacattttgggaaagtaatgtgaagatttgtactttgtgaatggactcatatttatgtgtacaaaagcatgcagcagtttaaggaatcctatggtgaatactctgatacagaaggaagaattatttgaaatgcgatgcgtaacataaatgacctttcaactgaagttaacttagatactggtacattaagttttctaagaaataaatataaataaatcttatattaatgctagctaaaggcaaaccgggaggcatgctgtaaagtctatgcaaaatctggatgctcatggagaagattcttgtcaaatgtcatgtattattagtataggtagtctcacccttctaaaaaaggaaaccagaagtttgccagccaacctttaaattttgaaaaggtaagtctacagtgtgcttttcatacggttttcaaaagcagataaacattctcttttattaaacacacttctcaatttagtcatggtttgtggaccaatgttttcttaaattatttcataataattttacaacactgagaactggctgtgaaatcaacctttgggaaaaattaggagtagccgggggatgcacacacgcatgcacacacacacacacacacgcacacatgcacatgcacacgcacacgcatacacacacacacatgcacacatacatgcacacacatccacgcacaaatgcacacacacacgcacctgcacacacacgtgggtttgcatgctgacttgacatccaatgctaacagttcaaccacatttatggtttcataaatacaatgaatcatgagtagacctctaggtcaatggttctcaaagtgcagtcttcagaccagcaccatcagccttctcctggaacttcttaggcaaattctgaggacccattccagactgagtcaaaaaccctggataggtcagttattccttactacctttgcaaaacaccattctgttttagctcatggtgatcaaataaagagcaggatgaatgccaagatagagtatatagaacacctgatatggtgttctttggatcatgaccacacatctgttcccagcaaaaaggaattgtgccaacaggatgcatcaatgcactcctaatcagtgtcacctgatcatccactaatagctcaggcaaacatcagcttttccatcagtacacaaatcagtcattattcttgcctctcatcttagtgacagtacttcattgccccagcctacttgtcaaatccattgtcctgttaattttctccacacactccagggagataacagaatctctgggtagcagaccccatctcatgcctctgatatttataattgtgctgccaacctcctcttccaactagaattcctccccatgtttaaatttccaatttaatttcaagattctttgagaagattcctccaagtcttccctgttctgaaccatgtataactcttctgcagctatcatttggttcatcatggttcccttcatgaaaatcattttatgcatgtaatatcttaactgcccaaatgttattgaaaaagttttgagaggaagaactacatctcacatgcctttgtatctttcagtgcctagccactgtctcaccacaagaagttatagtgttttctttgatgcctttaatgtagatgtagattttcgctacaacgattttgccaggatgtgtttaaagatattcacccttggtcccctttctgcagttccttggatcatgaaagatgtgtttggtttggttggcccttacagttcattttccttttgaatcccaatttaaaattttggatttttaaaaaatagaaataaaacttatggctttctttaaaataaaagaagacttagaccctaagtctgcatttttataggagttgatgaaagtttatgcccctttgaggagcatgtgaattccaggctgccatggttctcagcacttcctaatataccgtgtccaatatggagattgagttctggattattacctgcctgtagtactgattttcttagattggagaggattctccatcaggactgccaggtttctagcattggctttgcaacttactagctttatctaagcaaccttgtgcaagatatttaactttgggaacagtaatgatacctaactcataatgttgttatcatgagttaataaagtccttaaaaccaacctggcacttactgagtgcgcaagaggtatttgctgttgttgtcataattattgttagaaatagtagtaatagtaggaaattcaaatgtgggaagtaattctagttggaggggaaggttggcagttgtagtaatagtatttactaatgtttcaaggtagaaaaatgaaatatgaattaggaaagttacatgttccaagaaaaatgggacacatttattttcaaaaataaagaatgttcctgtattcaatgtgtaaatacagtgttttggtctcaaggagactataacttaagatgtcagctaatgtcactgattacctgcttgatttatgttgcttcattaaattcaagttagaaaagtgggttcattcttgatttcttttatccaaatcctactatcagttttatgtggttattgtttttttaaatcttttcaatatatatttttatattggaataatgttagatttacagaaaagtttcaatgatagtacagacggttcttatttaccccttacacaatttatctcttgttattaacattttacttttctgtggcacattagtcaaaactaagaaactggcattgatacacggctattaactcaactatagactttctttggatttcaccagttttcccatgaatattttctctctgttccagaccctaatgctgagttccccattgcatttgcgtgtcctatctttccagtctcctctggtctatgacagtttctcagtcttcccctgttttttttttttctgaccttgaatcatttatttatatcaacatttttatggattgaattgtattccccccaactcaaatttatatgttaaggccgggcctggtggctgatgcctgtaatcccagcactttgggaggccgaggctggtggactatttgaggtcaggagttcaagaccagcctgaccaacatggtgaaaccacatctgtactaaaaaagtaaaaaaattagccaggtggtagtggtgcatgcctgtaatcccagctgctcggaaggctgaggcaagagaatcacttgagcctgggagggggaggttgtggtgagctgagattgcaccactacactctagtctgggtgacagagtgagaccctgccaatttatatgttaaaattcccaatacctcagaatgtgactgtatttaaagattggtcctttaaagagataattaaattaaaatgaggtcatatgaatggaccctaattccatatgactggtgtccttataggaagagattaggacacagccatgcacagagaaaagaccatgaaagtatagagggagaggccaccatctataagccaagggcagaggccgcagatgaaaagagtcctgctgacaccttcatcttggacttctagtccctagaactgtgaggaggtaaattactgttgtttaagtctccaagtctgtggaatttattatggtagccttagaaactaattcaagtatggactcatataagtcatctttgaacttttcattacaatccaattctatgttgtttatatcgtggctcaaatgattccagctttgacgtggtctccctctcatgttggttcctctgtcctcttagcatgtacctacacttgtgatttttgggcacttttctgatactacaagatgttccaggtttgttttgttttttccttgccctggcgctaaaatcagttatttctccaaagagtgaggttccttttacttgtgaatggcattaaaaaaccaagacctatggtaccaggttttgatccctgacctgtggcaccactttcaacataccatggttctgtagcagtgctggctgggaggcttaattcttgcctgttaagcatggccttcagtttggaagcccagtcgctctccaaggtcctgattttgaaaggcttttctttattgtgtgccaggaaagacagaggagaaaatagacaagaacataacatttaagcacaggtacagtcattctctgttcttttcacatttatgatgctaataaaagaaggaagatatattacatgagttaaagaaatttagaaatgttagaatttaagaagtagtgcctgtctctttgcaaatccatttcttgaagaggacaagtgagcctctttaaggagaaaattcaataagatacgtggaaacagagcttacataacttcagattttcctaacatcgtgtcttagggatgacagttcaagagaaaatgtgctaaagctgtgacttgaagggtttatttagatatgtgcatttcctgacaggcgagattagtggattctggaaaaagcaataaaaaggtttacagaattttcttctaattctgctgataaacagatgcaaactggcttaaactctgctgggattaaaatatttccgattcagtatttcatcaggtataaatgtggtttttcatccacatttcatttatgaggcagatgaaacattgagatctttttgattctgtgcatgcatttgatagtacacctccttggataaccaatattatgatatgcaatactttttttctacatttctctaacatgctgatctgtggagataggtggaggaggtagtgcttgttataattaaataatcacacattagttttcactaaggatctttcatcgaaggatgttaagagcaaaatggattctgcattattgctgcagtagatttttaattttactgttaataagcattaaagtcccacagcatgcaatattttgtttcttcccttttaaagaattaaatttggtgttttcccttagagcttgattgatttgctagattaaaaagcatttaaaatcattgtttaacacatggaaaaacatattgattgttgcagttctttataaagaaaaaagtacagtttggttccctgaaaaatacatgaattcttttagctgactcttagaaattaagacacatgtatctacaagtaggtttgggccaagaatgttccctgccccaactccgtgaaaaatttccattacatcagatacttctaggattgtatattcccttggaagatcacaaaggacatccgtctccacctttgcttaaacctaagtgatctttataaagaaaagactctttaatgtttagtagagatgtcacagaagtagacatatattagcatctttaaatgtctgctcagatttttcgtaactctcattgcattcatcctcctcttcaattgttaaaaattatagtcaattttctaaatttcaagacaggatctcactcccattgcccaggctgaagtacagtgtcgtgatcatggcacttgacctcctgggttcaggtgaccctcccacctcaccctcccaagtagctgggaccacaggcatacaccaccatgcccagctaattttttatatttttagtagagaagggatctcactatgtggccaaggctggtctcaaactcctaggtttaagcagtctgcccttcttggcctctctaagtgcggagattacaggcatgagccacagtgcttggcctcaatttttatctccctagaatatttatgattctttctgaatatcagttgcaaacccaaatctatatgataactaatcttccagaaattctaccccacaagacagagtcaactgtatacatgaagacatttatgaactctgttttcttttaggctcaacgatacttcttggcatatttttaacttttgtttataggccgttattaattttgaagtacctggtattgcttgtgtggaaataaatctgcattcgagtaattttaactctatgatttgggcgctaataatacttattgcaagagcatcctgaagtagtctcgggctaggtaattcatctagttcatcctcttcgtttcaggaaagtggatttcctagcctattcaagcagctatcacaaaataccccaagcagggtgtggcttagaaacagcagaacttgacttctcaccattctggagaccgagaagtccaagatgaaaatgtatttggtgtctgctgaggggtcactctccaacttcaatagcacctccttgtcaagtcctcgaatagtggaaggggtgagagagctctgtggggtctcttttatcagggcactcatcccattcaggagggttctgccctcatgccctcatcacctcccaaaggccccacctcctaatcttgggggttaggattttgacacgtgggaaacaaaaacatttgcccatagcaggctgctgggacagaatacagttcaggggctgcaagtccaaagccaggtgccagcaaagtcaaagtccaaaggcaaatgaacccagcagggctaatctccagcaaagcttctctgcttggcttgcagaggccagcttctggctgggtcctcacctgtcctttctgaatgcacgcactcttttggggtctcttcctcttcttttaagaacagtgccctattggatcaggcctccccacctcatttaaccttaattgccttcttagaggccccatctctaatgcaatcacaatggcagtgggggctagtgcttcagcatatgaattttggagacacaattctgtccataactgtaggtttttggttatctctggaaatggaaatgctttactttctaatttcccacaatccagagaagcaatatctttttttttcaactttagaaatcttttgaagttttgcattgttatacagcacttattcaatgccgcccaatccgagtgacttcatctcactcgacgacctcacctgactattccctggcctctgccctgcccagggcacacactgtggcaggtgagtgcttgtgcatgggcacacaaggcagatgcctgggtgttctgggcgtgctttttgcctgagatgttccatgacctggtctggtgtctcacaaagcctcctcatgagaaacacctttcttagggaaataccttgtgttgctcttttagaagattccacatgtggtccaagaggcatcagcatcccctgggagttcatgagaaatgcagctcagacccccatcccagccctcctgagggagaacctgcacttcttgagattcccccactgacctccaggcttaggaaagtgagagacacgctgccctaaagtggtcctcggtatagattcaaggcagctgcccaccccagtcatccaattccttgggctatcttaaattcttttccagtctcttctacttagtttaaataaatcaagtcacactttttctccagggactcatttccctcaaacactatatctgatgtttctgcacctactgggtttttatgcagttatgcagagatcacaggctgtttctatggatctttgcatattgcaggaatctttttgatagtgaggtaatttgtgctgaatcaaaaggctgacatgcaaagagagtatggtggcgtgtactaaaggctttatggtaatttttgttccatttcaccatcttttattcatatgccattttgatttttctagagcgaatatataggatattatctgaatccattttctcaaagctacgttttaacaacatttagtttgggacatttatttcgtattgaacacacaaaatgtttgctaaataaaggcttcaaatagcaacccctcccctgtttggtattttttcattgtttatcattggacttttagaagtgtaaataagatgtgtgagtcaaattctttctttgtaactgcttgaaaaattcagtaaccaattatttataataattggaaattaaatgagaatcaaaattcccagtgagtatatggcaagtttgttatttcctttctaccaataatgaatgataatgagtcaaataaaagcaatttgctttttcatgaaaagtagtgatgattattttaacaatcacaaaatgctttcctgaacatgttcttttatcatttctgtagtattgaactttaaaaaaagatatcattgagaataagtgaagcatggaacctgtaaattgcctgtttttgaagccatcgtgtccatcatttttagtgagagaataatgttctgatatctccacttgacatcttagactctattgtgttataacttcccacaacttgccaaagggccattctaaacttttgctcttcaatcggccatcattacgggaatattggcttccaatttttgtgtactaatatgaatttggctcatgaatgttactactccgaccaacaaaattcaaatgctccacaaaaagagaagagcctgtctagcacaaagatcttttcagcttttgagtttcctcttccctatcaatcatggggtttaatttaaattaaaaaggaaacattctttcaagatacatagtgtgaatcaatcaatcaatcgtacagtcttcctttacctaaattaatcacctttataatccttttagtggttcttgatctcttataggatacaatcaaaattccccatcttgatatctaaagcttcttaagctgaatcccatctcccttatcacttctttttatcatctctctctctactttcctttacacatattctattccaaataacctacatgttataccccaagccttactcagtcattcctcagagctgcgtttttatctgtggttacaaaacagatctgctgtcagaccagtcctgacttgacctttctgtgaggttgccatcaggtgtcggctggggctgtgtcttctgaaggatagggctggatagggctggaggagcctccacctaactgtcccccttgtgtggctgtcaagttagtgctggccccacacaggttgccgaagggtgctcacggcatggtgcctggtgtcttccatagagatacacgagtccaaatctgaagctctggtggctttggtaatccagcctctgaagtcacacactgtcacttccagtatgttctgcaggccacttgtagccagccctgatggagtttggaagggagtgagtagcaagaggcctgggtcccaagggtcatcttgaaggctggccactgcagggcctttgtccataccaacaaagctcaccctggcccatctctgcatgcttccttccacaccctgatagatccttcttcctctaggagccttcctgacccactctagattgaagcaactcaccacacacctgaaaccctttagcacatactatctagaccaagcaggtggtacatgttatattcacatgtagaagactcatccctggttgagtgacactctagataaatcactcaaggttccagctcttaaaagattaccttccatatggtggtatgaacagagattccctaatgaccactactcagaattaagaaggtaaaatatgccgcatataatatattcaattccttcaacactgtgtggctttggctaaagttaacttgccttcctcaagcatgcttaaatttggtgtgagtagtaggtctgtggcaactttgcagagttttgtggagaatttcctattacaaattctctaggttgtgagctctgcggtacaagtggctatgtgagactaatgagacattaagatcctgtttaaaggtgcctgtgggtccctgagctatcttgggctcccttctgaataagcaaaagggattaacttgggctcagtatgatgtaggttaaattttgacccagcagttgaactcttttagaagaataaatctattgatagtagcgttgggcagtactctgtcatctagaatgccccattttctggccaggctggagaagtgcattttcagtactggaaagctgagtcattttccccgttacagattgagttggacacctcctttgaggcatccaaaaatgacagggatttcagatgaagcaaggctagaattgtactcgatggacttgaacttgaacctgcagcttctcaccctccctgctacaacccttgtgttggagttgcataacttctgggagaaccatgccagagagttatagtagtccccacttatcctcagtttcactttctgcagtctcaattacctgtggtcaactgagatccaaaagtattaaatagaaaattccagagataaacaattcataggttttaaattgcacactgttctgagtagcattatgaaatctcacaccgtcctgctccatcctgctccgtcctgttctgggacatgaatcagtcctgtgtccagcatctcaggctgtgtacaccaccctcccattagtcagcaacatcatcttctgacagccaaccatggacatcatcatgccgatgattcaggatcacccaagcagatgatcctgcttctaacctattgtcagaaggtcagtagtaagctaacacaacacgatgcctgtgtcattccccagacttcatctcatataggcattgtatcatctcagatcatcacaagaagaaaggtgagtacagtacaggaagatattttgtgacagtgagagagagagaaaccacagtcacataacttgcattgcagtacattgttatacatgttctattttattattaattctaaaaataaaatctcttactgtgcctcacttataaatgacactgtatcatagctatgtatgtataggaaaaacagcacatatcaggttcagtgacatctgcagtttcaggcatccactgggggcatccccttggcgtgtattctcccccaccaaggatcaggggagcaattgtaattctctgctaaattctagtctgtcaggatacttagtgtttacgaatttgaataaatatgagtaaaaacgaattatagaaatgcggttttcctgctttcaagtgcaaacattgacctcagtggacaactcaggaaacgtttctagatccagcttctaggaggcctgtggctagctggctccctctgtatgcaaaccattcacatgcaaaatctcttgagcaattcctgtctaaaaggggctcataggctccgtgaaatcatgtttacagtttcaccttgcttaccaaggcctttttggttctagacaaaaagtctattacaacccatgtcaagctgtgatattattcaaatcactggagtctgatttcaatgatcgttttctatgcacagcttcaggatactcagcctatcacccaggaggtgaatgaagcaagtctgaggtgtctgggctacttgactttcgggtgatctcagggaacatctccccaccaattactttcaagactgactcgctgacatggaaattccttatctggaatggtttctgtctgtggttgcaatgcttttccaattttcatctacatgaaactctcccagaaatcttaaaatgtagtttttgttgcagtaggtttggggtgatggccccccatgctgctagtccacgtaccaagcactggaggtatttaaatgcacaagcccctagaaaaataatgcctgagactttctaaacggaagtcctatctgtagctcaggccattcccgtaagccccagcctgtgaaggctccctaggcacctgaggtgggctaggccctgacctgatttcatgacttctcccttgggtttttccctccccacctcccaccccgctcccagaagcgaagagatggcttcaccttctttactccctgccttgggcagtggctccaacatcttcacactctctcaagtcggacagttcattcatcttatttcctcactcccaccacaagtcagttactctgtcctttggatggtgatcatgtgcatgatggctgtgtcatgtttcccatctgcatttagtcctccccatcttcatggctactctgtgccagctactctgtgccaccctcatcgcctcttgcctaaactcttcaaaccagtgcaaaagcgacctcttatttgcttttgtaattcattcttcactgttttgccaaagggccattacaatacattgacagaatattattacccttcctcaaaatcatttgtgtctctccatggccaaaaccctttcacaagagatcactttgataaacaattaccacctgctcatagcctataatccaaccatactgggaaatgtatcctttagtagataggacctgcatttgcaggagtctttgtctcctaattttccttcagccagaaaccatctcctcctccagcatgccatagcagaacctaaaaagtctgcttcccttctaaacttctgtgtcaatttcactttctgcaggaagccaaccccaattccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaagcgtttcttgagtgttttttcttagattgtgcgaaaggaaagtgtgaaagatgaaaggaaatcccataatgaaataatgaaagagagtggacaggggacggctggaatagctgatgtcaaatgtacctgaaacacagctctatctgtgagtcctagagggtaggaaataacagtgacctcataagaaaccattcctctccctgctccctactttacaaccagattatattacttctgccctccttgggaaatgctatgttaaatgttatttttctgcaatttgtaatgacctttatatctgaaagacagttcctataaaaacatgagattgagaacccatcaaacaagtatctctaccatcaactaaaataagcaccatggacccttcttaagaagtgagggtctcatgtttcaggacaagcgtgttcaagtaccaccagccaggaaggccaaccagggcaaggctgtgcattccagaccctccagggctatggcgtcaggcacttgacctgtgttttaggcaattgtgagttaatggaaatgatattagcaatcataggcaatgactaatatttaccaagcatttagggaattggatcagtgactgctggaaatggaatacaagaattaatgttccaggaattaataatgatcctcagaaaagcttatggcttcatccacaggcttttgtcattttagtattaaaggcaaagcaatgaagagactgtggctcattcctctttccttgaatgggcgtttgcatgtttcaacacgctggaaggttaccttcttaaaatgccagctcattattcgtgtgaaagtgatcatacattggtattaaatgaagagtagaggcttatcattttagacatgatgggtatgctttatttacagatagtcatccttccaggagttaaattcacattgactattttttaaaatagtgctcacagcttagttctggatatgtttgcgttttccatctctcttggctgcttgagaacagagcgtccttaggaaaggacaagtcctgtgcagaatgcgttctcctttctcccacatttgcatttgcggggagaggcgtgcctgctgttgtgcacttcaccagcgacctcccacacccttggttctgccctgggcttgtcttcctttttctttccttctcttgaaggggttacagcccgaagcctgaaggaaaccagtctataaaactggtgaacgctgtctggatagagagaacagccctcgaattttgaagcgcagtttgtgtaagagtttatgggctctggatcatctgatagttctatttttagttttttgaggaacctctatactctttttctcataacagcagcaccgttttgaattcccaccagcagtgtgctccagggtgtttccaaaataagtgaaatcaggatgtcaaagagacaccagcacccccatgcccatctgcagcaccattcacggcagccgaggtgtggaaacaatgtaaacgtccattgaaatgtggaaacaatgtaaatgcctttgacggatggttgggtaaagaaaatgtgttatgtacatacaatggaatattattcagccttacaagagaaggagaaggccggcacggtggcttttgcctgtaatcccaacactttgggaggctgaggcaggcggaccacctgaggtcaggagtttgagactagcctggccaaaatggtgaaaccctgtctctactaaaagcacaaaaattagctgggcgtggtggcgggcacctgtaatcccagctactcgggatgctgaggcagagaattgcttgaacccaagaggcggaggttgtagtcagccgagatggagccactgcactccagcctgggcaacaacagctagaagagagaaggagatcctgccacttgtgacaacatggatgaatctggaaaatgtaatgctaagtcaaataagccagtcacggagggacaaataccgtgtgattccactcataggaggtatctaaagtagtcagactcatggaaggagagaatagaattgtggttgccaggcactgggaggagggaaatgaggagttattaatgaacaggtataaaatttcagcgatgggggtgggtagggcatgaggaaatacagtcaaaaaatgcaaagtttccatttgacaggaggaataagttttggagatctattgcacggcatggtaactatagttaataataatgtgtatttcaaaattgctaaaagagtagattttaaatgttctcacaacaaaaaataagtatgagatgatgaatatgttaatcagcttggtttaatcattccacaatgtatacatccatcaaaacattccactgtagcccgtaagcatattcatttactatttgtcaattttttttccaaaaaatcattatgcaaaatgagtaagttctacaaatctgctctacaacattgtgcctatagataacaatgctggcattttgcacttaaatctgttaagagagatgatcttatatgaagtgttcttaccacaataaaactttaaaaaataaaaataataaaataaggcaaagtttaaaaaaaaatgttcgtgagctctggaactaagcataccaggattcgaagtctgagtctcccaattactaagtgtgtgactttgggcacccacgtcacgtctgacactcagttctacatctgtaagtgaatataacaatgcctaattttcagcatcattacaagaagtatagatcctgccgcagggtcttgcatggggcagtaaccagaaacttgtagctactgttgtgtgactgccatactgtctttggcccttgtaagctatgtgattttagacaaataatttgcatgtcagtttctttttttttttttttcctttttttgagatggggtgttgctcttcttacccaggctggaatgcaatggtacaatctcagctcactgcaacctccgcctcccaggttcaaccaattctcttgcatcatcctcctcagtagctgggattacaggcgtgcaccaccacgcccagctaactttttgtgtttttagtagagacagggtttcaccatgttggccaggctggtcttgaactcctgacctcaggtgatctgcccacctcggcctcccaaaacgctgggattacgggcatgagccactgcgcctggcctttgagtgtcagtttctatgccttagaaagaggggattggagactggatgatctatggggagggtggtctaagactttgatgtgtatgagttgtaaagtaacataatagatccaaatgacaccaaaagcttttgctgaacccagtcagttgagtcaaacaagtcattagtggagaacggaaccagctatttaaattaaacactggcatgtgcctggtttattacagtggccccagtgcccagcatgttgtaggcactcaggagacatttatttaatgattgaaaagcatcagtcagagctacaggacatagaaagcacatttgaaacagttgagaagatgtaatgaagtaacaacttagtaaagaatggacagggtcaggaaagcaggaaaacgtggtgaaacattctgggattagaatcgcaagaagttgctaccaccctttggcccaagggagcagttagtgaaactcagcaaatgtctgtagttacagagaaagaggaaggacaggatctgtgggaataaatacctgaattctctcctgactttttgatctcttggtcaagcctcaaatctattggccaaacctaactaaaagctggagcacaaggaaatcaggttgaggctggtctgcagaggtcactcttcctagacaaagagcagatggaaaagggagcaaaaaggatctgcagggacaagtgaagaacatacagcactctaaagaagcttcccatagaagcaaatttgtgtatgtgggtgggaactaggatattttatttgtttggggatgcttttattacaggtaaaagcaataactgcatattttggtctgagatgtattttttctactaataaaattaataggctaataagggcaatgatcaccttcaaaaaacacacaattttcgctagttaatgccaggtctgatcagcacattttagatggatggatggttgaatgggtcaatgggtagatggatggttggatggatggatggatgaggaggaggtggtagatggataggtgaatgggtaggtggatgggtgggtggatgggtggatggatggatggtgagtgggtgggtagatggatgggtgagtggatgaaaggttgagtggatgggtgggtgggaggtgggtggcttggctaagttaggattgctacctttaaaagcatagcaatggtaacatagagtatcggccaggcaacaacatttagccagaaaagacagatccagagcagggtctcccagctggcttgcaataaataaattactttttcgtaattttgtcaaaaacgttcaatgtgcttggttttaatgaccaggaaatatctagctgtgttgaagccccccatctcagggggaggtattacctgctgatggttctcggcttgttgaaagttcacatcctaagagtgtgtgttgttgttagtgtgattacagaaaatctgcgccctctttctaacctgtgtcaaagataaacaaggcatgacacaaggtggtaagaacagattttaatcagcaacaactattgcaatagggaaaagaatacaacgtgaactaaattcaacttccatttgtacagcagtgactgggcatttataaaaggagaaggaaggagtggagagagttaagcaggatttagtagagtcagggaggtgaaaaactccgagggttagtcatgtgataatgtcggtggtgtctgcgaactggcaattatggaagttaggattccatcctcccacagagaccagacacagaggctctgtcctcaggtgtcagctggaacaagtcataagctcttttggcaggtgtgacttttctctggcaggcacttctggttgggggacagccagggccatcctaggaatgtgaccttgttctgttagaaactgtgctagtgtttgttcaagtctttatagaccgagcttaaggcctagttaaaaaaggattcagagaaatctgactcaagtttggtcaaagagagagtccttgccaattgttattctttaggcatttagatatctctgaatacccaaacagagaatacagacaaaaaggaataagcaaactatgttgtcaaggaacagttttattgtcaaaatgtatctcagtgatgattaatgaattggaaagttataagatgcctctattaatcacttttctaaatgagttgagttttgcagcacagctgaaaattttgatttcattgtttaaagcaaattttggaaagaactattgagtgcaagttaaagccggaaactcacagaggcaaagaaacatagaggatggtctgttcccctactgccatagactctataaagagcttgtttcacggcctttgttttcaatgttcctcctatggaaaaaataattgccagttttcccaccaatgtggacacatatatgaaaattttttgactcttcccaatcatttgtaaaaatgatactatcctctcctgtttttgcacgccattagagagatgaggtgcaagtgtaccataggcctagaaaccttgcaatgtcagctacgcactgtttatctcaactcacatacgcagatatttgttgcagattagggtgttgtctgtaaagaaagaaaagtgttcaaagaaaacctgctaggtgatgtatttgttttcgcttattgctgttacaaattaccacaaacttagtgacttaaaacaacataaatttattatcatatgagatccaaagtctgaaatgggcttcaagtagctcaaatcaaagtgtctgcagggctaattccttctggaggctccagcagggaatctgtttcctgcttctagaggcttctacatgtcttggctcacggctctttcctccgccttcagagccagcaatcgctgcctgtgtttttctaatatcatattacttgacaccgactcttctccctccctcttccacatttaagtacccttataattaaaattgagcccacgtggataattcaggataatctcctgttttcaagccaaccaattaggaatactaactccatctgctgcccagttcacgtaacgtagccacaggttctgggaattaggatttagatgtctttgggcggccttgttcattacaatgaagcaatttccatctgctgcagattctagatctagaagttgccacttgacaactgcgtgactttaggtaaatctcctgacacttaaatgcttccctggctcttctcatttgcaagttgaaggcactgtgttaggtaacctctgccatctctttcagagccctccaagtttgaggaatccttttgatcaaaggtgaaggtcatgaagtgtaatttgctttgccgtggttattgcattctcgttgattgattttttggattggatacccatgaagtcttatgcacatttaaagttaattatttcttcattatataattaaatgtagatgagtcccagtgtaaagtgtcagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggtctctgctcagtgggccatcgctcatgttttgaaagcactggctttgtccctatgtgagcttgctagttagttgatacatgcaggagtgtggtggcctcaggggaatggaatttctttcttctgtttataggttagtttggggaaaaaaatgtgtgtgtgtgtgtgggtgtgtgtgtgtgtgtgtgtgtgtgtgtgtgtgtttactgagatggagtctcattctgaatcctaggctggagtgcagtggcatgatcatagctcactgcagccttgaccttctgggctcaagcaatcctcccacctcagcctcccaagtagctgggcctacaggcacacaccactatgcctggctaatttttaaatgttttgtagagatggggtctctctatgttgcccaggctgattttgaactcttggtctcaagtgatcctcccacctcaatctcccaaagtcctggaattacaggtgtgagccactgtgcctagccaaaaatattgtgcatatttttaagcactggttggcattaagtttgagggttacagggctaaaacaaaagatgagattttactacaaaaagaacttggaggctcttttagaattggattcaactttcttcctgctatagagactatagattgcttgatttatgatgcgagatttgattcttcatgtcatcttgccaacacagccgctgcagttgtcttgttactccagctctttacccagcatactgtttgccagttgaatgttattcaagccagaagtttggcaaaacactttggtacaataaaaatatatttaagaatttaacattttggctttttattgtagtattgagtagggaatgggaaattagccaatgataggactactagggtctacattcgaaagaacttttatagcacaatcttttggtaacttatttggttgaggacgtactaaatacaaataatcatgtgggaatttggtgagctatggtaatgaatatgacgtgagatgacttcagaggagtttgcagttccgtagtagagacagacacgtgtagaaaatcctgtattggtcttcttccttgttgaccgtagtgctttcagtggggtgcatctcattagaacgttgtgattgggacatacaagtggaaggtttctttaatgtctggttcccatatcggtgagacatagccttaatgtattattctccagaggggcaaaccatccaagactattttagaattaaggacttgctgctctggttacttggtcactgttgagaggatgtgttggaatgacatagcaaaccatgagatgatggttttggaaaaacatcagccgagtaagttatttggtactctgccttaaaaaaaaaaaaaaaaaaaaaaactgagccataaatattcaaaaaagtttgtatgcacagaacacaaaattccaagagaattatttgtttcctaccctaggagtcaaaagtgtttgtttagaataatgtgtaagagtttcttaccccgcccccaggattaccaattcctttaacaatgccctttatttgtgcatcagtgctagtaggtttttcttttaatcagaaataattttggtgagcgtgtctatgcacacagaaatagctactaagatcattaatattttattgttgaaagcagttttatcttataatcacattttcatttgatgtttttagttttctgcttctctcacataaatgcatggtgtcgagagaggcacaagtatttttgtctctaatatcttaaaaattaggattaagtgcattctgtattgttttgtattcacaaaatagttttgaaaaagcttgagattaagtgaaatttgtatgtttttaaccatagtttttgtgggacaaatttacgctttatctctttggtttagatgtggttgacatattgatgcatgtattctctttattctgtaggctttctttttccttagaaatgaagtcacattcagtagttaaataatactttactcaaaagtacagtgatttgaaaataaccttcaactgtcagaagaggctgaacttgactgaaatgtggcctcctaactgaatattgcacatgaatcttaacagaagttatcataaacatttaaatatttgcacttggtatttagacattgattttcaccaataactgaatagatataaagcctatttttcttctttagccctcatgaatatcaattcagtttgttttttgtttcttctgggtgattcatagatgaatgcctagtgtcttcatttgcaagctgttcatggaaggaagccacttttctgttgcctctgtaaccattgcagggccttcaatagcagccttcagacactaggcatgcattcagcattggaataaataggatagccaagggtagctaattattttcaggttaattcctaaagagttaatttgcactgccttgcccaaaatcaaaccagcagaacattttattaagcaaggcttttgtgtgagtggtatggaagcactgaatcagttgctgtttcttttaatctaaattatcgtcattttgagctttatattaatacactggctgagtaactttgtttaaaagaaacctaggtaaattgatagttctatgttctaaattcttctgaataagaaaacagtgatctgccagatgaaaaaggcaattcagaatgtgacataacttctgttgagagatttttgttgaaaattgggaagtatgaattcttcacagactttcataaaatatttcaatactcttatttttaaaaaaccttgaaaagtcagaaatcagttagaataattgacttctaggcatagaaaaattcatttaaattttatttatcctggatgtcttcttttttagcataatacacctaaaacagatattccactaatatagagtgattgaagtattcagaggaagattgcattttaaagctataaagaacatttaagagtaaatgtggaaaacagtatgcagatttcttaaaagaactaaaaggatacctgccattcaatccagcaaccccactatttggtatctacccaaaggaagagaagtcgttatatcaaaaacacacctgcacgcataggcttactgcaaaaaaaattcacaactgcaaagatatggaatcgacctaagtgtccatcaaccaatgagtggataaggaagatgtggtatatatgcaccatggaatactactcagccataaaaataacgaaataatgtcttttgcagcaacttggatggagctggaggccattgtcctaagtgatataactcaggaatggaaaacctaatattgttatgttctcacttacaagtggcagctaagctatgggtatgcaaggcatacagagtggtataatagatttggagactcgcaagtggggagagcggaaggggtatgagggataaaaagacacatattgggtacaacgtacagtgttaagatgatgggtgcactaaacgctcagacttcagcactgtacgcttcatccacgtaaccaaaaaccacttgtacctcaaaagctattaaaataaaataaaacataaaacaaaataaagagaatatatagcctacttccttaggttttatagtcaaagcaccactgatttagaatctaaaggcctggcctcaggtctgattctgctactttacatctgtgtgaccttgggcaagtctcttaacctctctgagcttctgcttcttaatctgttaaaaaaaaaaaaagcataatttgtcttatccttgttttgatcaaatgaatgagttctgggaaatccatccagctggtcagtggaatccacgtgcgagcacagcaaggcctaacgaatttgctgacgctcctctgaccacctagcttcacagatgggtgggcagccagacctacaacccaacccacgtctgccaagtcccagcctttccattcacctttcaagggaagaaaacttctcatgtattggaaagcacagtgcctctagtgcctctctttcttgattgttggagttgggtctctcagcattgtggttcactacgacagagcatcgcttttaacagccacataaaataaccctcttgggtaacacactcaagaggcttcgtgaactcgggaggcaatctgggcaggcttacagctgtgtgacaacacaaacgctgtttatttgagtgttatcaggaagatgtgtcactgtcatggttgaatatggagaaacaggtgcccgcctcggaatggctacccaagtcaaggaggacccaaggctaatgtggagaccacgttcctccctggagtaccggggttaggcagggcttgaatgaggtgcagcgaggccggtgaaacacagcagtaccacgtgtcttatgtcacatcagcaatgcaggtcgcgctcgtcacagacatttcagatggagctgggtattatattccagtcctggcatttattatggtcaccaccagcacagagcgttcctggcctggtgctgtctggtttctggaatacaggccatccttcctgatattctaaagcctgcctcccaccctcaaagagtcagacggcaagtttccatccaccctcccagttctcagcctttgaaggtgagaagctcctcttctaggggccgctgtcagaatctcagggtttggcactgttgcgctcgcctccattccccaggctcctcgacggccttagatgcttaaacacgctgctgcctctcatctctggaccaaggctttcgtttccctgtgagtagacagcactaaggcacggggttagtttaatgatgcaagtcaactggggagccttgctgctatagagataccctttgtatgtttactttaacttcttgcatcagtcaattcaggctgttgtagcagaataccacagactgcacagcttaagcagcagcaatgtattccttatgattctggaggctggggaatctgaagtcagtgtgctggcgtggtcaggtctggtttgtagatggctattttcttgtatcctcacatggcagagagcacagagcaggctcttgagtctccttagaagggcactaagcccattcaccctcatgacctaattacctcctgaaggcccccctcctagtgctgtcacattggggagttaggatttcattgtatgaatctggggagacacaaacattcagcccatagcacttccccagccgtgcaacacaggtgccctttggtggtgtttgcataggtcatggctgctgatagccaccgtgtgttgactgcccactctgtgcttgacgctctgctagaggctctttatgttgtctttaatcctcacttcagtgctgcaagggctgtgttattcccagctgacatatgagcttccaggagtttaatggatggaagctcagctggcacatggtggaggcaaacccagggatgtctgactcattcgaatgtttctttcgttaagttaagtcttccattcaggaaaccaatattgcaagttcaacgtgtgaaaatgtcactaggctccacggtgctagagaggtggatcctgatgatgtcctgtgctcacggcgcttactttgattggcacccagagagaagacatgagcaacactggttgtgttcagatgagagacagtgcacctcaagggaagtgttggtgaagtcctcagaggaaggaggaacgcaaaggcctgtgttcagaacaccgtggtgccctgagaacagctgccaaggatgctcgctgggagccacaggccaccagggggaagcgccaaggccgtctttcaagatgcagttacatcatcactgagcagcaccagctcagggctgctccagcaagcctagacccaccctgcttccctgcgccactccccagggcctgctccacaccacccacaaaaggcaggcggacagtggaagaacactccaggcccccagctccaaaggctcagatagccgctgtcgtcaaaacctcatgtcaggctctgtttttctttcctttcttttcttttcttttcttttcttttcttttcttttcttttcttttcttttcttttcttttctttcttttattatttctttctttctttctttttttttttttttttgagatggaatcttgctcttgttgcccaggctggagtacagtggcatgatctcagttcaccacaacctctacctcccaagctcaagcaattttcctgcctcagcttcccgagtagctgggatgacaggtgcatgccaccacgcctggctaatttttgtatttttagtagagacagggtttctccatgttggtcaggctggtctcaaactcctgacctcgtgatccgcccacctcagcctcccaaagtgctgggattacaggcgagagccaccgcacccagcctttccttctccctttcttacccgacttccttggaattggtattcaggaccttccttttctcctggtatctgcccagtgatccaggacagcgctcagctcctggtagccctgggctctgtggtttcaggctgggtgcatctgttcctgtgccctgatctcagcctggcccagctccttggcctctccaccctccacttcccttggaagaaaaaatgggggtaacggtaaggaggtgctctgagtaaagcagtttccgggtccaaaataattcaaagaaatgaagagcaaaaatcacagtacaagtagtttagcttttcctcagttaatctgccataatattaagtaaagctagttttaagtatttaggctctaatgaattccatgtactaagttgcctggctgttttctaatacatgttatttgaagattctcttgaaaattgcttatatcatgctgctatgttacaagaacatggttttcacgcattctggtatggaatgtgtatgttgctgtcacttatttaataataatagtcacaattaatcagtacaaatatttatggccctaagtaccctgagatctgttgcttgatacatgtctgaacattttggacaaaaagaggccagtgtgggacaatgagatagccttttaatagagagattcttttctcttaacaatgatctaggggttttcggggggaaacacacacccccttctccatcgggaccgaaactgctcttgtccgtgtgttctgtcacacgtagatgaacaggctttcaacacctgcactggattttataatgcattgggtttggttattgtcattattgtttttaccagtttatttattcattatggtgctagccacaaagcttatgcatgctgagcgtgggtttcaaattttgagtttttttgaaacattcaagacacggaagtgggcatcacaggtcatgagttctgttcgataatgatgtcactggtcacccatgttgcttttgacttggtaaaagaaaaattgtacttaggaaaagctgccctcatataatgtgtactcatatggtagttaaataagtccagtcaagggctgtaagacagccaatcagaatcttgtttctaaatgggcatgtttctaaactggtctatgatgtgctaatggacagaattttgcatttggaaaattgccatcacaaactcttgagccttccattcttaaaccagttgcaaggggctttaccaaactgacttatccaggttacagatataacaagttcctgtaggtaatggctctcatactagactgcaagtttttttttttttttttttttttttttgagacagagtctcactctgttgcccaggctggagtgcagtggcacaatctcagcccactgcaacctctgcctcccaggttcaagcaattctcctgtctcagcctcccaagtagctgagacagggactacaggtgcatgccaccgtgcctgactaatttttgcattttttttgtttttgtttttttagtagagatggggtttcaacctattggccaggctggtcttgaactcctgacctcaggtgatccggccgcctcagcctcccgaagtgctgtgattacaggcatgagccccctcgcccggcctcatacttcattgtttataagcgtgtactgggcacattgtgaaacacaaacgttctcccaccctgtccccagagactccagttcagagggtccaggaatctgcatttgacgtgcacacccgggggttctaaggctatttttgtaccatcattttgagaaatacatgaagctatttcaaacactcctcataatgtcaattagtcttctccttctgtcctaggaactagataattattatttcttttgtccaaaatcctttggattatacaaatgcattatatctggaggcagtaattaagctctggcctggcccacttttctccagataagtacactgattaccttcgcgtttccttacaggtccaactttccaacaaaatcatcactgtttgctttcctttaggcctacacgttcttttcctctgttacacaatgtctgaagtaaaacaaagatttctgtctttcctttcatgttgtacatgttgtgactaaaacacatgcctcaggtctcagtctatcttaaactgtggttatttctttaaaatccattttacctataagaacaataaaggcgtcttcaggctttttaaacctgtaacaatttaaagacattgggtcataaaataatgtttaacctggactgatacaattaaaataaaacattaacagtctgaattttgtttaagatagaaacttagccctcttgttcctggtatgtgcgacttcatgaaaacccaagtttcgctacttaaagtgcagactatgtttctatagtttcaggtagaaattatttggaaatgtaccatgctgctgtaaaacaaacaaaaagccaccctaagcccgtattttctccttttgtgacactgcagagttatagtttccacacagatatcgtgcctgcagggcctttagaagcatgtggctgctggctttcaccctgaaggtccagactgctggactcttcagccgccgcttcacccttccctctctgcttgctgctggctttggggttgggatctgcttcccactctcctgcatctgacgtgctcttccatttttctcccagtccatcatggtaaattcttgtcttcatattccttctcttctcccacctttgtttctgagctgctcacctgagctgtgggagtgcaactgggatcatcagcattttccaatcaaagtgctcttatcttctgatcagcaaaataacccatcacagaaatgactgaattaatgactctctagacagttgagtctcttccacgtttttgatcagggcctgctcatactcagacatttcttgtttgttgttgttgcttttatgttcatggctgttcccaagcagagagaatttattttattctatttttatttttattttttgagatggagtctcgctctggtcacccaggctaaagtgcagtggtgcaatctcggctcactgcaacctctgcctcccaggttctcaagcaattctcctgcctcagcctcccaagtagctgggattacaggcacacgcccttatgccccattactttttgtatttttagtagagatagtgtttcaccatgttggccaggctggtgttgaactcctgacctcaggtgatccacctgtctcagcctcccaaagtgctggaattacaggcatgagccaccattcctggctgagaatttcatttaaattgtggattactaggcattaattatgtttgtgtgagagagagtggcagagggacattgaaagagcaacagggacagagagacagagagagaacaaggagaaggaggacgagagagaaagaaagagggaggaatgggagggggtactgagagatcacaccaaattcattgcacgttcctgtgagttgctgccacacgctgcactgggccaacgctttcccaccagtttcactagtggagatgacctcatcggatcctctttgccatcttctgtgaggttggaaccatgcagagtcctgcattttcctccatctacccctaagtccttgtgttaattatgatctgtgttggcttttatcacctttgtggaaagagaagagccaccaataatgaagactgagtaaatgagccagtgaaacagagacggggatgtgcaccccccaggctcctggatgattattgacggacacgtgtcagctgctaaatgttatttaaaacttgttcttgccatcctatcatcatttgctgtcctcctgaatatggaaatacaatgattagaaggctgttttaccatcctgagatatgtgcaccattgattttgtaatttgttgctaccttctacttatagtaaatggtccatgatacataaaagaaatttatgtcagagcttttcacagtgaataaatattaggaagaaaatacatttagacaatagaaggaagcagtgtaatgggagatcctgcagtcatgtatgtgtcgtttattttctcccaatattttttatagtagctgtgtgaatatcttactttttacggtgctcaattccacattggcctgatatttgacatattttaaggcacagtgggagaaggaaccaatcctgacctttctctaggcacttttctgatgtcagtagatgaactgaataattaatatctgacttcttctggaacttatttgaggtggcttacagaatcctcccctggcttcctattgtgttttggataaaaggcaagaccagtggcacggtccacgaggctgggcctggttttctttgtgcctgtctgtccagcttcatctcggatgcttcacgcctcactcctgacatgtagccacacatgcaccaggttacaaccgctccattgcatgggaaacctgccccagctggtcaccacctccttcctgtatactcttcaactctcagctcaaattctcttcctcagagcacccttgcttgccccaacacctcagtaaaaatcagcacatgccccatcattatacgccctcttgacacatggaattcctgcccactgccccacctcacagtgtcactgggtttgcctgaggtctctcccaccgcgtgcaagtgtagggatgtctcttcagttcagcacgttaggccaatgctcactgtcacaacattggtatccagtacacgtggttaaccattgctattgtgaaatattataatgcaaaaactatggaacatgtaaactcacagcttaatgggtgagtgtaacctgaatttcctaatgtgaaatagcccattcaggtctagaaacagaggacagccagtaccccgcagctcctgtaccttgacttcctctttccagtggcaacttctctctccccgttgagttatgcagcatcctggatttcatggaaatgtctttctggcttgtcttcatgaacttacgtgtgaaccactcacttagtgtagtttgcccactgtggaactttttacaaaaagaaatattcatcttatattctttactgtctgatctatgtcacttaaaattatatttgtgaggttcattcatgctgtgcatgtagtcagaggttgtgatttgcatggctatatggcattctgttacatggaatacaccactctggtagacagaccaatgacaccccatgaagatgtccgtatcccattccctggtacctgtgactatgttagcttccctgacaaaggagactaaggttacaggtgaataaagatagtaagattactcatcaattgcctctctgcagccaatcatttctctgatgctatttgtttttccattatactggattatgtgaaaattctgatactaggctaatagctgtttaacatggatctaatgaatagattccattctaggccagctatagtttaaaaatactacagctttctttttgagtaatttgatacctaaaatagtgaagacctcaggaagagcccatcctctttgagacccgtgaacattctgccgtgccaactgtcttggctggcatttgcttccccttaaattagcttcctcctgtcacagaggggcccatactacaaggctggtggatgatgacaaatttgattcttgaaaatctgttaaggtaattgcaaaattccactcagtttccctgggaaaataactctacctgctagtagaatcaccagccttttcaaagaaaatgtatacatcaaattagcaaattagttattttaaaattgtaaaccaaaggccaggtgtggtggttcatgcctgtaattccagcactttgagaggctgaggtgggcggatcccttgagtccaggagttcaagatcagcctggccaacatggcgaaacccagtctctgctaaaaatacaaaaattagctggacacggtggtggacgcctgtaatccgtgttacttgggaggctgaggcagggagaaatgtttgaacccaggaggcagagattgtagtgagccaagatcacgccactgcactccagcctggatgacagtgagactccatctgaaaaaataacataaaaataaaataaaactaaattaaattgtaaaccaagagtgttgttggaatttccacctagtcttcgagtgtaagtgtagctagaatatgccgcagacacaggagcatacccctcaggaaccagggagcaggcgctggatgaagcatcaatgcttgctgtacattcggcttttgtttttgagtttcagaaacccactcaaattagtttaagtaaaatggaaaatgaaatatctcctaaaggctgggcactgtggcaaatgcctgtaatcccagaactttgggaggccaaggagggtggatcacaaggtcaggagatcgagaccatcctggctgacacggtgaaaccccgtctcgactaaaaaaatacaaaaaaattagccgggcgtggtggcgggagcctgtagtcccagctactcaggaggctgagtcaggagaacggcgtgaacccaggaggcggagcttgcagtgagtcgagatagcaccactgcactccagcctgggtgacagagtgagactccaactcaaaaaaaaaaaaaaaaaaaaaaaaaaaagaaaagaaaaaaagaaatatctcctaaagtaacaggagtgcattattaaatccaagggaaaaatgcatccaggcctcaggaggaaaagtacatcaaaaatggaaagccaagaggagctcattctgtctctttgagcttcttacctttttgcctttgtctctttgcttttcattctctttggttctgaacctctctacttcattcctctcattctgtaaatctgctttatttcctttggaatctttacaccatatggcagcaggcacttaacttccctccccaccttccgttctcatggtttgtgacagcagccaagaacgacttggaatattttaatctcacaccacaaatcctggagcagacttttgacctaggttaggccaattaattgtctctggctgaggaggagaggagggggctcacagactagaaatgtggcttccagggcccatgggtggaggaggagggcagctccgatcattctgactgggatgctcttcacaatgcctctgtaccgtgctggaacattgtaccagggtggcaagccctttttaaaaagtgagctccaattactttagtctctgccattcaattgctggtggttcttgcctttgaggctagtttgttagttacttaatatttattgagtgcctgcagggatttttgacattgagaagtgatgtgttgagcgtgccaaaaatctacccagtatagaaaactcatctcaaaatcgcctgtgggtttcagagagtctatgcaaaaacagccattatctaaacatgctttaagacgctgttatcatacacagcaaggtgaaagatacaaatgctcaattttaaattctgcagcttacttcatagccatcttttcactgaaagggatttctcttgggcctgatgtgttgtgacatttttttctgtggatgatcaggtcacagtgctgctgcttttggaaatatatagaacaacttgatacctttaaaacattatatcaaaatagaaccaaagtagactgagcccagaaagcaagactaacttacattttgaactaatttcataaaagaatctatcagacccagtcaattaaactgaagagcctaaaataatttgaacctgatgttggaatttgcaggtaaaaataatcaagaagaaatgttaacagatagctattgcatcaataatttgcctgtttgttttctagaaggattgatagggcagaagttaattctgaaaacacagttttgctgaccttcaagtagagggctgacagctgctttagcaagggtggtgggtaggatttcaaactgctgtgccctcaggcagcaacatcaagtcatgttatgtaaaataggcaacttcagaagttcccaaatgtatttgagaaaagtagggtggatcccaggtgagtccatgaggcgcatacggaaagggtgtgggagagccctgggagagcctgagcagtgagacgtcccttctccacatggaggacgtggtggacactgcccaggggaagaggggcacccgcaggtttgtgtctggatgtaccggaaacattggctcctctgcttccactaagatgatgatgatgatgtataattaattgccagtcctcgaaagttgggcaggttaaccaaaattaacttctaattaatgaaataaacggaggtgttggggaaggtgggatgacatcgtcttccaccaccaccacatcccattcccgcattggttgcttcagtctttctgaaagggctgctcagctgcccacgcctgcagtctctgcagttattcacatggaggcggcattaattcataccttgcggccatatccattatccctccctcacccccactactagcaaaagcaccccggaagtactcacaagaaacaaagtgacagtcacaaggaaaggagcatctcggggagtgggaaagcttcccctgctaagtacatgcaatgctttattggacgatgagttagggtcctcttgctccaacaagactggcttgcgtttccacctccagccagcattgtgaatcccaagtagctgctgatttatatgtatcctctggaattatttaaagctatcaattacctaaccatgggtatagttatatcgtagaaaaggccactttccattttgggagcgagacattgtcttctagtcttaatatacttctgcaggctgcctgatagaagaagagattgattggtttaaagatagattgttatgagagaaataatttacttcacttcctccttccctagtgagaaggccatctggttgacccctctgcctttagctaagggacatagaatgcacaattgccagctgtccccaatgtggctggcaaggctggacctcagctgtccccggggtccctgctgtgctgcccccgattgctccagtcttctcctgcaggggtgtgtctttaggaggaggctttggttgatcgtgaaatcatcctccaatctcacttctgctggaggtgactccttctgtccctttagctgcgtaaggccagacttacattacatgaaacaaacacgtcatgggatgtgtacccggaacattcacagtggttattggctgcttgaggtatgcatcactttactgtggagtcacaattatggatccaataacctggatcactctgctttgaggacccaaaacaaattaaatttctgatttcccctcattaaagctcaggatgcaacaagaagttggaggatcacaagtggaatgtgaccactctagccccttccctttctttataaagagtaggaaatgcaatgcactttcgagttctttctctattacatatcatatgttgctaaaacattacttggtggtgatagcaataaatagtaaattagtatcttgtgtttctataatttttataaattatagtgtgctttcaaatacatttacatttaatcctgataacacctatgcaatcagttccttttgtgtcccactcctttcctccttgcagcgttcaaaaatcgtctccaacttagagttctcatttgaatcttctcctcttcataaggcacaaagtctgataaaggtagcaagcaaggcaaatccatgagagatacgaagctcaggccaagatgagacgtgtcagattttaacagagaggagagaacagggatgcataacctgacagagaggcgtgggctctatcagctgtagctggggagaaaattaaagcggcctgcattagggtcctccttgaatcagttcatagacattgtggtgtctacaattattatcttaatctgggtttcttgcactcgagatacaaaattggcacacacaaaagtcaagctgtaatcacaagttactaagataataacattggataaaggtgaattttatgtttaaaatgaccaaacgactcagaaaaggtatagcttggttttagttcgttgtttgttttatttttgcctgagttaaaaataagtatgagcagcagtgatgtcgcaaaggacaggattgccaactatgcgtgtcagtttgcattacatcttgcagaatccattgctgcttatggcctcattcacgcaactgggcttgcattaaccctttgctttctgcatccatcaatgattgcctttctgttacttctaaaggcatttatccatccattcatccactcaacacagtctctgtgcactatgttgtcccaagttttgtacgagacattgagacgttgaacacagtaaggtaactgtgtccttaagtagtttgcccccctggtaatgacacatgcattatgataatatattaatactcatactaagataatatatattaaagagataaattaatagtggaacagtgttacagaaaggcactcacagagtgttgtgattgtgtccagggggaaagaataatgccggtgaaaccaggcaagacttcctacgatgtcagaggtgatattttagctgataagtaaagaatgcaaagggatttgcctggcaaaatgaagatgaagggaaattccaggaaacagaaaagttgtagggcgtgttgaggaaaggggacatggaagggaatgacttgctccaggaacaatagggtatgagcggagtagggtagaacttagatttggcctagaggtagaaagaggacagacttgccatgtcacaggggcaaagggtgtttttttcttgaaaacagaaggctagagccccagagagggctttacatgcaaaagggatacataaatatatcccgacacctaggtctgtatgaccttctcagaataacactgttggctaatatctttctattgtatgcccagaattcagctacttcccagcatacccaccactgccacccaggacagacctccattacccctgtgccttgttggccgctcctgttcccaccctggtttctgcaagtgtttcctctaagcagctcccctggccaccttccttagtgggagccttatttacacactgctgtgctcacacccctttcactcagaggtaagccgaagcctgcacctggccctcaggctctgcactccctggccccttactgcccccactcctcagaacagtcaccttgctctcccactctggccactgcctccttgctgtctccactgaagcctatgctgtctcacaggccaggcacctgccactccctctgtctggattgtcttctcggatgtcagctctgcagattccttcagttctattcagatgtcactttgctagagatctctctgatgcaaacagctcccagagctccattgtcctgcttttctcttctcttagtgagctgatctgcttattgtttgtcccttcccccattcctgcactagattacaagaaaaaaaatgaaaaaaaaaatgaaagccattcaacttctgttgataacagtgtcagtatctgttttattcattcttgtattcaaggttctcaaaacctaacctggcatagtaagccctagataaacatgtgttggatggatggatgtggattgacagatacatggatggatggatggatggatggatggatggatgagtgaatggatggacggatgtggatgaatagatggatggatggatgagtggatggatgggtgaatggatggatggatatgtcgatgaatgtggatggatggatggatgtggatgaatagatggatggatggatgagtggatggatgggtgaatggatggatggatacgtcgacgaatgtggatggatggatggatgtggatcactgggtagaaaacttattcttcttagagcaaatggttaattgtgaacatgcttttccattttaatggatctccaaagtatgcatgtggtaacggaatagggaatatgttatagcctcactttcaccatgctaggcaaaaaatgtctcattctactgagaaatgcactactgacactcagtgtgccgggggacaacctagtgacttctcttgactttcatggaaagcagaatcaatcctactcgaattttcaacagttcaactcctgcaagttaggaggaagtctgaatgtggggagccaaattagatgttcaaagaagcacatattagcttgcattctaacttgaaaactgcatctatgctgtggttgtacccatttaaaaattaaatgtgcatatagaccagaaatagaaaacaatatgaaaaaggcttggccaggcgcggtggctcacgcctgtaatcccagcactttgggaggccgaggcgggcggatcgcaaggtcaggagattaagaccattctggctaacatggtgaaaccctgtctctactaaatagacaaaaaaaaaaaaaattagccaggtgtgattgtgggcgcctgtggtcccagctactctggaggctgaggcaggagaatggcgtgaacctgggaggcagagcttgcagtgagccgagatcgcaccactgtactccagcctgggctggaaaaaaataaaaataattaaaaatgaaatagaaacaatactcaaaagatatcaattatttgagctaatgaagataacattaattttatcattctggttcatgaataagatttggtcttgatgttctgtttttaatggtttccttggaatttcatcttaacagcgtttgaggaatgtcaactgggctgtgagaaattgcgtgcactaggttgcttgtatgaatagtaccactgaaagattcctgctagtcacagacttgatgaaaagggcttattttctttctgaattcaggtgaaatgaaaagctgctgaattagcaagatctaattacttatccttggccctggccagtgattttctcccaaagaaaatactacctaataggaaatgagattgaatcagtgtaactttctgtagctgttttgttgctcacggatagtcttactttttaagttctaaaaagctactctctgtagatgaattaagttatagatggcaaatatgaagacttgtagaaattctaaaccactgtagaactctttcctactaagcctataatggccccatgaatttttcttaatttaataacaaatatagccaatattaaatattttggatgatattgcatattgtctattttagtttgtagcaatttgacacattctaaagaacttttaatctttgatgaaaatatatttatgtattgcattgtctactttttaaggccgtcttcattctacctcattttggcttggttactaagttgcagttatgtgcactataagagtgtattctccagactatacatggacagaagtggtccctttgcagtgtgaccatctgtccttatttgttcctgtataattaataataatccatgtgtaactattatatttattacttattatcaagcattcatatgatcctttttgtctctcaaagaatcacagtttcgactaaaagttatatgattcctctaatttgcacggaactgaaaacttggtctcagcagccagtacgcgtgatgaatttcctagacttatgtagtctttagcaccctttagcagtgtctccagagtccctctctcacctgccactcttgctgcagtgcaagagggttctctggaagggactgaaacctagaataaggataggtgagttgcccagtgaagagagaccaggaaaatcttgaaaccttgaatgaggagctatggaaaaaagaaaagcctgaaggcagtgcgatgggcagaagttggtgaaaattggcacatagcatgtgctaaataaatatttaaatttggtaccctgaaatagaagttgatcacatggatgtaaaaaaaaaaaaagggaatgatgacagaggacttggagctgaaaagtttaatcctagttgggttggattcaatgagggtaaggaatttagctgtgaagaaggaaagctccaagatgaccctatactgcagagtctggtttattgggaggaggagcattaggtttgcacaaaagctgcaaacataataatatcagattctttcttgaggtaacatttggccatagtacaggaaaatgacagccgaaggctttgggccactgaaggcagaagggtgcagaagggtacaaaagggaactaatagtagcttcaagaatgggaagatgcctctttcactgttttgtatcttggttcttgatttaaatgaaatatgtctatttggcttattttatttccttatttcactcactggggttttctttgttgttgctgtttttaggagctggtggggagtaaccctccgcagaggaattggaaaggaatagcaattgcactgcttgtcattctggtcatctgctccttgatcgtcacctcggtcatacttctgacaccaggtactgtattcattcttggaaaagcaagtcgctgtcagagagaaagagcataattttaccttgcaatttttttctaagtaactacctattacataatttatttttcccaagttctaattctcactatgccatatgatataatatggtttcaattttaaaaattcattttatatgttttggatttgttcacaaagttgtttactacgtggaaatgcttggcatatattaaaattacttatacaatcacttattcatgcttgatcaacttaaagacagtggcataaatataatgattttatatatttcatagaattcctggacattatatcaagggtgaattaagaaaattattaaaacaacatatgttgagtgtgaactaaggagaaggtgctaaataggtactactgaatattacataaagtataaaccagtgtcataaatctctcaggaaagaaaagacactaaaatccacagaagaaacctacaacaaatacagatatatacatgcactattgagtaagccaaagagaagtgctattggagttgagaggagaaagagaaatctttcaaaagaaagttcatggagaaggtagtacgtaaagtgggcttaatggagtaatggtaggaatttagtagccagagagtggtaggattagggagagaagaaagcctttgcctataaaataataatatagagctggacatggtggcttatgcctgtaatcccagtactttgggggactgaggcgggtagatcgcctgacatcaggagttcgagaccatcctggccaacagggtgaaacctcgtctctactaaaaatacaaaaattagccaggcgtggtggcaagtgcctgtaatcccagctactcaggaggctgagacaggagaatcgcttgaacctgggaggcagaggttgcagtgagccatgattgcgccattgcactccagcctgggcaacagagcaagactccaactaaaaaataataatgataatataggagttatcatagaaaaacattgtggccatagataaaacagtatgtaactgttttatccgttctcatgatcatagtagatgcctatttgtgcaggcaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattatttctacttgaaataaactgtccttgttacagacaaaatgaatgcctgcacaaaatatgccaaaataatatatgtatagtagttccccttatctacagagtatccattccaagaaccccagtggatgcctgaaaccatggatagtgctgaatcctacttatactatggggttttattgcacatgtatacctacgataaaatttaacttataaattaggtgcagtcagaaattaataatgataactagaaataaaggagaaaaattataccaatatactgtaacaaaagttacatgaatgtgttatctctcactctctttcaaaataatctcaatatttctagaccatggtcaactgatggtaactgaaactgtggaaagcaaaaccatgggtaaggaggggcctactgtaagtaagtttagaaaggttacagaatgcaaggtctatttacacatattaattgcatttctatgtactagcaacacacagttgaaaaatttttgaaaatacaaattttattagtcagcttgagctgtcaacaaaatatgcagactgggtgatttagaaaacagaaatgcaacaaaagccaaaattggcaagtgggatctaattaaactaaagagcttctgcacaacaaaagaaactatcttcaagagtgaacaggcaacctacagaatgggagaaaatttttgcaatctatccatctgacaaagggctaatatccagaacctacaaaaaacttaaacaaatttacaagaaaaaaacaactctatcaaaaagtgggcaaaggatatgaacagacacttttcaaaagaagacatttatgtgaccaagaaacatatgaaaaaaagttcatcatcacaggtcattaaagaaatgcaaatcaaaaccacaatgagatactatctcactgcagttagaatgatgattattaaaaagtcaggaaacaacagattctggagaggatgtggagaaataggaacacttttgcactgttggtgggaatgtaaatgagttcaaccattatggaagacagtgtgttgattcctcaaggatctagaactagaaataccatttgacccagccatcccattactgggtatatacccaaagggttataaatcattctactataaggacacatgcacttgtatgtttattgcaggactattcacaatagcaaagacttggaaccaacccaaatgcccatcaatgttagactggataaaaaaatgtggcacatatataccatggaatactatgcagtcataaaaaaaatgagttcatgtcctttgcagggacatggatgaagctgtaaactatcattctcagcaaactaacacaggaacaagaaaacaaatactgcatgttctcactcataagtgggagttgaacaaggagaacatatgggcacagggaggggaacatcacacactggggcctgtcgaggggtggggggcaagggaagggatagcattaggagaaatatctaatgtagatgatgggttgatgggtgtggcaaaccaccatggcacatgtatacctatataacacacctgcacattctgcacatgtatcccagaacttaaagtgtactaaaaaaataaataaatgcagaatttcatttctcacacttctggaggctggaagtccaagatcaaggtgtcagcagggttggtttatggtgaagtctcccttcctggcctgcagaccgcaccttcttgctgtatcctctccctgctttttctctgtgagtgcacatatgtgtgcctgaagagaggaaaatagagctcttgtttctcttcctcttttttaagtacagtagtcctaccagattagagcttcaccctctgatctcatttaacttcagtttcttccttaaaggcgctatctccaaatagaatcacattgggggttagggtgtcaacatatggatttgttggtacgtacaattcagtacataataccagtgcacgtggacgtctttgggatggccctgtcttacctaacacagtctgttctctgacccgcaaagattcacatccttctcatatataaagcacattcattcactctaccccaaggtccccagaaatctcaacctattatagtatcaactcaaagtctgtgatctcatcagttcagaactcccaaattttaacactgaaatcatctgaatgagttttgagtaggcctcagggcatactccacccaaagcacaattcatctgtactgtggctctgagaaactggagaggtaaacacagtagtgggacgggtataggatgacagttatagacattcttgttcaaaaagggagaaaaaggagtcactagttccaaacaacttctaaattcagttggggaaactgcattaggtttataggcttgggaatagtatcctagggctctcaggtctgccctctgggagtcatctttcttcttcatgaatggcagcttgagattgtagctgagtagttttataagcatgttttctgcctgagaattttgggggtctgatatggtttggctctgtgttcccacccaaatctcatgtcaaattgtaatcctaacgtgttgaatgagaggctggtgggaggtgattggatcatggggctggtttctaatggttcagcaccatccccctagtgctgtcttgtgatagagttctcacaagatctggttgtttaaaagtgcgtagcacctccctctttgctttctttctctcctgtcaccatgtcacaaagggtgcttgcttccccttttccttctaccatgattgtaagtttcctgaggcctccccagccatgcagaactgtgagtcaattaaacctcgtttcattataaattacccagtctcaggtagttctttacagcagtgtgagaatgggctaatacagcgtccaacagcctttatttgtttcatactccctctctccttttcagtccaagctggcaatgtttctacagatataaattcttaagaatctgcggatcttctatgtatgtcatgggaattcattccattagacaagtggctcttcctaggattcttctagatactttcatctctatgtttgccttctgctgagagaggtttggggtctgtgaatcacacatttaagctcttcaaagggccttttgtgtgactgaatacttaccttttgatctttcaaggtattagcaaaggtttttcagccatgctctcaggatggcagtatctttctcgacagtgaatctcttaatttcagcattttttataatctgaataaagtgacacatttctccaaagaagatataaaaataaccagtcagtgcatgaaaagatgctcaacatcattagcttgtaatattattcatctataaaaaggaatgaagtagtggtacattctgtacgtattacaacatggatgaactttgaaaacacaatactatctgaaataagccagtcacaacaaaatgcatattgtatgattccatctacattaaatgtccagaatagccaaatgtttagagacagaaagaagatttttggttgcgaagagctgaagagagatgtgggagaatagagagtggctgctaattgttatgctaatcttttgggggtaataaaaatgttccaaatttaggtcagtaatggtgcacaactctgaacatactaaaaccattgtgttgtagactttaaatggctaagttttatggtatgtgaattttatctctaataaaggtgtcaagaaaggaataaactaggtagggaaacatatcaacctatccgcatataatcatgtgaagtcacaggtgcctaatgcggtaactcactaaagaaaacaggctgctgaatatattttaaggtttcagtttatttcctggatctaaaagaatggaggtaaggacatgaagagggaatgtatacctttgatgtatttgatttagaagcttaaaataaagcataactacaatttcttagttcataagatgtgctgaataatgctgatgacttagtttctaccatttcaataaaaagtattatgtgactaattttgatgttatgctactagttttcttagactatttgaagacatgtgaatttgtaaggagaagcttttaagataaattagtatctctgtgagactttttatagacataagtctggagtataaccataaataatatactttagtaacacaaagactgcattacaaaaaagtaagcgaaaatacaagcaaaggcacagatttttaaaacaaatgctctcttcattcaaaagaaatgaactgaacatctgtttgctgggccccttagagacatgaagttgcgattcctaactaaaacagaaaaggaaaatatcaagctagtatgggaaatagacttgaaagcaaataactagttcattgatagtagctcctggtagcagaaaagaaagcatgatcaactttgagaaagtaaaacacacacacacacattgtaaagaggtactgactgtacattttcttgtagctcctctagcatcactcaggtaagattatttaatgcaattctcatcccaacaatagttattttgtttcttacatttggggttggatgactctagagagatttcttcagagaaatatgtttttgtgtattttgagtaaatctcacttttgtaaagagagagagtgttcccctgactcacagctgctgccacggcttccttccgtctctagggtttttgtgtatggatgagatgttaccatctcagctctgacctatggattcatatggtgaacaatctgccagtgggacagtttaattcaggaataggtcaaaatccccaaggttcatatggtgatttgcagacgtgctacctggttttaaatttcattgtttctaatctcttgatggtacagcatgatataaatttattctttcattatgataagaatctaccgaggaaataggagtagcacctgcaacacatagcatggattctacctcttttactttaagaaaaaagaaagaaatataattggaagtcttgttcaagcatctgcagtgcctgactcagggcactcaatcaataaatatgctggcagaactaaatgatgtgtttcctgcattctcattgagctttttccttgttactaagcagcatctgtgttaggtccatcgctgacggaacaggctgcagtggtttatttttaagcaaaagtgatctcattggaatttgtgaattaatggtaccgacgttggaaaatggacagcttctttgatttccacctgtttttgtgaagtgttggtaaggaagcaaacaaatagtatccattttgtaggaataacatacaaattgttctaaatacaaagactgctttactctgagcctcagcttgggggtctgtctcccctgtgaagctagccctccataacccttgtctcctttgagttttgaaaacacctagtgcttgacatctgccaaccgattcctcacacatctttggaggagtcatttcacctctcagcagctcagtagctcaatgtaactttccttcctcctcattatggtggggatcaggagagataataaatatcattgcactcggaagactataaagcactttagagttgtcagttattccaaattgctcacaaaagcagaatctcacagaaagtcttggactcttctgggtagattttctttgttaccaagctgagtttgtcagtagcttacctctacctgcagggattgcatgcccctccagcagctatgctcgggtgatgggatttatttctagttttctggtatttaaaatatttagagaaggagttccaaatggttctccaggaattttactatttaacaaatatctgaggaagggaaaggaggctgagaaatttgcattacacattggccaccgtaaagagtaactacatcactgcagatttcagcatgcctttacatgctggtgagctaaccaggccaagtcaatttgaagtgccatggagttttctatagtatatcaagctaaagggctggaaggaactttatttttcagtgatccctgaattgcctttgggatgaaatccaaacagtgaaagccactgccccttcttgcatcgccacctttatgttgccttccagtttaagaaggaagattgagcacagaaatgttccttgttttgatggcaaaagcatgtggaagtgacagcaaaataaataacgaaaaacacagctgcagccgggcatggtagctcacacctgtaatcccagcactttgggaggctgaggtgggcggatcacctgaggtcaggagttcgagaccagcctggccaatatagtgaaaccctgtctctactagaaatacaaaaattagccgggctcggtggcaggtgcctgtgatcccagctactcgggaggctgaggcaggagaatcgtttgaatgttggaggcggaggttgcagtgagccaagattgcgccaccacactcccgcctgggtgacagagcaagactccgtctcaaaaaacaaacaaacaaaagcatagctgcttctttctcaaaaacaagaacaggagttcttcacatacctggattgaaagggaagacatcctcataagaaggaacaggtaaaaacctatggcaggagggaaggccaaatttccatcatcctcaagtcatagagactgaagtcaggcacaacaggagggcttggaaggttggttttcatgagagaccaggggtacatggagtccctgcctgaaaactgggttcatggtcagaaggcctcagatcacatcacccatttgggggaaagggctccagcctaaatgaccaccaagacttagtttagagctgttacctagacagaatctcaaaactgcctgaggaccacccaaccaggggcctctcaagacccagaacacttgtaagacagaagcttacaaccaagaaccacaaagcatcttcagaaaacatccccccataaagcagaaaccaacccaacacacatgaaaaccaaaatccaaagaaatttaaatcaatagggaaaagagaaaatgacattttagatttttgaaataactatcactatgctaaagaagcatgaaactataaaatatgagtagatgatcttgaaaaaagttatttagatatattagatattaaaatgtaattattttaaatttaaatccttagttgggtaatagaacagtctaggtgtattaaaatattgacaagtaggagattgaactgaagaaatcatccaaatactcccaaagtcaaaaaggaaaaacttaagaaaaagcccgaggtgtggggattgacctagaagctccagcacagtccagatgggattctggaaggaggggatcaaatgctgcaggagccatattgtatgagataattactggtagtattcctgatgtgaagaaaaatagtctttaagctgaaaatattactgactgttaagcagaatttttaaagaaaatccacaagtggacattttttctaatggaatttcagaatatcaaatacaatgagagaatctcccttcccctctaggatttcctgttcacattgtctgccacgccaatgccaacacacacaatctcttgaaaatactgcatccaccgacaactttctgcccttatgagccttcctagcttgaatgtttttctctctcctttatcttggctagcagcctctttccttcagcaagtcctcctggaatcaatccctcccactttcttatttaatagtctgcttccatattagcaggacaagccctgttcctctcagccccgtccctgctatgttctgatcattcattctgctttggttccactgctctgtgagcttgtataaggcctttctcttcttcagggctcagcatggtttgtggaatgtggcagtctcctgtgcctgtcattatctcagatgattttgggaatgaatcaaatgataaaccaatgaattagatatcagttgaatgtgcaaatgagccatctaggtacagagaggccagcagtgagtttcttaaggagacagagctaattaaggacagagtcatgtcctggcttgaatggagcaattttgatagcatatatcataatgcctccaccacatactttccctatatagaagtcttaagtgttttaaaaatacctttaaaaaacaaataaaattacagtttttaaaataaaatacatgtatagaaagaaagattttcagaaagtgaatacattgccttttcatcttttatttccaacgtttgtttaaatggcagtcttacatgttttttcttatgaggcacatagataccttaagttgcatggctagaatcattcttgaatagtgaagtttaatcagataaaatgtaaatttcaacatgattattattttctgaccacgtacttaagaatgtctcaggaagttttagacttcttaattgcaagatcagagtgtaactttattagattaatgtctagtaatttttaaaattctcatttattgtcgtgtatatggaagtgtgtcatgtttgaagccatgtgccttttcctgaggctgcttcagccacacctagaaagctcctagagcgaagaaagaacttggtttggtttaatgcactatgttcagcgcccgggatagctccatatacagtcatgtttcacaataaggccaccttgagtcacagcattctgtaattttcaaaagactgctacacacagtaaccctatttgatattcaagagatcagtcaatgcacaaaggaatacatgacttttctgacaatttcagtaatttgtcaacaaccagacccaaaaggaagaaaccaaaagtgacgtaataaaacccatgcaatgcactggggtcctagaagctttgaaaattttatttagagattatttattcctatttgtttatgtaatcctaacagaatttctttctgtttttctaacctgccacagagtttaaaacacaaaattaaaagaggcaaatggttctgtcaaggtcaagaacaacagtccaaaaagcgtaacagccagaaattgaaacaagaaacagacataccaccagacattgaaatacaaaaacacacagctctagagccactgaatgtggaatgcacacagacatatgcacctcagttagcaccaagatcaccccacatagcagcacaacaggaaactgttgaaatgagaaaactgggagtctttgaaaaaaatgtgcaatgatatttagcatcttctatttaagagggcagggaagtaaataagcatcctaggtagataatgtccatcagatgtggtcaagtcaatatacagaggagtttcttattagtatcacagaagtgaaggtggtggaatggactggcctgtaggctcacaggtcaggcatgctgacagccctgtgtcttttcaaagtcaataagtggatttttgtgcctctaatggagagagcctcttctgaggaggagcaaaaactctagaagctttgatctctggaaatacaggataaaagctctcagatttttaaagtctcacccactgacgccattaactaaacatctcatcttgggatgaacattagctgagtgtgttcacaggcttatcccaagtgctttctcctaagccttgtaacagagatgcggcaaggcagaatctggtagtctgtgtacagataattggggtttgatcctgtctgagcaagaactaacccacaacccagagacagccagggacaagtgaagcttatggagaatgaagacctaaggaatattttctgtgtctttgaattctcagcagctaaaatgctgcacttaatgaatgcttcatgattgaccaattacatcatatgactgaggtccattctggatatccgtatcttcctctcgactattcccaccctattgttcataaatcaatcctgaaagaattatttacctctgtgctgagaaatatgatcacttacatgctgcaggtgtgggtgagaaggcgtgatgccgttctactgaatcatgatttccttagcataggttttgatagtttaattaaaaacagaatgcaagactggcttttatccccattcacttatggacgtcatgtgtgttcccatccatactatttataaatgacaatcagaatgtttatggtcctctcattttactaattatgaaacaagcttaactctttgctttttatttttttctagcggaagataatagtctgtctcaaaagaagaaggtcactgtagaagatctcttcagtgaagacttcaaaattcatgaccccgaggctaagtggataagtggtgagtccaggtccttcgtgcacaagacatcgcttccccatgcctcacccccactttcaataggttgggtctagtaatttgcctctcggatttccccctttggccacagaaggggatctacagagcttttgctgtagtcatcatcagattatcattctatgaaaatgtgtatctggtaaaatcaggcttttgtaatggtgttgcctcccgagcatccacacagccttcacttaatgagaaatgggtctgctgaagacgtgtcctttgtgtgccacctcccagagacatcatttctccgggggagctgtggggtgttgcttagcaacaggaacagtgcagggcacggtgagctttccttccttctccacaatcttcattcccctttgttctcttgctctctttccgttaggcagaaggaccaaaagcaactcatggagttcttgtagaatagcttccaaatgaaacttggagtgctgtacacagatgcagattcatttattttccctgttgaactttaatttggattaaatctactttccttgtatgggggattttttttttaaaacaacagaacaaaatacagttgggggcagaaggcatatgttcacaatgcctgtgttggttcataacataatctatttcttctaattgggtctgaaataattcaagtgcatccatggaagatgtacccatccctccacaggccaagttgccagcacctccctgttgcctccattgctgttgcttacatttcatctttgcttcagtggaatacacttgaaggtttatcctcaggccagagaactttatagtgatcaaagtctagttcagatccttgcttttataataaatgaggtccagagaggtcaagtgacttttctgaggtcacagagctgatgagtgcgagctgtggctagcagcccgtcccctgacttccaattcagtgctcttcccaccatcctcttttgctgagtgatcgagtgtcgttgtatgtttttctgtcaaactgcttctaaaatgcttttcatgcttcacaaactctcagaaatcaattaacaatgactcttggctgttagtctcctgcttaggggcaatcacttttctttcgtcctctattgtggcttcagtattcatttctgacccttagattagcttatttaaaagtgaaaaaagtaggtggatctcagagggaatgtattttagaaaactggggagaaattagagcagcagtatatcatgaataccaagggcacacagaaattaaaaaacaaaacaaaacagcacagaggtctttttgtttggtggaggaattgactttgcctttgttttcggctgacctgctgaaatgttcgtgttcgtgttcactgtatgttcgtgtacacccgctgcatcagcaaatgcaagcacttgtgggatgccacaggtagaccttgggaggaaaacatgacaactctccttgaggagctcaaagttgtgttggagacgtatctatgagcagccagtgggaatcctaacacacaagactcagagaggaggatcggaagttctcatccttctcaaaggatgtcccagagacagtgcacaaactcagtcttaaagcgatggctaggagcttgttagagaaagctaagaatagagccctggaagaatgttaggtctagaatgttagtcttgctaaaccctggttgggggaaccaaaaccaagctgagaaacaatgcccagcagttacaaaaacaaaacaaaacacttagacttgtggtatttaagaaaatgagtgagcacagtggctcacacctgtattccagcactttgggaagccgaggcaggcagatcgcttgaatccaggaatttgaggccagcctgggaaacatgttgaaacgtcacctttataaaaaactagccagccatgtgggacctctggtcccagctacgtgggaggctgaggtgagaggatggcttcagcctgggaggtccaggctgcggttaactgtaatcatgccattgcactccaacctgggtgacagagcgagaccctgtcaaaaaaaaaagagtgaactctttggtatttgtcaaaaaccaattataaaggctcagttaatcattgcagagttacttcattcactttaagctattacgtctttagggagcaggtttgtccatggaactgtttctcagtggtatacatgggagtcacaccacccaccaccatgatctcccaccaccaccaccagcagcaccagcaccacaggcttctctttctgctccttctctgcttctccttctccttctcgtggagaggcagaattcaaggatgaatcaagaggccagaaacaagggacaccaaacctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgtttctggaggaacgtgtgccagttcatggtataaggagtttgatttttatgagcaaatgaatggagtctgcccagagaggcactggctttctggccagaggagaccagccggattttctttatatccgcaaagctgggagttaatacacgcaattgagacgtggctatgtgcccagcagaaaatgcccagcctgcctgtatcatcaggttatgcctattcataatgaccacctgcagttctaaatggacctgcctttggtgttgaggagctttcttaggatgattctccctctgtaaatgtacacactgaagaaactttgctgtgaagtaaccaagtggttgggtccccaaatacaggtttgatttggagtgttttggaacctaataattccactcacacatgaccctcagcttccccttacctttttttttttatcttattcctcttcctaaacattctctctcttcccgctccctaaagaggcaatagcttaaagtgaatgaagtaactttgcaatgatgaacggagtctttataattggtttttgacaaatactatagagttcacccatttttttttaataccacaagtctaagtgttaagatctgggaaaagattactacaaatccataggattatctcatgttgtagagctgggatgagccttagaaattattagaacattaattcattcagtaagagatttttgagtgcccacagtgtagcagacaaattgctgggcccaaaagcggtgagcgatttgttcatggaactgtttcttagtgatagacataagaattattacccaccaccaccatctatcaccactaccaccatcacagtctcctcttcctcctcctcttcctcacatcaccgtcatcatcataacatcatcatcaagatcatattatcatcttcattatcttctgggtgtttactgtgtcttaagctctaggctaaatgatctatatacatatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgattttgttttttgtttgtttgtttgtttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctaccttgtctgaaaatgattggtacaacagcctcacattctctaacatcctgaagaccttgtagacttccttacttgtttgttgcaactactggggcaagccaaatgaggtgtgtaaagccatgaaaaggcccactctgggccaggtgtggtggctcacgcctgtaatcccagcactttgggaggccaaggtgggtggatcatttgaggtaaggagttcgagaccagcctggccaacatggtgaaaccctgtctctactaaaaatacaaaaattagccaggcgtggtagggcacacctgtagtcccagctactcgggaggctaaggcagcagaatcactcaaacctgggaggtgcaggtggcagtgagccgacattgcgccacagcactccagcctgggtgacagagcaagactccatctcaaaaaaaaaaaaaaaaagaaaagaaaagaaaaagaaaaggctcactctgggctccctctcaaagaggtgcacactcccagaagtggtcacagcattgcctctccaagtatttgctccattgagtaaattcttatacctgttataacaaccgcattgcacttcttaaccttttggagcccctttgtgccattctgggactccactctaggggctgtgatgagatattttggttactctttgtttacatggaccaatcatcctgggctcccctggcccattccctctttctcatttctagatgatgataattgcaaatctcaccttctctgcccaaccctgcaaactccctccccatcctccttctcagctgaaactgccagaagagagcttaggaacactcccactgtcctgtcaactggcctcaacactgccgctggctcttcctgcaccactcccaccccgcccctgccccgccccacaggtgacctgtctgctgtctgcactcaatctaaaggaaccacagatgcactcgcttcacttacctgaggaatcattacagcaggcccctcctttctcccctaaatttttgttctgtattggctgattcctatcatgaacgaaatgtggtcttccttctcttaccttaacacaaacacctcatctcaagtccacatgccctgcctggctcggcctggcttccctgttcccctttgcagcctgaagcagtcttctatctgtaacatctccaggtactcttcttccactctccctaaatccactcccgttaggctaccacgcccagcactctccgaaactcctcttgtcaaggtcagagatgacctccaggttgctaaatgcaacaggcatttctcagaccccaacttattttacctgccagcagcattggacaccattgattcctcctctgccctggatacacttttttctttcttgtcagctcatgggcatctcctttgcaggagggttggccggttctccctcttctccctgacgtttaatattgctgcaagactcaggacttgttcctctccttttcatggctgcacgccctcccttggtgtctccctccagtcttatagttttaaatatcctccatttactgatgattcctaaacatatgtcatcagacaaaccttctctcaaatctctcagatgtctgagagacatttcaattttaaccttaatatctccaagtctcagtccttgatttccccccaaaaccaaaaatacaaaagaaaaaaaatccaccctatccacaacctttctgatgtcagttgatggaaaaatttgtagaacaagctaaggaccttcaagtcatcttttattctactttttctctaacatcccacatccgatccatcaagaaatcctgccagctctgccttcagaacacacgtgcccatcctagcctccacgtgatgtttgggtgcatgaataccatggcagacttggcatcagtccactcggagggttggagggctggactcaagcccagcagcagcaggaaggaccgaggctctactccggcacctcaggtactagctcaggtgcaaggagaaggggatgcttgggtgactggggtggaattttaatgtttctaactttaaaagtctgaattcctcaagtttctcacttatcctcactttgtactccctgaggggaaataattcacccccacaatgttaggtattgtctatatgatgatgagtttcaattctctagctcaaatgctcttccgagctatacacttggagagagagagagaggggtgtgtgtgtgtgtgtgtgtgtgtgtgtctgtgtgtgtgtgcatgtcagtcactggctaatttccatgtccactgcagtatcttacattcacctcacatcctcatgcccagcactacatcatcctcccccaacctcttcacagaccccccgctgcccactgtgcgagcacagccctggccccccgaccctccatgtctcagactctacatgatctgtttactctcctgactcatcattggccatctccccagttttctcttaaactttgcctacgtgaacttctttggattgcttcagaagtccatcttcttttcccccagagtggctcttacataggatgttccttctgtccagcccactcgctctcctctccgcgtccacttgtgatcactcctagtcaccaccctgcatgttatctttttcctttaagttgctccctaattcttgctctgccccacattgactcttctggttttggattctcctatatcctgcactgacccttttgttacataggttaagtataattatttatgaatgtaaactccacaaggatgggactcgcatctctgtttactgtggtatccccagcaccagcaaagtccccagtttgtggccgtccacgaagacttcttgggcattttctcatttgatacttaaacagcctagttttaaagataaggaaacttacaagcatgtgatttcacatagaatggtggaaatcttttctgatcatgtgatttgggggcagggacctgaaggtgaggatcatgcagatgagttctctgggggaaagccttccaggcagggtggaacaaccaacgcaaaggtcttggtgcaggaggctgcttggcatattcatgaacagtgttgagcctgagggagaagagccagagataagatcagagtggaggctgggaccaacacctacaggctctgtggcaatgaagggggcaaagggagtatgggggagaatttagagaagctgagaagttgggtttaacttattggcactgaaggttttagaataacaatgacatggtgcaagcttaggctgatatatcaacttcttgtattatatatactacacatttgttatatgtatgtatttattacagtaaattagaaatcagagattaacacaaatttaaaagatactaaaaattacctgtaacccctctaactgaaaatggccactattaaattttcatagctctccttccagataataacatatattgaataatactaagtgtattaagtaggaaaatattcataacctatacatacatatattctcatggcagtaagtatacatcgtcattatctttttaacatcttaatagtatttcacgatattaatgtgccttaatttgcgccatcttctgatattgaaagtttaggctgtgacaggaaaggaagtggcaggtgtaaaaagccatggtgagtgacaaatcagcaggaggtggtagtgtatagaaatggaacaccagggaagagagcactgtcaaggctgacttgaggatctcaggcctgggcagctggaatggtgattctctattcttgacagggagtcagtttctgtgactggatgaagagtttggagtggaagtctatgagcaataactcggtggaaatgttcgttaggtattgagaactggggatgaagccaggtgagaggttggagccatctggaggaccatggaaagcgtgggttgtggaggtactgctcagagcctctcggagggaagaggggaagagggacacggaggtgtctgaggaagtgtggtcagggaggcaggaggagaacttctaccacgccacgtcaaagtcaaggcaggagaaaatgctctaggcgagttagtgtgctgccgattttgtaacggcagatgtaaatgaaaaaccaccccacggtggccacgcacctcttcctggctcacagccccagggacgtgtttgtgtagacaatagtggtgatcatttgagtcatatttaaattgtttatttctttctgttaaaggtaaactgaggcacaatacaatttttttttttttaaaagcatttatttgagcaaacagtgattcatgaattgggcagctccaaaccagaagtggttctggggttctaccaagggaacaagggagaaggcttttacagaacaaagacagaagcaaagcaactatctgattggttacagttatggagttgccttatttggtcaatcctgttggaaagttcttagttacagaagttagttgggagcttctgactggttagtctttaagtttcacttttctttaatataggcatttatgagaaaaagcccaggtgaagtttttgtttcgttttgttttgctttgcttttgagacggagtctcgctctgtcgcccaggctggagtgcagtggcacaatcttggctcactgcaacctccacctcccgggttcaagcgattctcctgcctcagcctccctagtagctgggattacaggtgcacaccatcacgcctagctaatttttgtatttttagcagagacagggtttccccatattgctcaggctggtcttgaactcctgacctcgtgatctgcccgcctcagcctcccaaagtgttgggattacagatgtgagccaccacgcccggcccaggttaaattttatttatgtttgcaattcacacaaggtcaaggttacttacacttacaaggccaactggctttgtctccttgaggattctttaggccttttaacttacttttaacatcactaaccacactaatttatatggcaaataccctcttattgacactgttgcagactatagtaggggaaaggttaattccagaagcagggtgaaagacgcttacatgcagacagctttccaccctctcctcaccgcatctgtgaccaacagaaagtgtctcctctgtcttaacagaatttgtcactctgctcaggtagctgatgccactgcacctggtgagccacctagctcaacaaacatatttgcttttacagatctgccttttatgaaggcagcctgggctaaaccttggaaatggtttgataagccccatgccctgtgctctgagcaaatcgaagcctcctgcatccttcaaggggtcccctctcctcccgtctcctcccagtatctcttggatgcaggcaggcctggagctgattgacagaagctgctcgctgggcctgattaacttgtctgctagctccaggcagagcttggcctcacagcccatccggctcctgcctcctccccgccccctgcagcatgttcaactttagtctgaatatggtgatagaccatgtggctggcaccagcatctctccactgtctgtgtttgtttacgctcattttcattaatccagccacttgttagcagagagccctctgtgtctctaggatgcggtactagagagactgtaaaattgaagaaaattgcttcctttgaatggaggaaaatatcagctggctggttgatactggaaaagtatatgtttcagaagataaaattggagttagtgcacagggctcaaagcaacttgatttccatatgtgctttatcctcttctcttttgttatgctgaaaaaacagatgggttttttttttaaataaagcttatggggttaggtagaggggggaattcaagtttaaaatggtttgggtatttccactgctttttggaggccacatttttcaatcaaaaccattaagccttagaattgcagagagtaataaagtcccctcgagggcacttggtacagcagcctgtatcccatggccagcagggacttcagggaagtacccaggaagggcaggcttcgtaagagggactgtgttctcccacggctctgagagtgtttggagagcataacagtgatcatttgaagtcattacataaaaatacacactgaagcacatcgttgtaccttaatgaagtccttaagaaataaacaaaatgtaattatggtttacattggtgtaaaccaccagtttattttttctctcttttgttgtcatgctcaaggtcgcacctttccttaagagaagagagcctcagttgtctggcattaggaacccaatcatgtctctgactattttcgtgcagtaaaatctgtccatgccatcactcccattttttctgcctaacacagtttcaacagtatcctgtctgcacggccaggcttatccttaaatgcatcttccccatttctggtctctgagctaagacaattatttgcttaaacttctgcaaaagtttcctattggagttttctataggacctacgggaagaactcaaaagacagtatcatttagcgccagcagcagcggaagcaataattgcaacaggaattgaaaggataacagtagctgcatgaaatatctcagttacttcagttcagtcttcactgaaacccatggaggcaggaattttttttttattatactttaacttttagggtacatgtgcacaacgtgcaggtttgttacatatgtatacatgtgccatgttggtgtgctgcacccattaactcttcatttaacattaggtatatctcctaatgctatccctcccccctccccccaccccacaacagtgctggagaggatgtggaatttttacctttactttagaaataagaaaactatgagtcaaagacactaaatcactttttcaaagttaccaagatggctttagagaatccagggtgttcctgcctcagtgtaccttgcctccccggtctcctcaccacccctactcatggcctctattttgttttttttttgagatggagtctcactctatcgcccaggctggagtgcagtggcacgatctcagctcactgcaacctccgcctccctgattcaagcgattcttccgcttcagcctcctgagtagctgggactacaggtgtgtgccaccacgcccagctaatttttgtatttttagaagagacagggttgcaccatgttggtcaggctggtctcgaactactgacctcgtgatctgcctacctcgaccacctaaagtgctgggattacgggtgtgagccaccatgcccggccactcatggcctctattaccacgttcctggccatattaggttctttggcagctttgtgactttattgctcttctctttttctgaaaataccgttgctcatcacttctctgcttcagaaagtctcattaatcctcatggcttgacccaaaatacattctctctgattttccaaattagaattagttgtgtactccacgataccgcagtagaactttacaaaacttcagtcagagcatcagcttgtgaaccagctagggttggaccaccttggggatgcagcccacttcgcagaggctggatgcacttcctccgtctgaaagcagagagaggtgtgtcttggggcagggcagccgatttcttccacaccacgctggtcccttccagaggtgctgtaggtcctctgcctgtaggtcctctgggcggactctagttcctaactgatggatgatgctgggccccgctgttgatgctgcttaattcataatttggggactcaagtctctgcaggctccactgggccaacttgcttcctgcagagatacatgttcagactctactaattacttttccttggcaaacgttgcatccctgggaaatttaaatacaacttccatctttgttgactccagtttagaccccggccaagactgaaatcgcgtttcaactttatttgtttgcagtatacagagggacaggctcttctttttttgtttttgcttttttgatttagggaaataaatatttgattttgtgtgtatatacgtgtatacgtacatatttttttctcttaagtaaagggatctcatgtgagatgttcatgtttttttcctactctgataagtagacagatattctccaggtcattatacggttgtttccagggctccaaggatctcaagaaataatcctgaagaccccgccgtactcagcccctccatcctcctacctaatagagcagatgacaggatacgccgtgcagcgtgccttgtggccagcctggtctttcttcaaggtcaagctcaaaatcaaagcctggggcaggcggttttctgcctggcaacgcagctcagccccagcagcccacagaccaggatgcaggagtttgttttactttagttccgttccaattaaaagagtctgagagctcaggtgaatcccaatgcactgtagctgtttggcccaagggtgagattctgccgcgtcctctttttagagtgaagcgcattcagaagacccattaattagagactattcatccttcaacacgatgatattcacatgagcactgacaccaccatttattgtctcagttaaattacttcacagagtccttaaccatggtaacctgctagggtctaattaattatcattgacatcttttcaaacatcgatcaccttcttaattaataaaaaagactcacttgatctcttcggtaactgagcaccgtcccctgtgactcatcaatcttttgcccacagcatgtctcacttcacattcaggtgtctgtctgcatctctgtctggctcttgacagcaaacatcttgggggtcacaggtatgttgtagtaattatcatagttccctcataggtcacagtatctggggtgggataaagtctcaataaatattaactgattgaatgattcagcaaatgggcaaattgagtctccagagaagaggcctctgggaactgaatttttggttaattgagggctggccaggctctttattgtaactcttcgtgttttaagaaagtagacacacgtgggcggggcgggacgcagtagctcacgcaagcctgtaatcccagcactttgggaggccgaggctggcggatcatgaggtcaggagatcgagaccatcctggctgacacagtgaaaccccgtctctactaaaaatacaaaaaaagttagccgggcgtggtggcgggtgcctgtagtcccagctactcgggaggcagtgagccaagattgcgtcactgcactccagcctgggtgattgatagagcgagactctgtctcaaaaaaaaaaagaaagcagacacacccttgtaataagaaacgcacatctgattctattttcttgctttaactgggactctctaacagatgaaagagatagctcctgctactcctcatactagatgtgttctccatcgtaagtttgatacttgccacttattgatcatgtgcagaatgtgccagacatgatgctaagttcttaatcacttagcatcccgtgaaagacaggcgaggccatcgtctctacacagcccacatatttacaaatcttccaactggatggggccatccagaaacacaggcatgaagctatgtcctatggaaggtactgtggccttttaaatatttggggtgtgatatcatcctggtctcttttccacctaaatccccgtccctcctccatcctccatcctgtgcatcactgggacctcatgacgtgtttatctctcagcgatactttgctaccagcactgcatcttctctgttttccaaaatacactaacacaaacatgcttcataacagacatttacaaaaagtgacaggatgacaaaggagaactgtgggtaccacagaagatgaagcaacaccgatatgaacagcacggcttgctcttcttaaagcccctagacattcttgcttaagagaacctttccttgactgcccctttttctcttgtttatggggtcttccaacaactgcatggcctggttgtgctgcggttgcttctatcacagaacttttccgtagcccccattgccctaaactgttgccaataaagaccaagttgggattcagggatatcgaagtgaatcagagttctcttcaaacttagtgtgaatctcatgttcacatttaaaatgctttaggggcccttttgtgcagggctgacacccatatcctatgctcccttcgcaagctgagtatttgcaggacgctgttctgagattggtgtagacctttctaatatccggcactttgcagttgaaatggaattcgtgctttgtggtgtcttttctcatatctctttagtgtaaaagtggtagaaatgtgtagaaatagatatagcatctggatattgtgatgctgagcaggttctgggcttttaaacccagatttccaaaataagtgccaacctcacatctgatgcttctgccgagtgctccctggaacccagcctagaccgtctcttgggtcaggatcttctgttctctctcaagaccccttattcattccccctcttctctgaatattttgggatcctctgaaatgtcctccctccagaaaaaaaaacaggtgatagctctcagattccagcaatttatgaagcagattaatctagctgtgctggtcaggcctctctcctgtgctcctgcctcaggtacctttctcaaggatcaacaaaaagccaaatgcaggaatttccccaaacgaaagatacgtttctggaatttctaccctttgcgaggcaaggaaccgacatgtgcattcattttcttaacttctcccagatcacattcttacacaggacaacccaaagaagggaaagatggaataaacctcggaagttcaaagtagcagaatgtttcttatttacaccagtgttacagatcaggggccctagaatcagagaagttaagtcacttaccttaggccacacagctaataggtgacagagctagtctttactttgaaaatgcttctgacaattctgaaaacatgcccaaagtccagtggaaagttatgttcactaaatacaacggtaccaattaagtcttcatagggttgaacttgaatctgcaatggaaatctggaagtatctgtgaaggatgagacaacacccccaggtgtctcttcccccggctccctcgtgctctctcaagatcagcccagctcattagtgcagcccgtggctacatccaaagcacgcagccctccttgctgcagtcttttgcaagccaggcatcctgaaggtcacagcagaagtgctgtggggtaaaggatgagtttgtcagcagtgccccgtggctgcctggggctctgaagggcagccagatggagtgtgagctttgccttttccaccagatgttatttacttatttttgctgttagcttctcactcccatctcaaacacctctgggcaccaaatacttgaaagtagtttgtgatccgcaaagacaaattcctaataaaagtctgaaaataaaataatgttgctggagaattatttgggatacttaaaagtgttgtgtgttgtatctaacgtgttgctggtgttttccatacatccatgctagctgcttgggaattgccgagttctgagtcaggaattttaatgggcacatttattcagaccctgagcctctgctgcttagttctcaccagtgataacatagtttacagagtgacagccggagaccaggaatgaagctttataagtcattttaattatttgatattacttgtaagttgccgaaggaaggagactcctgtatgactatactgtaggtgtctatttgcgacacaccagtgaacacgcacgtgcgatatacaaaggacaaaatgcatgtgtgatggtcagcgactgagaatgcccctttctggctgacatcagaggggtgcatggcaacaaaatgtcatcccaatctctcatgggatgttttcttttccaactttcttctcaatggcttctgacattaaaataggtttttactgaatataaagtacttatgttcctcaataaaacccaaattgttgggttttaaaaacttaatgttggattaagatctcctaataagcaaggttaaacaaacaagggggttggaaataaaattagggagtgccaatttaccagctgctgtgcgttagcaacaatggccctgttagcgctcccccaggttcttcattaagctcggaaaatccttactccctgattgctcagatcccacagatgagcctagaagaaagtattaaatgtctaagaaaagacacaacatattcaagtctaaaaagatgtttctatttcactttgaggctcaagtaaacccatcccccgccccttgttctcttcccatcatcttcctttgccattggagcctacaattcgtccagaatcctttcctcctccctcttttgaatcagtccttgagacagcataaaagaagaacaaaagctccaccttatcccatcgccatccacctgtcttacatacttgaagaacaggagaagataaataagatggcccagcatggtcattttctaatttttatggagggacttgaatttgaaaccgacaccactgactgtgatcatgcccccagcatacgaaggaggattttcctttgggctcccaggcagatttaggcaagttcctcttctctgcctgccgtgacctttagaaatcatccactaatgtgtcttttcatgacttcccttccagcgttaagttccaggaacttaatctctttaagtgatttctgtccaagctcagtagctcaaggatcccataatgttaccaaaaaagactaagatctccatggttctagctgcatccaacaatgtaaacaggtaaagtagcatccttggagcatcttttattcactttataaatatgataaaagtgctgctaggtgcctaaagctctgatttgttagatgacttgggatcacaaaggcaaataagacaagctttgtaccttgtatttagagcagaaggtatattttaaatgttaaaagccatcgctttatttttatttgattatgctgggggctgaatctgtaacaccttgtatagcacccaggaagtattagttaagtgaatgcatgcagacgcacaccacatggttccagaaaggattctgggcaactcagtgcaaacatcagatagcaatatcccaaatcccaacaactgcaacagaaagaaaataggagaaaagatgagatttgtgcccgcagtgcatgttgatttaataggaatttcaaaagaaaaaaggacgtctgtggccaggtatatatccaaagcctgctttctccttctcgcctcacctctgctggcttctggagctcacactcgttcacctcgtccttccctcgttccacccattccctattctggtgggataccgcaccgggtgttatgagtacatcagctcatttgatattcacaaccattcctgctggctggtggtatctccattttacatatgaggaaactgaaggttagaaaggctaatgaggatcacaagtctcatggctagtgtcataagagagcagatatgacttcaggcttgtctgtctccaaaagccttcgatgtggaccctacaccatcctacaaggaggtggttctctaatccgggatgaagctcttgttcttcctgtttttccttttcctcaacatatgaggatttgttctgaagatcagcagtaaaatctcactgaagggttgaggcttgttttaaacgagtccagaactaagatgtaacccaaatagaaaaacagtcagtaaaaatccacgaagctcccgcatccctcttcttaaacatggcccagtgacccccgtgtgcgggttaaactcgagattcctttagaagatcgtgcttcttatataactaggactaatgaaagcagcctggaaatgagtgcacagtttgatatgggacccatcaaagatgtcattcagcctgaggataatgacccccaaggctgctgcaagagccatgtttgagctagagccagatctccttgaagtttatgcttcaataacttcgttaagcctccttggtgcttttgggtcaagcatgactttagtaaatgaattatacgttggataagggtcattttgtaagtgaaccaaatgatgataggaaagtcattctctgcccatacttatggtgtcatctgtaagcacagacctgcaactttccgtggttcagtgagactgagaccctgggtaggtgcactcatcacaggcctcacagggagattttatttaaattgacacaaagaattgaggattggtggcccatcgttttatttgaagatgtagacagcaaaactaaaatatttggatttcttttgttctgtaaaagatttatttttatgttttgaatgcctaaagagagaaaatagttattgtatgatgatggtcatcttacataaatgaaaataccatttaatgacatgaatcttattcattctaagaaattaaaatgcctgtaatcattcatttatattgttgccttgttatttggctttcgtgaactgtgtaaaaagttgtgaatttttaaagaattcaagagcaggattccgtttctggaattcaatatcggtcacactgtgattgcgaaacctctgtatacggatgcaggcagggagttttgttttgatttggtttggtttatgtgtgagcaaaatgtgtcatagatctgtagaaactatccaattttatagatcctttcaaacatggagttgccagacttctcctaggaattgtagcaggtaagataagccaagaagtaagaggaccatctgatagttcttatcttacttagatggaaagtggaaagctcatggaaactagaaatttttgtgtgtgttggttcttatttattaaaagatatattgccggatattgtggcttacacctgtaatcccagccctttgggaggccaaagccgaaacatcgcttaaactcaggagtttgagaccagtctgggcaataaagtgagaaatcatttctacaaaaaatttgtaaaaattagccaagcctggtggtggacacctgtagtcccagctactcaggaggctgaggcaggaggatcacttgagcctgcgagggacaggctgtggtgggctgacatcgcaccactgcactccaccctaggcaacagagaaggaccctgtctcaaaaaaatatatattatacatattttttattatatataaatatataatatatgataacatatatttatatatatatgtatatcacttgtaagcctcagtagtttaatattactaacaaacttcacagtgacacatcacacaaatgatctcagcatcctagaacttaaaatctaggatgaatatgttcttataatttttgtttctttctatatttcagataaaactcagatacctaaatttcatgatagctttctccctgggaaattatattctcttcttattgcaagcaccacattattgatttccctgatacctcattaccaagactcttttctgcaagagaaaagacgctgagtactttatccaagtttcacatcaggcccagtgatccccaacccactgtctttccatcaatttgcctcctccaagtcaaccaaatgcattcagttaataattgaaaaaatggtataaaaataaatcaggcatgtatagacgttgtcctcaggtacttgcagattaagggagggagtcaggtaaatggttaaagacataacaaagcatgggtgctttctcgagatacagacagaggagggagaatacagagaaatggcagcttcctgctgtaggagcttagagagagtctcgtggaggtgacatttgaaccaaagtaacatttgcacataactaggacattgccatgtagaggcgtctggtatgaggagggagcagggaatttctctaaatattgcaggtaaaaaggtttaggaaaagagttgtggcatatccagaaactgatcagaatatggatttggcttaagcctgcaacattcagtatctggtaggaaatggggccatgagtgtgaggagaagacagaccctcagggcgtttctgcaggcccctctctagcagctggggccatggtgggctctgagtgatgagagctttttatttcttaaatgatgagggtggagtgtagatagtgggctaggagaaagacatgtatatgtgtttggctttggggggtttgttgtggtttttttttttttgttgttgttgttgtttgagacagagtcttgctcagttgcccaggctaaagtgcagtggctcactgcaacctccacttcccaggttcaaacaattctcatgcctcagcctcctgagtagctgggactacaggcatgcgccaccatgcccggctaatttttgtatttttagtagacactggatttccccatgttggccaggctggtctccaactcctgacctcaagtgatccatccaccttgatctcccaaagtgctgggattacaggtgtgagccactgcggccggcctgtatatatgttttaatgagtcactttctacataaaaagttatttgcaggaaccagtgcggggaggtaagaatgacttaggcaaatctccttcttttaataagcttggagtccaacaacaagtgggcgagtcacaaacaccaacagctgtgtgtgtacccagatgcaggaagggacacagaaggaaaaagacacactgaacatttggcacagcagtgcattgagccagggactgtcagagctgagtgctgtgggcctctggtaatgaccattaaacaaacacctgccagaaagaacttctcctccactgggattcaacaatagggaatacctcatccagtctacctattcgtaatagacaatttagtaggcaaaatcttaaattttcataaagaagaatatcttaagagttggaggtttcacacatattgtatatcttaattttcaaggagatgcctatgatatgtttctaagatctttttttttcctctctggaataaatactagtgaacttaatttatttcaagaagaatacagatgcacctcttaaacatactacatacactccatagtctcagaatccaagactgcaaatctcctgtctaaaaggaatgagttaatttttgaaaagcagagtgaagatgttatgacataaaagctataaaaattcacttaatttaattaacttgacccgaaggggagctatgtgagtccagagacttaagattttttttactatgtgagaatatcccattaccaagtgtcatatatttatcccataattttcagcatgttttactgtggggttactcctcaatggcaaatgttccctgagcacaatgaatggcatgcgcccgtggctagaccccacaagaaagtcaagctcctttgaacccacagtgtgctgggggtcttcgactctctggaagaggttttgtgaaggggcctcttcaacagaaaggggaaggagtccttttggatctgccccatcgttaccatccagcctgctgtggaacaaaggagaacagacctaacgcctgtgcttggaagaacttggaaatgtgtgctgggaaacaggatcgaggccttccttagtgtcacttcataacatagaagtgttcacgtgacacctgcttgtttagatgactggtgtagctcaatcttccatgattacagctacagaattttggatatgcttttattgtttagcctagaatacatttagagaatataaaaaatttactcccatctttaaggaggttacattctggctcatccattcactcatgcagcattgtgttgaggacctactatgtgacagggactatttcagccactgggataaaaaggtaaagaaagcaaactccctccctccccccatgaaccattgtaggttaaaatagcccagtggtatttttcagagctcaataccaggcagaactggatgtaaccttcacaaacttggaattccatctcacatctgacagactaaaaaactaaaatcactcaagtaacctgcccaattagagtctcttctagtttgtactataccttcaacctggagttgagactgaggaaggcggaggaaggtgagaagaagggagtgttggtcaatcctcagaaaaagaactaggacaggctgggcatggtggctcatgcctgtaatctcagcactttgggaggcccagttggttggatcacttgaggtcaggagtttgaaaccagcctggccaacatggtgaaacccccatctctactaaaaatacaaaaattagcaggatgtggtggcgggcatctgtaatcccagctacttgggaggttgaggcaggacaatcatttgaactcgggaggtagaggttgcagtaagccaggattaaaccactgcactccagcctgggagacagagtgagactccatctccaaaaaaagaaaaaaaaaaagaaaagaaaaaagagctaggataaattagatcatcattcacagcagcatattcacaatagtatcaaataaaaaattttgaaaatagaataaatgtatgcccattttttaaaattggcatgcatttcctgaatatgcttagaggaaaaagcctgggaaggaataaaacaaagggtcgtcaatatttatcttctaggatcaggcatgctttttttctttcatctcacttatctccttacagcatccctgacaactggacttacctgttttatctttataccagaaaccagcccactctaccaggccatgcaaggtctttcctgctcagcaggatgatgggggaggacgcgttgtgtctctatcatggcaatcagaagaaggagaagatattctgtcatcagggaaggggtgaaaccgagcatgggagagaataatatcagaggcagttgcctgcttcatagatagttacagaaaaacatctgaactgacatggtgcttacatgagattgccacagttgatacagctcagaatacagccttttgaaaagtctaagcttagaagcagtcgagaacacaaaaggaaagaaaggagagtgaggtacttggactgagcgaggtggaaggtaatagaatcccaaataattgggttaaccaaatacgcaatgaattttcctcacatacaagcaatcagagatagaccatctttttattattttttattttattttttgagatggagtctcgctctctcacctaggctggagcgcagtggcatgatctcgggttactgcaacctccacctcccaggttcaagcgattctctgcctcagcttcctgagtagctgggactacaggcacatgccaccacacctgattaatttttgtatttttagtagagatggggtttcaccatgttggccaggctggtctcgaactcctgacctcaagtcatccaccctcctcagcctcccaaagtgctgagattacaggcgtgagccaccaagcccagccagatagaccatctattatggctagtgtcattgccctcaaatatcaaggacccaggcttctagagtagggtgttccaacctcagcactattgacattcggaccagatgattctttgttgcagcagctgccctgtgcactgtaggatacatgcctgccctctacccactcaatgccagcagcacccaccacctacgctgtaaaaatcagaaagtctccagacattcccaaatgtcccctgagagggcaaaatcagcccttgttgagaaattactattctatatccctgctctgccatcagtaacatatggcttttatctttagattcacaaaagaaaagtaggcaggtgagtttgttggcagtcacagctctacagaagccttgtggtagctttcagctcacatctgtctcgtggccctgagcttggccacgtgactaaccctttgttacttgcacagaagtcggggaggagaatatttttatctggacatattgaatccctagccaacattagggttctgaggaggacagaatgggtttggggcaggtgactggcaggctctacaagaagacattagagaagaaaggagtaaaacagatatttcactgacctcaatgataaggcatttcatggatacaaaaggagggcccccctgcggtacaaagcatggccattctagcactgcccccctgccttctaggagcacagagtgtctgtgagcactgcagcagcccattcccaaagaaactgggctcctgttcatattccacgaggcaagtcttagaccataggtgtgcctgcagtcactccaaattgcatgtccctgcagtgtgaggccaacattaagtcttgagatggagcagcgttaattggccattgcttaagagtctcttcattttctcatctcatgggttttaaatattttttaatgttttataggtcctttaggacaccacaccttttcatttattttagtatattttggttaaaaaaattctgtgatgtttaaaattagggaataataaaaaaattccctatgaaacctcacccttagcttgaagaagtaacaagtcatagtgaatctctgtttcctctatatccccaccacccaccaacccccccagatcccatacactatatcattccatctacagatatttcagtatgtgtgtgggggtcctaaagacaaccaggtttcatgagtcactgggaggactcataagagtcagcatttagacacaattacagctgtgagttattatcgtgaaaggatacagaacaaaattatcaaaaggaaaaggcacatggggtgacatccagaggaaaccaggcacaaacatctaagggccctctctaaacacaatacatgcttagtgcccctggcgagttgtatagcatgggcatgggcggactgtcatctaccagagaacctcactagagactcagttcccgtgggttttataggtggctcgtcacactacattctagactttcagaaggaaagcaggtgaccagccaaagccacagggaacaaaatagtttaggcacagaaagccactttgatcagtgatcagtttgaagaaaaatgtccaggaattattatagatagtggtgatggttgcacagctgtgtgaccattctaaaaaacattgaattgcacactgtaaaatagttaaaatgatgacttttgttatgggaattttgtctaagagaaatacatcccagttggcaccatttctataaaaaggaatagtgagagataaagcttataatatggtttcgctgtgtcactacccaaatctcattttgaatggtaattcccacaatttccatgtgttgtggcaggaacctggtgggaggtgactgaattatgggggcggatctttcctgcgttgttctcctgatagcgaatgagtctcatgagatctgatggttttaaaaaggggagtttccttgcaccagttctgttctcttgaccgctgccatatgagacatgccttttaccttccaccaggattgtgaggcctccccagccacgtggaactgtaagtccaataaacctctttcttttgtcaactgcgcagtcttgggtatgtctttatcagcagcctgaaaatggactaatacagtaaattggtaccagtagagtggggcactgctgaaaagatccctgaaaatgtggaaatgactttggaactgggtaacaggcagaggttggaacagtttggagagctcagaagaaggaaaatgtgggaaagtttggaacttcctagagacttgttgaatgttgaatggcttttcccaaaatgctgatagtgctatggacaatgaaatccaggctgaggtggtctcagacagagatgagaaactagttgggaactgcagcaaagatgacttttgttatgttttagcaatgagactggtggcattttgcccctgccctagagatttgtggaactttgaacttgagagagatgatttaggttatctgcttgaagagatttctaagtagcaaggcattcaagaggtgacctgggtgctattaaaggcattcagttttataagggaagcagagcatgaaagtttggacaatttgcagtctgacaacatgatagaaaaaaaaaatcccattttctgaggtgaaattcaagccagctgcagacatttgcataagtaatgaggagtaaaatgttaattcccaagatcctggggaaaaatgtctccaggccatgtcagagtcatcacagcagcccctctcatcacagacctggaagcctaggaggacaaagtggtttggtggactgggcccagggttcatgtgctgtgtgcagcctagggacttggtgccctgtgtcccagtgactccagctgtggctgaaatggcccaagttagagtttgggctgtagcttcagagggtgcaagccccaagtcttggctgcttccacatggtattgagcctgtgggtgcacagaagtcaagaattggggtttgggaacctctgcctagatttcagaagatgtatggaaacacctggatgcccaggcagaagtttgctgcaggggtggggccctcatggagaacctctgctagggcagtgtggaaggaaaatgtggggttggagccccgacacagaatccctactggggcactgcctagcggagctataagaagagggccactgttctccagaccccagaatggtagatcccttgaaagcttgcaccacacatgtttgaaaagctacagacactcaaggccagtccatgaaagcagcctgaagggaggctgtcccctgcagagccacaggagtggagctgcccaaaaccataagaacccacctcttgcatcaacatgaccgaaatgtgagacatggagtcaaaaaagatcattttggagctttaagattttactgccctgctagattttggacttgcatgggtcctgtagccccttggttttggccaatttctcacatttggaatggccgtatttacccaatgcctgtacccccattgtatttaggaagtaactaacttgcttttgattttacacgctaatagacagaagggacttgccttgtctcatatgagacattggactgtggactttggagttaatgctgaaatgagttaagactttgggggactgctgggaaggcatgattggttttgaaatgtgagcacatgagatttgggaggggctaggggtggaatgatatgatttggctctgtccccacccaaatctcatcttgaattgtaattcccacaatccccatgtgtcatgggaggaacttagtgggaggtgatgaattatgggggtgggtctttcctgcgctgttctagtgatagcaaataagtctcatgggatctgagggttttaaaaaggggagtttccctgcaccagctctcttctcttgtctgctgccatgtgagacgtgcctttcaccttctgctgtgactgtgaggcctccccagccacatggaactgtaagtccaataaaccacctactttttaaaattgcccagtctcgagtatgtctttatcagcagtgtgaaaatggactaatacaacttatgagttgaatttggggtgaatttacattatattgaatgtcaggtaaggagactgaactctattttgtagttcgtaggaaggccagcctagggagttttcatggagggaaaagttaatggagactgctctgttgacaggatgtaaatagcagctgggaaggaaaatgacaacatgcaaaagagtcttttaaagactctagtgaaaatgtttcacatgcctgtgactcagttctgatgatggctgtgatgctcatcatcaaaaaacttgaacttgtcttttaaggtctctatctggtcaacagcagaataacggctaccatggacggttctatgtgtggtcctggatttcctaagaattctcctgatccttgcttcctctgtttctgctctagaagggaaaattggagatcagagagttgaagctacaccttgcaatacagtacagcctttatttacactattaaaaccccttggccaaatggacaaagtgacaggcttagccctttgtatgtttgtccttatatttgcttattcaacaagtattcacagagcatcttcacttgccaggccaggtgattcataaggaaacagagcctcaaggtaaaatccaaagagcatgtggtttgaagccaatagacaggtactccagtcccaggttccatgcttactacccaattgattgctgcctctcagccattcctttcttcacctacacgatgtacctgaccaggcttttcttatgtaactactggaggcaaggtgggctctcttgactgaaagcactctgggaacacacaattttggccaccataaatgacattaaagaatacaacttttgctttagaatctgcgattattgtttgactttagctaagtaagcattttgtcaaatctaacagcaaaagcttctcagtaaaggagcatttcaagaaacctgtgaccctcatagccacaacatttaagatcagcatcaaatattttgtgtaaaggttccacagatgtttgattttttggggtaaggaaactgaggcttacagatgtttttgagacttaaagaattgacacgtcagtctctaaatgaaaaactgcgattaaaacccaatgcttctgcatcaggaggactagctaatggttgctgggcttaatatctgggtaatgggttgatctgtgcagcaaatcaccatggcacatgtttacccatgtaacaaagctgcacatcctgcacatgtaccctgaaacttaaaagttgatgaaaaaaaaccaatgttcctgatttatagataagtaataaaaacaacaaagtatccttttagctgaatgatccctgcttgctaacattgatgaatttagaaatgtgtcttcagttgacctctactcactattatttttaattagttttcttaacagccttaatagtgtttagagcattttatgaaacagtgccctctagtggctaaggatacacttttaaattgcaataacaggtgctatttttagctagctggagaattgatggcgaggctggcatttaaagagatgtattatcttgtggcagatgtgtatattgtacatgtgtagcaaataagcatgaagacagttactgtctggcttgttaactaggtgtatgatttcttgatcaccgacctattaaatcacttattaatatataatcttatcgtgagtgtaaatttagctgcctgtcatttataataacattagcgatgtgacgtatgatcatttgagcaagagcactgctttctgccaaagccaagagcctcaataattatttttaaactgtagttaggtatgatttaaaagagatgtgagtacaagaatagataactcaaggatcaacgtatgggacctaatttttatgaaaaattactcctgtctcattcttcttttcttgtccaacagatcattacaacccaaaagctcaataccatattcctcaaaatgcaaattaaatactgcctctcaaaatagcctttcttaactaaaaatatccaagtttatcttttacaaatttaggcagtttttggttaaaaagacaaaacggtaatggaaaatatacagtatcagggtgttttttttttttgctgtggaatgctattaaaattacatgtttttgaaacttgtcgtttgtggttttaaatcctcaatcatgcattacctaatatatgcatatctgggtccatgcagtcaaagttaccatgttgaaagagattttgcagtttaggaaagtaaggatcataaatgtttagtgaattaagctgacaaaaactattccattttgtaattgcagaatcagaactaggagactgtctcttgactacctggaatgtatgatttacacttgtgttctggacagcagcatctggaaagtctaaatactgtagtctcttcagagacttccaactcagattcctgggattccagagctggcaggatcccctgtagtctggcacagacctctcagcccatactaatccttggcttaattttattctgaaagactttttaaaataaactttttatgttttagaatagatttacatatatagcaaagttgcaaaggtagtacagaaagtttccacatgccccaaacccattttcccctattattatcatcttatatattatgcaacgtttgacacaatgaattaatagtattgatataatgcatcactgttagacaaaatttatgcttaattcagattttcttagctttcacctaatgtcccctttatctcccaaggatcccatccgggacaccgcagtgcatctctttcagttcctcttgctgtgacagcttcgcagaagttcctgtttcttgatttgggtgaccttgacaaaagggtacttgaggaacatgggtcacgtcttttatagaatattcttcaattgcatcatttctgttttgttttgtttcattttccctcctaagtagactgggtttatagggctttgggaggaagactacagaagtaaaatgcctttctcatcacatatctaaggaacaggctatcaacatgatttatggccattggtgttgaccttgatcacctggctaaagtcgtacttgtcattttctctactgtaactacatttttttacccctctttctatactgtgctctttggaaggaagtcactatgcatagccctcacttggagtggaaggcaatgctctttcttcttgagagcagggtatctgtagaaattacctggaattcttccatatggaagatttgtctactctcccccatttatttatatttatttatctataaattatgtatttattatttatttattgaatcatttattaatatcagtatagacttagagatacttatttaagactgttggaagtcattgtttaattgccaagatttgaaaaagttgattttgacaatgtttgcaatctcattgcttttctggaagagatttttggagatcttaactctgctatttggatgtagctcctttttttgtaggattttacacacagttttttttttctcagtttttgttgtgttcagaatggcctgaactctgacacagttgatattggatgatattcttatccctttcaatgctctcaagaattttcagtaaagattttttaagtttcacaattttttgtgctaccaggagaaatgtgtctttagagggtgactattgaatatatagaaacccacattcctgagatttttttgtgtttaatggtatatttcataataatacaactatcttaaaaagaatcacattggcatatttactctgcattattcaaatggctaatgctttgagaaggaacatcctctttataataaaatgagtgctgtcttgtttggcttatttagtatcaaattaatgtgatactcagtgtttcattaagttcctccaaataaccaattttaaagcaacttcttcattctttcatggatataatgctaaaggcgtaaaaagatgatgacccatattatctgaaagagaaaaacatgatttctcctttctctcttaaaattaagatctatatttatgatagcaaaagtcaggtgcttctctccccaccttttagaagctgcttagtgtgatcaggggataactacagagaagcgctatcaaacatttctttctgcactttcagttaggaggatgatgaatgcatacatacacattttccctttctagtagcaatagattaacactgttgggaataattcccctagaaagttttccgagagcctggaaatttcacatcatacttttctagccctgggtcactgtgagtttgccaaagcctccagcagatagataaattggtttccaagtgaacaaagtatattagtcaatctcctgaggcattttttctttgatggccattgagtgtgttaagcagcaactgtatgcccttcataataaaaagcactttaagttgagtgatggaaggctcttgatacttgtggaatgacagagaagttttgaagaaatgaacattagtgcaagtagacaatatttagaaagcataatcaaataaagagttttaagaaaccataatttttttttttactttaagttctgggataaatgtgcagaatgtgcatgtttgttacataggtttacatgtgccatagtggtttgctgcacccatcaacccgtcatctatgttttaagccctgcatgcattaggcatttgtcctaatgctctccctccccttgctccccgccctgatatgccccagtaagaaaccataataagttttaagtcaaagtgagatggaaaatacagagaagggttagtctttgaagactttggagaggtgatttgaaaatcagatgttaaaggaatgcatgggcataaattagcaggacattccaaaccagggctttgatgtgaacataagtcagttatgtgaggaagcagcaggcaagagcaggactggagagggtttgatgtcatctcaccaatcatccacccaataaagaaatctctcagcaacccctggcctgtggtcagccaatctgtgtctgaatgtatcgatcaagtaataatagttcagtgctcttagtgaggaagccagtgatgattgttacatggctctataatattaagataaaatttgtccccagaatgttctatgcttgggttcaattattccttttggagcaactcagaatcaatctaatattttggggaagtgacagtttttcagatcttggaggaagaacttattattaatctctctcccccattcaacttaattgaaagagtctccgattagaaatttgagaaaagatgttctagccccaactctgctatgtattatttgctttgtaagcaaagaacagttaaactgtctcaactatatatagcgtctatttccctctgttccttccctatccagggcttggctctatgaaaagcaactcgaactcttgccttccagcttgggatactgctccaagatagcccccctttagtgaactcctgtctcctatgcagttccatcttgttatcttatacctggattctccatctctgcccagacactacactaatttggatagttttatttctttctcacgttgcaattaatgaggatgagcctggaggtgggggttcctccatggagtccttcagggactggggttccctccagctggtgactgtggtatctataagggctcaaattcctccatcggatactctgtatcttgatggcagactcaagaagagaatggtgaggctgtcacaggaagttttcaggggctgggcatgaaagaggtatgcatctcttctgcatatatttcccattaattcacagtcagtcacttgaccccatctaactgccagagagcaggggaaatgtagcctagttgagtgcctaggaggaaaaagaccaaatgtagaaccagtgcatgtcacttctgcctccacttgtgctagaattcaggcacacagtccccaactaacctcagaggaatttggaaaatgtagtctggttgaaggctaagaaagaaaaggcactaattagactttccaagcttatcagctttagagaagagaaaatagcatagattttctatgttatggagtaaagttgtataatataataatgcatgtgaaaatgcttataatctggtaatgtggcataaaaatgaatgttaatatctttttttacaaataattctggacaattagacagccatgtgcaaaataatgaagttggacccttacctcacaccatagataaaaattaactcaaaatggatcaaaaacctaaatgtaagagctaaaactaaataatttttaggagaaaacagagggataaagctttataactttggatttggcaagattcttagatatagtacaaaaagcaaaaacaacaaaagaaaaaatagataaactgaagtttatcaaaattaaaagcttttgtgtttcaaaggataccatgaagaaagggaaaaggcaatctatcaagtgggagaaaatatttacaaataatttacctgttgaggaacttatatccagactatataagaatgcttaaacccaataataaaaagacaattattccaatttaaaaatgggcacaaaatctgaggagacatatctccaagaaagatttacaaatagcaatatgtacatgaaaagatatttgacgtcatcgttcagcaggaaaatgcaaatcaaaagcacaatgagacactactcccctcttcctagaatggctacagtaaaaagtcagataacaagtgttggtgagaatttggaaaaaacagaaccttcacgtcctgctggtggtaatggaaaatggtgtaaccactttggaaaatagctgggcattttcccagacaaataaacatagagttatcctttgacccaacaatttcattcccagctatatacccaagaaaaatgaaaacatataaccatatacaactaattacactaatgtttgtaataatattcataatagccaaaaagtgcaaacaacccaaatgtacatttgtgtaatggaacattatttggccataaaaagcaataaaatactgattcctgctacatgctacgtactgattaagtttgaaaactgtaagacagtcacaaatgactacaatatacatgattccttttatatgaactattcagagcagagaactctatacagacagaaaatgggatagtggttgcttagaatgggggtgaggggcatgggggcaaagaaagtgatagatcaaagttaagggattcctttttgagattctgagaatattctaaaattaattatgatggtgggtgcacatgtctgtgaatacgttaaagaccattaaattgtgcactttaaattgatgaattgtatggtgcgaattctatctcaatgaagctgttaaaaatgaaaggtaatatatgcattattgttaataagatactggcctacccagatgaaagactgtgcaacactcatggcaggtccttagaaaccaagttctgaccactcaaccatgagaaatactaatgaggaagaaatagaacaagcatctccagcaaccagtgtactagtctggacagctttctgatgatcttgactttaagaaaaatgtatatacaaatggagctaacctcagaacttaaaaatcatgccaagatgaccaagatccaagatgatgtaaagcttgtaagaagtgtaaagggaccaggcacggtggctcatgcctgtaatcccagcaccttgggaggctgaggcaggtggatcatgaggtcaggagttcaagaccagcctggccaacatagtgaaaccccatctctattaaaaatacaaaaaattagccgggtgtgatagcaggtgcctgtaatcccagcgacttgggaggatgaagcaggagaatcgcttgaacctgggaggtggaggttacaatgagctgagatcacgccattgcactccagcccaggtgacagcccaggtgtctcaaaaaaaaaaaaaatagtgtaaagggcattgaacagaactgccaggtaatattggagcaagtaagagggtaaggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtggaggaggtatgcaggataaccatgcagtaaatattcttgcatgttctccagtaaggaatgtatttttcaaaattgaaaaggaaaattcgatatcactttcttaggaagggagggaagattgttcaggaaatagtgagaacaccgagctgctcagggagattcacctcaatctaaagtaaatttgagatgggataacataaaaataactaggtttaaggtactaggacaaaacatctagcatgcattatctcttttaattgctcagtaacccagtgaagtaggtaatatcattatcacccattcagagaggttaagtaacttattcttagtcatgcctgtagacaggatgaacaccagtttgaaaaaccctctctctggctctgggggcaaggtgaaagcccacgccatgtgtttgagaattcagcgcaggtaaagaaatgtttttttgcattggtgatattttatttagtagtaacactttattcctaaggcgtactagttgacttgtcaatgaaattacagaaccattgtaaataatctgtagaaatttgcaagcaaatgagaaagcagctgaaagactgggaaaaagagatgattgttttagttgtcaaaaaaggtaaatctataggactagttcataactggcaaaattctagagccatttaataaatacaagtatgtcctgtaaagcggtttgcatcctggtaacacctaattgtaagccatacaaatactccattttcctaacttatttctagagaatcaattatgatcttaccatagtgttatcttaacagcttttatactttcaaatgaaatggatttattcaaacattagttggtgatatactttttatcatgctgtaaatgatcctaatagaatttgttaaaacatttaagttacgagtgaagcacagttttctagatgtgtgctggactaacatttgccataaactatcacataatcagttccttgattctttatggacctgaagcctacttacataaaattggtctagtaactaatgataaagattaaataaaagtcattgaggtcattgacagaaggctatgttttcctctaaaatcatggcactcaattcataaacattattcatttttcttctaacttgtatatacttttagatgtaattgtgtttcaattttgattgcccagctaatcggaaaagctttaaacctcttaaacagtttctttataaaagcataatgacgtatataatggctttcagataatcctgtcacagaaatgattatttttctctattcctggtgaaccaaagtgcccccatgtgcttctacgtgtaatgttatataaagcactttgaagcacgctgtattatttttcatgacagtatcattgataattctaatggtaatttttccttcacacttggtagcttccaggcataatgacacatcactaaagctttgactgttaaagccctttgctcatgggtgaagaaaagagaatggcaagttaaaaataatgacttaatcctcatttacattgcaatgagttattctcatttgtggaagagggatgtcttcgatggggaggataatgaaggcgatgagaactatcagaccttttgtgcccgatcaataggtcccataaataaaatctcaaatcacacactacaaagtggaaatcatgtgtaatgggaagggagtgaaatcatcatcttagggatggcaagttcttactgagaaggatgacttcatgctggacctcttgtggtttccagagctgtagatgaataaattttcatcccttgattgataataaattttttgaggacaaaaatagttctagattgagaattcagtcattagactagactcaaggggacatactctagggacaactgtgggagaccatagactagacgatggctttcttacctgcaggaacaggaaaaaccatcttcaattttgtggtctgggagggactgtgcctaagcaatgagaataaaaatacaatctattctattgaaaaggtctttagagcatccttccagtaatctaaaagtgtgacaccccaaatacactagttctttcattattttcttcttccttctctttatcctgaagcccttaagtctactcaattatagaatttcttcataaatgacttatagggccatttttgctgggaatggaatgattttccatatcttctattccatcctacctaattttagtcaacctgaaaccactgctttttgtgaataacgaatgtccaacagaactcccaccaacctcacagtcccagacatctgcattactgtgggtagtcactcaaatgtagctagaggaggctttaccagaaaagctaattgccccaaactttcctcttggaattagagttgagtttttgttggtttgttttttaatgtgcccaattaatcttttattggtgtgggacaaatgttgagactaacaagaagattttggataagtggataacaatctcgcaccctacatccctccttcatgggggaatgtaagtgtggattgacccaaagcaggaactctaggggtgaagcaaggactcagctctgccttttcatcagctctgatcatccattagagatgtccaccctgggaaacatgggaaaattttcacaccacccaaagccctgcactgattccaccacaagctcccagtggggtctgggccttgtatgtcaacacagcaagatagctttgtatgaggacagtttccttcccaccagacgttagagtcatcctaggaacaactgtccaaccctgggcacgtgccacccagcagcacttctgaatatgccactgaggggagagatgaaataaacacctactcaaacccatacatctttcttaaattagccacaactaatttctttcatgctgatttttatttctaaagctgtgatttccaaagccataaactttgggtctgaatgaaattaagaagggttagagggctgggcacggtggcttatgcctgtaatcctatcactttgggaggccgaggtagtggattacctgaggtcaggagttcaaggccagcctgatcaacatggtgaaaccctgtctctactaaaattccaaaacaattaggcaggcatggtggtgggtacctgtaatcctagctgcttgggaggctgaggcaggaaaatcccttgaacccgggaggcagaggttgtggtgagccaagatagcaccactgcactccagtctggccaacagagcaagactccctctcaaaaagaaaaaaataaatgggttagaaatacagctagacgctaattcagaccctctccttctcatactttccatcaaacccatttttctttctcaggaattcttttttttcaattgctgttaaatatataatataaaatccaccattttaaccatgtaaaagtatatactttagtggtacattcacatcgctatgcacccatctcctccatccatctccagatccttcctactttccaaactgaaactctgtccctattaaaactaactccccattcccccagcccctgcacccaccattctacttcctgtctctgtgaatttgactaccctggggacctcatgtcagtggaatcacgcagtatttgtccttttgtgactggcttatttcacttatcataatgtcttacgggttcatccatgttgtagcctgtgacagaacttccttctcttttaaagctggatgatattccattatatagacagacaacattttgtttacccatttatctgtcaatagaatcttggatggcgcctactttttggccattgtaaatgatgctgctatgcacatgagtgtacaaatatctgttcgagtctctgttttcacttcttttaagtctatgcctagcagtggaattgctggatcaagtggtaattctatgtttaatcttgaggaactgtcataacatttataagaagctcttaatatttccagaaaccatcccaaatagtggatgagccaagaagacaaagtcatttcaatgccattttgacactcaagaaattaggccttaaaatgcttaatgtacaaaagaacaagcaatatacacttgtctctcttcaatggaaatagagttatttctgtgtgagagtctgttactacattctgtggaagtggctggagagtttacctggcttacaaagtctgttttgaatggcctgtcataaaatttgcatttggggactctggcgtggcacttcaaaaggtcagccaccattctctggaataccatgtgattggagaagcagattgtttccttcctcatggaataattgtcctgtcctccctggtgtgctttctacaacaatcagggtccaccgtgcatgagaggccagaggacctagttctgggccatggactagattcctgacattgggcatttactgtttctgagttccttcctaccttccttccttccttccttcctacttttttcccttccccttccttcctgtctcccaggctggagtgcagtggtgcgctctcggctcactgcaacctctgtctcctgggttcaagcacttctcctccctcagcctcctgagtagctgggactacaggcacgtgctaccatgcttggctaattttttgtgtttttggtaaagacagggtgtttcaccgtgttagccaggatggtctcgaaatcctgacctgatccgccctcgtcggcctcccaaagtgctgggattacagacgtgagctattgcgcctggcctgtttctttatgagtaaaatgaataagcttgcatgtgaagacaaccccaagtctcttccagctctaagttcccacagtgcacggaggcccagatgatcactgcaggaataggaaaaaccatcatcaattttgttgtgtgggagtgtctgtgcctaaacagtgagaacgaaaatacaatctattcattgaaaaggtcttcagagctcagtaaattttgccaaattcgatccatggtatacattacacctactaccttttctgatttcttttctctctttttcctacaaataatcactcttcctcaggtctggggatagtccagtgaacttgacagagtcttcaaggtctttcctggggccagactcttgcggcaccagctctgtttaatgtaacttcacaaaactgctccatagcctgacttcctggaagggtgttttcctgctttcccagatgaccagaaggacttcctcaatacctactccgaactctgctttttttttttttggtccagacagaaacataaaaagagaggtgcagcattccaagatgcagggagcgcaaaggactgggaatgtcaggagaccatgcttagccacgcaggaaggcgctgaggaaccgtgctactgaaaggagaatgagagctgagccccaggggaggcatctgcagtctcccaggagaaatttctcacatgcactgactcaagaaaatgtgacgtataatcatgaaagacatatattatacacaccatggctgattcctacgaaagaggaaaacaaccaggcaaatctatctgggaagcacaattataatatttattcacttgagtaggactctatcctctgatttaacacatggagtgaggacataagactcaggactgggatgagaaatgtaaggtgcatgaatttcaaaaataataaaatgaaaatatttatttgcttatggttcaattacgtggaatagaagcataagcagaaatcaaatggtcaaacttacaaaatctgctcttctttctgaacagtgatcaatggcctcactgaaaggactcagggcttggatgtctctgtggggtagtttattctagcacttgtgtgtgttttgccttggcaacacggaccaaggcaccagaatagcacacagcagctgaatgccatctcgaattttctgatttcactcccaggcttccagtcttttctgttatctttttttattttgaaatcctcattatgtgtttgctatatgaaagcacaccaaaatgtagcatgacacagtccctcccatgaaagcagaatgacacatggggaaggaaaaacatgatccaagggctgggagatggtgaagaaagtgctgagtgtggaccaaggtcatcacttgcctctgtagctcccctggcaggactggacatgtaggaggcacccccacagtcagtatttatttggtgttctaggttggaataatagtgtgattccattcaagggaaaggaacaaaatcagatcccagttgtaacactcattgcagcattttccttgagtctggggcaggtgtgtccagcgattctgcttggagaaggagaagatcctacagatgagcttctccacagggtgagagttgagcacccagcacggtgtctgcacagaggatgacaaaaatcttgaatgaatgaatggagttgaataagcaaacctaggacagggtgtggaaggtgaactcatggttcataaagtcagatactttggcattagtgaggtaggcctgtgtatgtgagtattcacacgcagttgtttctgtacttgtatgagagttactaatgttgatctagttgacattgtttagttcctagcataaataaagtatcatgacattgtttaagggaagaaaatttactttgtaattctgtggtgttgaaagtagggaaagaaatatgttgccttttaaatacacagcagcgctctcatggagatcacatggaaatgacagcggtgttgtgtccggaaagcaaaagcaaaacaaaaacgagaaaaaatgaaaccaacagaacttgggcacttaagaaatccatttcctaatggagtaaacagatatcgcactgcaagttacaattttcaacatcgtttaccctacacctccaccattcggagaggcagctctaataaatgagatgcagtgatgacctttaccggctccaccgatagctataaattgagctgaacattcccatcagctaacaggacagaactcattactgactgaagattgctacgatgcctttgactgagatgtgtaccattaaaatgaatgctccttcactcgtaaaaacaatgtcttgtaccgcagaagacctgatatgccattcattgatttttgtggatgactacaagaacaacccgtaaagattagctgagtcttactgtgtgttagttaaattatgattcagatcaatttgttcttttttgagagagttgattttttgtttcttaaattagaacctttgtcgatggcatgcatggaatataattgtcagatttacagtcctgatgattcaagcttagataaacacttgttccaaatacattaaagtaaaacttatatccattaaactaagtcaggattttgaatttttaaagctttgggtacatagaaaaaatttggttttgccgatttttttggcaaaatgactctgactttgagaacaaaccagtgtccatgcccaggtgacagcacttgccctgctgtgattattaaagcagccccttgcactgccaagtgtcctagtccagatgatgaattgcacagtcttattggaagtatgtgaaatgggaggactgtagccatacttgatctctaggatacacttttatcaggccctacaggtaaagtattcccataggccttgtggattttcacaggaaggcctaagttactcagatgtctgggagttgtccctggttggtttctgctaataacattagtagtcctgacgcttcatacttagcaggacctaataggtgaacccagatatggttctaatgtcatttaagttattaattgacattattaatatccccattttttttcagatgggagtatcaaggcacagaaaagccatataacctgtctgaggttccacagttaatagctagtaagcatgggaatttcctaggactccaggttagggaactacatcagacacgggttctcatttcaccaggaaacaaatgcgaggacattcttacttccacttactacaatatattaatgactagtgtgtgatgatacctccacccactcggagcttagagtgataacccggttatcctgcagctttcagatgatgggttctacctctctaattgactagactttctctaataatactggcaaagtctttatgggtcaaagtcagaagggaaagagtctctagtcagagccagagtcataagacacagtgaatgtatactaatgatgccacttggtaaacttccagcatgttatgctggaggaggctgggaggcagtctgtccctctgtccctctgtccttggtggcacagacagccccctggagccagccaaattcagactcacattctgcctaaggcagagggacacaggcagacacacgctaccaggagacgtctgcctttgacatcccacgtttgtgacacatgccagatcttctcagaaagaaacagtgcaccacagccactgtgccatcaggcactttgacactcacagacataaatgggcaagtcggaaggagtagatgattccctctaagaggacctgcctacttttcctgggagagtgaagaaacctctaatcattggtttctctgtttttccaacccaatgagtagacagaattgttccatgtaatgatttttcttctctctgtataagacactggccttcctgctgtttgcattttggattattttgtttgcttttaagtcagaaggacaagagttgtgtatagacaagctttatcatagattctacctaaaattcttctggaatatgattcagttttttcctttgtaaataaaatcataggtgaatgtgtggtcaaaaggtgtagttggttttcccctttcagagatctgagtgccgctgggggaggtggcatctcatatttataaaacatgttatttattttcttactttcaaaatgctaaacatagctgatctcaattaatcagcacagtaaccctttcagaaaaataaggtattctattactgaaaatgaaagactgcaaggtaaagtaactgctctcaaaaaacgctgcaatgggattagaaccaaattctcctgattccaaagccagaagttacagtcagagtatgattgtatttctttattaagattaaagtcagctctcagcagcagaaagattaaaataatactagtttaagaaagatggaaatttacttgtctctcaaatttatttattttccacatataagtccagaggtggaatctacactgtattttgcttttatcttccattttcatcttttgcttttatcttccaagatcacctaaaggaacaaaatggctgctctagctccagccatcataaaagccttcctgctagcagatatgaaagaggagaggggactatcatgctctatccctttcaggactctgctttagaggttgcactgcatacttctggcatagccagtctgtggcaaagcctaaaatagaggccaaatttccagatttttggaccaagctctttccaacaatctgtcccttacgcctggagctttttgtcaccgttgtgttgatgtaatctttggtcaagtttctgtctctcagcctatccattagtctttgctagtaggaggtgatttttctcagggatgcatagataaggtaaggtggaggcttggctccattggaaatgctgaaatgaatttactgcaaaactagtgttttctatgggagtgggatggggcaggaaaatctattgcatctccaccagccagaattcacttgcgtctagtaagacctcctcacatttccatcagtgtctacaacttacagagtcacaaaaagctcggagacaataggaacagacatcaaaattatcagtaacgcaaaatataagtgcccatataatgcctaatataagtagcatgtaccggacaatgcctcgtattctactgaagaaatagccagtgatcttctggcggcccatttcaaagtcttaaatttttttgacaccttcagtaatacttgttattgatttgctctaagtgaggttttttaaataatagaatcatcataatccctttagagatccttcaaaaaatcttagatttatataacagctaatcataagaatccttaacaatgtgtatatgcgaagtccttttgttcgttatcaggaaagggcttggctgataacacatttctgaggatattcattcctggataaatttttaaggatttttattctttgctgatctttatttcaccttcacccctctcaacatttgaaagcctacttaactctatattttcttttatgttaggttcaagtgaaaaaataatttgcaaaaacaaatcctaattctacaaataaattgtttttttttttttccttaaccatgtagcaggtggttgacaatattaaatacagaaagagggccttcgttgtttcagtggggtttcagtgtatcaagctgtttaaaagtctaaacaggactctgttaaggcacataaaaattgaatagaaaataatggaaatgtaaaagattttaaaagctatttgggcaatgcattaatcaaaggcaaattgggcagtctcagatcttatgattaaaaattaagtgaaattgaaagccactaaagtcatctttgaaatgtagctacttcccaaataatttccaagctgtgattatttttttgaaagtacgaaagtacttatcaatgtcattactgacgttgtaaaaatagatattgtggtatcattttaccgtagtttgaagtccacagaatgtaataaccctcctctcagtctatccacacacgcttacccatttcagccccagacaattctccacctttgtttccaaggtttagggtttctaaagcaaatgcctcctaataacctcagacttacaaaatacagtacctggttgcattcttgaaagggggaagaaaaatattacgtggtctttctaactcttttttttttctttgagacggagtcttgctctgtcccgcaggctggagtgcagtggcgcgatctcggctactgcaagctccacctcccgggttcacgccactctcctgtttcagcttcccgggtagctgggactacaggcacctgccaccacgcccggctaatttttgttgttgttgttgtatgtttagtagagacggggtttcaccgcgttagccaggatgatctcaatctcctgatctcatgatccgcccgcctgggcctcccaaaatgctaggattacaagcgtgagccaccacgcctggcctcattcttattctcaagatcctgcaggaaaatcaggtgtagtgaacctcccagtcaggttatcccgccacgtatgttaaagttgccagcgtaagttggaatcaagaggcctgcgtgaggcccttgagccagagggagctcattaaccagccagcaattctaatgttcacatctcacttagggtcttggagaagctgggaaatctccaggtctcgggagcacgtctcacaaatgtcaaggctgtaccaccttggttaagcgcttactggcagggccgctgaatgctgtttgtatttagaatggaaagaaatattactagaaaacttgctcttttgaaagaaacctttgtacctctttggagcccacattgccttcctctgacaatttttgtgaggtaaaccagaaagcagaaaacccagacacgagaaaaaaaaattggaactctgtctcctccctccaggcctaatcctacgtactaaactgcagccccgctgtagagcttcccagcgtctgctcaggagccccctgaactgtcttcacctgtacaattagtgggtgttatgggaacgtgcacctctggcttcccaccttcggtatctcccacttcctgtacttgttttacctaaacacgagaatagttgctcacagtttagtctttctcaattctaccctcacccaacgttcccccaaaacccacctctggggcggggatcgccttcctgatcatccagggagaagcatctaggctgttttgagtcactgctcctcactgaccgagtcattcccaagtggtgcctgcactgtggacaagagctccaaccctattgtacgtttctagaaatcagggattatgtggtcttattttctgctccattttttatgaaatattttaaatattttcttgaaagggggaaggaagacattactgtggtctttctaactcgttcttttcttttttttgagacggagtcttaccctatactgtactctacagaaaagtagaaaacatatttcagtgaacacctatattaccagtacaaatgccaattaatttcaatgccttggccatttttgtgtcctccatcagttctttttttgctgaaaatatgtaaacataaattatactctcattttctttcatccctgaatactaaaacatgcatctccaaagtgtatcttcccatacatccacaggaacatcattgtatctgacaaaaacgaccataatccccaaatatcattacattcccaggccatattcaaattcccttattcagtctcaaaatattttctgtagcttttgttttctttaagcctggatcaaattaaaaatcataattgtacttgattatgtcttttacatttctcttaatggtagaatggctcctcttttttctgtgatatatgctatttcacaatacacctggattaggccagttgtattgtaggccctcctgcattccgcacttgactgattgctttcttgtgaggtggtttcacaggtttatctataatgtctacttgtcccatgattggtgattcgaaggggagattaatgggcaaaagaggtgaccaccaaatttctctattataaacatgtttttcccattgagaatggcgtattttctgtgggataatatcccattaacttttctccaaatgaggttagcatccatcattgatccttacctgcaccaagttttacgacaggggctacaaagcggtgatgttctgaattaatcacctcttctacacttacgagttgacagtcttctgaaaggtggaactctccttcataaacaggctatttggtgtacctgaagtaccaacaaagcaggcagctgaatccttgtctgtttttaattattagttttcagattaagaagttgatatcatagttatgttcagctatggaaaataaatagttttgttttctttaatgttttgtgagtatcactattgacttgtgctttctaaaatgtattcactgtgtcttcatcaccgatagcattattcttttggtgtttggattgtcctaactttgaccatggagagcccctccagagggttattctgtccttgtgtcagttatctaatgccacagagtgctgtgtaataaacaactaacaaccttccagaacacatagaataagtcatttttcacaaacctggctgttggcaggtggtggttagggaactccacgtatctcatggctgatgtgctcacatggccagacacccagctggatgttggctgatctggagtggcctcttcttggatgactggagcaactcggtttgttcttcatgcctttgatccttctcctgggccaggacactagaccaggcatgtttgtctcatggcaatagcagaacccaagagaaagcaagtccactgtgtaagagctttttaagcaccagcccgcttctacttactgatattccattgcccaattctagtcctgtgtctgagcctagagtcatgagaaaaggcccggaaaaattagatggaaaagggtggggtgaagaattggagccatttacaatctaccatggtcttattgatgtgtccttatcagtcacttgtctcccccactggtctttgctttctggccagtaagatattttagatttataatatactttgtgtgcctcagacctggaaacatccattttttcaaggatccctggctcattttggggagaatggtactcagagacaaaaatctgggtgtctaggataatcatgcttctagcccgttttcatggacaaaactagcaagtgtgtagttttgaacaataaagaaacattggttcctattgatatttctgatgcaaattcaacatcacagagttttaaattttaactgaatttccttttgtttgttaaagacagggtctcactctgttacccaagctggagtgcggtggcacaatcatagctcattgcagcctcaaactcctgagctcaagaaatccttccacttcagcctcttgagtatctgggactacaggcaaataccaccatacccagctaacttttaaattattttttttgaagagacggagtctggctatgttgcccatctaatttttcaggctctcaaactcctgggctcaagctattctcctaccttggcctcccaaagtgctgggatgataggcatgaaccactgcacctggtctgaatgtccatgattaaaaatgtgggtctcttttctcttgtacagaaaatcttagctcctaataacattaacggaattgtttattttcttggaatgatgtctgagagcacaatgctgtgattaacacggaatgctaccacagctaatatgcagtaactgtcatatgattatcagtttcattaaagtcagagaacgtggctaacacatggtccataccaaatatctagcagagcatcccgtacattgtaaatattttttaatgcataaaatgtctattggttttgttgttttgttgtgtttttttttttgagttttgcttcttgtacctatcatttctctttttggaaacacctaccttttctaagcatattctcatgcaaatgagttactgatctactttaagcagaatgcacataatttcttttacatttcctcaccgtctctatgtgtagtatttccttgatatgctaaagggctgtgtgcagttctcataatcccaaagaaaaggatgtagttatcatgttgcgtactttttaaaaatatcatgagttttaacaaaacctaaaaaccagaagaggctttggcatttccatggcattcaaactcctactttttaatccattgattctgatgacgattactgaggctcctgctacaatataagcctgcattcttttttaaggtcttgtgacatttgggttatgctggaatttgtttttaactatttaaagatttcctattttgtcccacagtggttgtcttctttatctttaagataatatctttaacactgaagacattattggcaagaggaaggtctggaggtctgctcaccacctttggtgttctcttccatagccatggcctgagaagggtgatttttccaggtgaaagataggctgtggtgtaaactaagacattccaaatgaaacataatcacttaatataacctcgtagatagtgctgtccaaaagaactttctacagtattggaaatattctatacccacagcatccaacacagtacccaccagctatatgtggttactgagaacttgaaatgtgtctagtataaatgaggagctaaatttttaatgttatttaattttaattaattttaatattaatggaaacatgtggctagaggctacatattagcagtacagttctagattataaatatggtccaactaaaatatttgcatttgactcatgtttcctgaaagaaactggcagtaggaattaatgtcagctttctaatcatttttgattcttcttataacttgccatacacaccttattgcttaagagccaaaggaaaaatcactcttcatgagaggcagtgtatctacatctggactgaagaccttcatttggctgctgtgagttcataggctcccagctcctgactttgcagcgaaaaatttcagaattggagcttgtggcccagtgattattggagaaacatggtgaaaacacaatcactaatagcctgcaactgaaatatcagattaattctataaacacaaattactgcagaagcccaaaagggatgaaatgaaagacaggtgcaacagacctttatttacgttatagctgcatgatgtttttaaaacttcttgaactgtaaatgttaatagaaaatgttaaagtagaaagaatagtaaataaacctccaaatctgtttgttttttaagtatcattttaagttcaagaacttatgcatagtcgatgagcttcaatcttttgcagttattagttttatcaatgctccaattgttttattcttggccagtgggagcctctccaagatggcttctgagtcattttgacatggtcctaataaactttgacctttgggctcagatattgcctatcacagacatggaattagccatttacagagagaatctgggtttcatttagtgggaaatggtatttctagactgcagtgtggatactggagattacagattaatattttatgaccataatattgatgttgactgtcttaagatatgtgtatgttgtatgctatttgttatcagaacatacataaatacaagtaaattatagatagaaataaaataaataatagaacactgtttctattgctagttatttaaaactaaaagaagatgataggagaaaaattaaatttactacattcattgtgtatactctttgtttcagaaattaaaatctattactatgtagggattctttgtgatatttatacaatcagggattaatgtactcttcaaaaccaaacagcatatataaattacacttagtaatgagatttgttagctcaattgttaatgaatctacagtaccataagatgccataacattatttaaatttttaacatacgcatggtcttcaaaagcctttttaaaaatgcattattgtcaagcaaaagtaaacaacatataaaatcagctgatctatgatactatgagtaaataactggcattttatctaattgttgagagagttagaaaaaataatttgttattgttatatcagtttgaaaaaaaaaacaaaaaaggaatcatcttcctagtcctagctaccaatgcaatttttttccatttctgtaatattttcagcttgaagaatcgcataggtacacaggaaaatgagatgagtggcatattttaaatgcaaagcactagatatattgcacatgaaaagtaactagcaattggtggtgctgtaagctttccttttggaaattttctcctaggaatctgacattgtatgtttcttagaactcccattgagcatggcttttcaactttatctccctatccatatagcgttaaaatgcactctacactcccctatgtaacatcttattgctttgcaattataaggataaaataacgataattgaatctcataaagaggcacaaaaggtataatttgacaaaaaagaaacaccatgcctacgcctccgtccttactccacctctgtcatggcctcctcattctagagcagttactcttacactagtggttctcgtcattgttttgtatgtaaggtggatatttggtgacttagacttatgatagtattaattggctcaattcctcatacatatatttttcatctaactttgtaccagtcattatgctaggtattagagatagaaaatcaggaagctgtggcctcttctctggcgaatcatgtactctagtgcagaagacagagagttattacaaacaaataactctatcatgctgtgatgaatataaaataggatgaatgaagtatggactgaaagcagagagagattaattctgcctggaaaaggcatgaaaactgtacaagggagttggcctttatgcagatcccaggaagatcttacccggccatagtgggagaaggacattacaggtgcagggagcagtgtgagggagtgcagaggattgggagacatggtggtgctccagatgctttgttggggtgataggcattcaaatgggaagaggggccaaggccagaatcggaaggaccttaaatgtcaggctaagaaacttgactaaaatagtttctgccaaagggataaaaaggagttttaaaagagagatatggctttgtctgcatagagaatggaaataaggagagcgacccattaggaggctgctggagtagtctatggtgaaggtgatgacaatcagaaccaaggcagaaacattggaaatgaagaagacaggtgatttgagaaggcttcaagaggaagaatgggcaagtcaggaaataatccagagaggggatccccagtcactgccttcccacattgctgaatgacctgtgaatcatatctgtggcagggaatcaaggcaggtcagctaaagagcttaaacatcttcactaacaacactaacaacaaagctgctacccaagaaacaaacttggctgtgtaagcctagcaaagaaaattgcctgctagaacaaaggaaatcacatttatcgggagataatatcaaaacccagaatgtccagaaattaatatccataatgtctaggatataatccaaaattacttaagatacaaataaccaggaaagtggaacacatgctcaaaataaaagaaagctaatcatttgacctggaaatggaacagatttctggaactgacaaagattttttgaaagctattataactatcctcaacgaattaacataagcctgttttgcaatgaatgaaaatctcagcagagaaatagaaaatctcagcagaaaacataaaggaaccaaatggggacttataaatagaacaataaaaattctgaaattaaaaaattcactggatagacttgataatttaattaccatgacttaggaaagattaaatgatagatcaatatccaaggtgaggctgggagtggtggttcatgcctataatcccagcactttgggaggccaaggcaggtggatcacttgagatcaggagtttgagaccagcctggccaacatagtgaaaccctgtctctactacaaatatgaaaattagctgggcgtggtggcacatatctgtggtcccagctacatgggaggctaaggcaggagaatcgcttggacctgggaggcagaggctgcagtgagcagaaatcacaccactgcactcagccagggtgtcagagtgagactctgtctcaaaagaaaaaaaaaaagaaaaagaaaaaaaagaaggaaattattcaaaatgaacagggagaaaatttgtttttagtgcgtcagaggcctgtgaagagatatccatctgcccaatttatgtgtaattaaaattctaggagagaaaatggataaagaagtagaaaaacaatttgtcaaattaacagctaaaaatgtgatgaaagacataccttggcaaatacaagatgctcagtgaacatcaaacaaaataaacacaaaacagctcaatctaaagcacatcacatcattagaggaatgcaaatcaaaaccataatgagacaccatctcatgccagttatcccagaacttgaaaaaaaaagtcaagaaacaacagatgttggcaaggttgcagagaaaatgtagcacttttacaccttggtgggaatgtaaattagttcaaccattatggaagacagtgtggcgattcctcaagatctagaagcagaaataccatttaaccttgcagtccaattactgggtatacacatgaaggaatataaatatttctagtataaagatatgtacacatgtatgttcactgcagcactgttcgcaatagcaaagacatggaatcaaccctaatgtccatcaatgatagactggatcaagaaaatatggtacatatacactatggaatactatactatgcagccacaaaaaggaacaagatcatgttttcttcagggacatggatggagctgaaagccattatcctcagcaaactaacacaggaacagaaaaccaaacaccgcatgttctcacttataagtgggaagtgaacagtgagaacatatggacacattgcagggaacaacacacactggggcctattgaggggaggcgttgggggagggagaacatcaggaagaatagctaatggatgctgggctttatacctagatgatgggtcgatctctgcagcaaaccacctttatacctaggtgataggttgatctgtgcagcaaaccagatttacctatgtaacaaacctgcacatcctgcacatgtaccccagaatttaaaataaaagttgaaggaaaaaagagaccaaaagaataaaagcacataacagtcagcttcaaaagccaaaggcagcacgtaaatcttaaaggcaccaaaagaaaaataatacgctctgggaaataattcaattaatggttgacttctcattaaaaaccatggtgaccagaagagagtggaacagagtttcaaaatgctgaaaggcaaaaaacaaaacaaaaaaccctataaactggaaatctatattcacagaaaatattcttcaagaataaaggttaaatgacattttcagataaaacaaatataaaataatgtgttttgccagcagacccatacaaaaagaaatcctaagggaatttcatcacggaagaaaatgatatacaatggaaactcaaatcttgataaagaataaaacacatcagaaatggccaattgtggataaatgcaaaagacatttttttctttttgactttttaattttaatttctttataaaccatgttgtgtcataaactaaaactataacattgtcttctgtaatacgtaaattatgttgatgtaatacacataacaagtataattgcgtggaagtggacacggacctgaaagcttaacaggtttctatagttaataagaagtggtacattattaactgcttctggactttgaaaatttaatggtatatattataacttctaagacaaccacaaaaaaagctaatgcaaagaaatgcaactaaaataggaaaattaaaattctaaagatatttaaacaataaaatgaaagccaaataatgagagagaaacaagacagaggagacacttagaaaacaaacaaacaaatgataaacccaaacccagccatataaatggttttcttatatgtgcatatggtatatttaaaggttagactatattattatccataaaaatgacgtttcaaaagactgaaatatatacagagtattctttgatccagtggatttaaattttaaaaatctataacaataagatggtcagataaactttaaatatttggaaattaacagatttcaaaatacctactgggcatatgagacatttgagggaaaattggaaataatttgaactgaataataatgtaattgagcatatcaaaatttgtgagacgtcactaatgctatacacacaggaaaaattttagctttaatagtttaactagaaaggaaaaaaaatatcaaaccaaagacctaggctttcatcttaacaagctagaagaaaagaagtaaattaaaagtgaagcaaaaagaaggaaggaataacaaagaaaagaaaataactttctgaagtagaatacagaaataatacacatgataatgccaagagcttgttctttgaaaggtcaataaaattggtaaatatccagtttggtcaagaaaaaaagaagacacaaatgaccaattcaggaaataaagtagggagataaatgcagatgccacgatcctactaaagcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttaccaaaagatgtaaagaagaatattcatggtagaatggtttgtaataacaataaaactaggaatgactggtatccattgtaatatacactagaatcgtgtacatcagtgagaactaagagccaagacagcatggactattatattcacctcagaaatatgatataatataaattactgaggaacacagtaaatatcaccttattaaggtcaaatgcaaaaaaaaactaaacaacatagtatttaaagatacataaatatgtgataaaactgttaaaagtaccggaatgataaaattcaggaggaaaaaaaagtaatcatacgttctaattctgaaatggtctcattggtttccgtagaaacaagcaggttttatgtacctcaaatgtagtacggcataatcttttttatgtatttatttattttattaagttccgggatacatgtgcaggatgtgcaggtttgtagcataggtaaatgtgtaccatggtggtttgctgcacctatcaacccatcacctaggtattaagccctgcatgcattagctatttatcctgatgctctccctcctcctgacccctgcaacaggccccagtgtatgtcgttcccctctctgtgttttcattgttcagctccccactgcatactcttaaacaatcattatgtttcatggtgatcagtaatgtgggggcggggtagaagcagagaacttggaactcgtgagggggtgtcaaaggtagtaaatcttcatccattgaaggcaaacttgatatttagaaattcattcagagtaaaagctaatggacgaagggagataaggtgacaatcaaattaagtagtaaccttttttgcaacttatataactaacaaacttaagtgctttctaaaaaaaaattctaaaatttgctatataagggcaacttcactgaaatgattgcagagtcttccatgtgagttcttttaatgtgagatagctcattcaatagatgcaccttggtgtgtttgcttaagaaacagaaaaatatgactcatttgatttgttcatgaaagtattaccaggaaaataaatgaaaacaatttcacctaaacatctgttaactttagcactgaagctttggatgtaatttacataatgcataaagtagattgatctaggaccatgtcgatgatgaaattttcattatattgatagactttcattttcctcataaaatctacacatacttaaattataacaactctgcttttgaattaatccagtctgcataatgtttttcagtcatcaactattatagtgtgaaatgcctttaccatcaaactggctcaaggttactgccttcactcagaaagatagtgttttccttctccccactgtgggccctgcctctcaacctgcaaccctacatttcagaaagtagtttgcctgtatgaaattttcttactctcttctaaggtagtggctgcaaaatggtacctatctctgattttaatttgcatcatcagagtgttaatgactttaagagtctactcatgtgcttacttactatttttgttttataaaatttcttggtgtacgcatgttctcactcataggtgggaattgaacaatgagaacacttggacacaggaaggggaacatcacacaccagggcctgttgtacggtggggggcagggggagggatagcattaggagaaatacctaatgtaaatgatgagttaatgggtgcagcacaccaacatggcacatgtatacatatgtaacaaacctgcatgttgtgcacatgtaccctagaacttaaagtataatacaaaaaagaaaaaaaaaaggcataaaaattctagaagaaaacattggaaagtgtctttatcatcttggagggtcaaagatctttctaattatggttcaaaactaagatgtcgttaaagatggatacatttgatgaaataaacatttttttaaattaaaaaaaattattggtgtatttattttgcctatttttttctgttggagtgtttttatctcattgattttggggagttgttttttatacaaccctacctttcagaaatacaccctttcattcataggagatatatatgtacatgtccatatgcataccattttgagtaagcgtttttactaattttctaaggggatgcttgaaatcttggttgttcatctacaagaggccagactcagcatctatgagatgtatagattcaaaggtattcatggcagcgaagagctaattcctccaagcaagagcacctaggggagctcgtggagcagatgaaagcatgttttgcaggatgtggctatgggccacaagcattctgcatacagatttactccaaagttggatataggaaattagtccctttactaacagttgtctttggctccttggagtatctgctttcttaatctgctctttgtgtcctgcccaagaacattctagctgttccaaaggttttcggtgtgtgcgcctgtgctttctatgtcaatgtgtaaagtaggagagaagcatcatgtgaggctggattaagaagagctgggcatattgcaccatattgaaagggccgtttgatgagtgggagcctatctttttttcagaactagtgattttactttacataagcattcgtcaaaagttgaggagagttccttgatgtttcatgtggtttttttctacttcctctcttacagatacagaattcatctacagagaacagaaaggaacagtgagactgtggaatgttgaaacaaatacttctactgtcttaatagaaggcaaaaaaattgtaagtactctctttaatgaccgggataatttcagtttttcttcctgcaagtcaataaaacagaaaatgacttttggtttcaacttttagcatagccaaggagaagcaataaacttgtaatactacaggctgagcaaccaaagataatgtgaaattgaaaccacgctaattcaataagatgaaagcactgtttctttcattgtctgggaaatttctctgcaggtgttgggaacaagtgttgcatatcatatataattaaaagataaagtcctaaggcttttacacatttacagaacaattgcaataatgcatgtagaatacttcaggagaatttgctcaatcctgtttaaaaaaagctcgtctccgcatgcataggaagtattaacttaggcactgtgactgtacttaccctaattatattaagtggatgcttatgcctcaaagtaaatactgagtcaatatgaatgccactgctttatgatttgggaaaacttgttttcccaaatatatgtatattttttgagacaggatctcactctgttgcccaggctggagcgaagtggtgcaatcatggctcatttgcagccttgacctcccaagctcaggcaatcctcccacctcagcctcctgagtagctgggactacaggcgtgtgccgccgtgcccagctaattgtttttgtttttgtttgtagagatagggtctcactatgttgcccaggctggtcttgaactcctgtactcaagcaatcctcctgctttggcctcccaaagtgccgggattacaggcctgagccactgtactcgaccccaaagatttaaatggcattaagatttgatgttcatgtacggttaaagatatgtattagaaatattgactggagttatacaccaaaatcaatttaaagagaattaacattttgtttgtttacaaaatgttcagactcttattagaataaataaatctccaactcaaagcagttgattcttttcttgtttgagacactggggaaatcaaaggacagaactaaggttaaagctatgttaaaaagcaagaattgaaacaggctgtgaatcccgttaaagcgatcataacagggctctggtatgaatcagaaacacagaaatcctagaatcctataatccgggattagaggaggttgtaaaaaaaattaaccggttccctggttttacagataaggatcctgagcgagacttagagcatgagcttttgagtctcacagctcagtgatggctgagggagcattcaggtggtgtcccagaagcctgtgtcccagggagaaggaaggatggcttcatctttaccctaccccatccccagatccacagaaatgctgtgctgccttcttttccctcctaaagaacatgtaacttgctatttaaatactttcatttcttttcttttgcataaagatacctttttattaaaaggtttgctgagatttagtattaaatgcatgctgcccctaacatagactgcaggcgtaagggaggcctcacgctgttggatgatggcatagttccaaaaatgatcactttattgaattaaatagtattctgcaaagtaggacctaggacaaatgaatgtgcctgcatttttgcattaaaaaaatcatctttggtagaattactcccctaagagaatctgattcaactcacttagaaatactaacgttgtagaaatggttttctaatattaatagagaggataaaatgatcagactgttgctgagcgtcagtgcattttaatgtcggaatgttatcattatttcctgtgaggatgtcagtttagtaaaggctgggtgttgtacataacagcagcacttagcaatgaaatacatgaatgtgaaccgccttctctttctaaaatcaatagcttgtgacagatcatatattttaactgaagttattttagccaagtcgcctttaataaggtgacttcagaaaccaccatgggtaaagaaaagttctcatctcagaaattcgctggcttattctatataatgcaatcttttttccttaaaatgtcacttttccatccattttataaacatttattaagcaccaaatatgtacagcctaatggattcattattcctttctcaaagctacatttaaatgctcctgtcaacagactcaaaataaagaagacaaaaaatgtcatttagaggtctgcatcctaatttaatttaatctggatttaatttccgcagagccacttagtcatttaaaattatcatgcctcaattgctctatctccaaattaaagctgatttcttctgccagcccagaacctgggtactctgtgagatccagcaatggaatatgtgtatgctctgtgtgttttcatgagcaagtatggagaaggtgaagcctggtgttccacaggggctggaggttggaggatcacccacagcctggaggaattgggaatggggagcagtagctcttccatattctgttctcttgccttcctggtgactgatcaggtgttctcttctcatttgaattccagaagctgtgagcttgtataaatgataaaaagcaatctgaggccaactgtaatttttaagttgggctataaaacagccttaaacaagttgagaaatggaaaggaattggtaaattctgtggtcagcagaattttaaaatattccctacaaccttgacctctaataacctcattctctttcccgagccaataaaaacagaccctcctcatagctggtcactgcaaggtaccaaagcctgtttgcctccagcttcttctttgctcctgcgcttactgtgattggctcttacatgggacaggtggatggaagggcctgcaaatcactgcaaacattttgtcaatccagcaggaaagcttttaagatagctggtgattaagcaaattcagagcttgtgctaagttctgtatttacatggatgtatttcacctttccttcccccaaacaatttcttttgactaaatttactaattcagtcatcctttattgtgcttttaaatggtagaaatcatgaaatatttcacaataccacaaacactttagattgttgagttcagaccaggtgcggtggttcatgcctgtaattccagcactttgagaggccaaggcgggtggatcacttgaagtcaggagttcgagaccagcatggccaatgtggtgaaaccccatctctactaaaaattaaaaagttagccgagcatggtggagcatgcctgtaatcccacctacttgggaagccgaggcaagagaaacgcttgaacctgagagttggaggttgcagtgagtcgacatcgttccactacacgccagcctgggcaacagagtgagactccatctcaaaaaaaaaaaaaaaaaaaagagtttctgtatgtgtaaacatttaaaattctatgatgattatattatggttcacaatttggggggcattcttttgttttatatatatatataaaacaaatatatatacacacaaatatatgtattttatatatatattttatatatatatatatagtgggctatttcctgatccttattatttgatagcatatcatatttgatggtagctaagaactgctttttagaaaacatttatcaaaatgtcttgatccatttcctcttttgagaatttttgaagtgcttgtctacatttctacagaaaatgaatcaaataaaagcacagttgtccccaaagcacaagtgcatcatctctgaagtagctctcctcagctgtaaaggctgctgcccagttctaagctcactggagcaggttctgtttgggatttaattttgtctcccacatagtgctcagcaccatgacctgcacatagtagatgctccactgctatgtgttttatgaatgaccgctctagaataacaaaacaatagagttgagcagttttccagaaacatccatgtgagtgacaggtgtggaggggcattcagcactggggtcatgactttgagcttcaggtctaccttccagccttggcattgtgctctgctcaggaacaacaggaccccagccggttgtgcaagttctgaatgtccagtcttatccctcaggagtgtcgtaggactgaattacagttgtaacagctggaatgtgggtatatgccacatgtggattccagagcgttaggctagaccaaagagcctgggccaggctcagggctcaggcaggaggagtgggttggttctatgaaggaagagacagaggatgatgatgtccaaaggagcatgacaaggatgctgccgcatgtgggcggctgcgtgggtccaggcagcagtagcagacagtggaatccacgccactttagttttgaggtccatccctcatgaagctggatgtagcctgcatcccagagtgaggcagaggcatccagagctggtaattacagcaagaggcactcgcagaactctaaacatcaataaaaaatcaaacctaagctcacttttatttgaattacatgtttgatgtcacagaaattccgggaccttacactttactcttttaaacacaattttaaatgtcaatgttattttacgtttcatgctccttataagactcttgtcaacaagatagcacatcttatcaaatggcctttgttctattatgtatcttgtttttttttcctaaaaaatgaaccaccacaaatatatctcatggtccaaaattggatctttggacatttggccaatggttgcctggttcctaaagtcctcatgaatttttatcttctgagtagaacactcctttttcctttccctccctccctccttttcttcatccttcactcctccctccctccctcccttccttccttccttccttccttccatccttccttccttccttccttccttccttgtagaaatacacttaaaatagccttaatacattttgctgaactaaatagatttcttggggacttaattcttacaaaaatttaacaccatctctccaattcttttaaaacataatagagcaaaaattatcagaagggtgaagtgtttcaccagtgcttaatatttagatatttaaagctgaaatagtctttagagactgtgtctttcaaactcttcttttatgaggtgaggaaactaagaatttctaagaacagttctctggcttaacctccactgatagtgctatggatgtaacgcaccagttcagaatgagtcactgtattgacctgtgtcactcatactgtataggccctttttattgacaatgctatcagtgacaagaagcattaagatttatatagtcattcattgtatcacttaaattctgccaggtgtttggaaagcaacttagtgatacgtttcaggagcagtaacaatattgatgcatttttatttgctctggggaatgcttctgtacaaagttgcagcattatttgttaatacaatagtgaaaatacttgaaactaggaaaatgagataactttttaaaaaaagataaaatatgatgtattcattaaaataatagctatgaagggtatgtagcgatacaaaaaatatttatgatatattttaaaaagatacaatatactaggctaacaactatatatattgaaaggctagaaagtgaacactgaactatgaaaatacttaatcttgttgggtggtgagattttgtgtattattttctagtgtggtgatttccataactgccatttcaatgccatttattcaataattttaatcgggatttaaaaattttggtttcatctttcaaaaaacagcagactgccttctcacaatgagtatgtaagagctgtagacagttcccggaaattcttgaaggagaaaataagtcgattatttaaaaaaaaaaaaaaaagtattctattgttatgcttatgtcaggctttctccatttttatgtcttgttttaattactaatttctttgttttaattgcttattttaatgactaaattaacatctaaatgaaatgtattttctctaagctgtatccttcttggttttatataatcatagatgtagaatttgaatttttatctctgtctctaaaaattaattaattctgactcctcacagaaagagacataaataggcaagtattattagacccattccaaaataagaagaacaaataataggcctgtttgtactaccagaggaactccagaatgtggctgagattagaactcgagactactttctttttacttcttcaaataaactccactggatacttgacccctgcatcagtaattctcactttattctatgtcatttaatttctgttaagtgctttatgcgctagtcctctcagccctgaaacagggtaaatttggaaggaaacagaagcccactttcttacctctttctcttttctgttctgcacagagcccagtgcactgttgaatgggaagcacaggatgttctgacaggtgtcatctcagccaggaacaggctggcccccgggaagtgggctcagcctcggtttcagctcctgttgtcctgagttcactgaccactgataaccaggacggtggctgcaacttcagtgggccagcaatggcccatgagccatctctaatctgaggctggatttcacttagcatgtcagtgaaaaccatgaggggaaacagccgtgtttttgtgtacggttgagagggcataaactggcagctcgtgatgcccactgaaatgttttgtttggcccacagagtggtttttacaaactaacccagatttctggcgtctcttgaaaaatacaaagatctggcagcagcaagatcctcatttgctcacagagagcaaaatttggctggagctaagaggcagctggcccctcagacaggacatgggccgaccagccctgcagtgacccacatttgctgacttctaaccagactggtctctgagtttgaaaccccttttagttcaggaacaaaagggtggcataagaactcaatgtcttctgcaagaacgttgcacattgtgagaaatcgtagcacaaactgtcttggtattatctgtattcatttctgtctgtaaaattccctggatcctctttgtccccctatgtcattatttcatttttctcctgtgtctcagagggtctctctctctctttttttttcttttgtctttcttgtcctacttttctctctcctgccttttctgtttctacttctcttactacaagatagaacagaaaacaagtatattttacttacttttattctaacttttaccacatagaccatgattttactttttaaagtggatgaggctgagcacagtggctcacgcgtgtaatcccagcactttgggaggccgaggcgggcagatcacttgaggtcaggagttcaagaccagcctggccaacatggtgaaaccccatctctactaaaaataaaaaaattagtgtggcgtggtggcaggcgcctgtaatcccagctactcaggaggctgaggcaggagaattgcgtgaaccggggaggtggaggctgcagtgagcagagaacacgccactgtactccagcctgggcaacagagagaaactccatctcaaagtaaaataaaaataataaataagtacagtagatgagtatttatacttatgtctttaaaatatctgaaaagaggccgggcgcagtggctcacgcctgtaatcccagcactttgggaggctgaggtgggcggatcacaaggtttaggagcttgaaaccagcctggccaatatggtgacaccccatctctatgcctgtagtcccagctactcgggaggctgaggcagacgaatcgcttgaacccaggaggcagagggtacagtgagccgagatggtgccattgcactccagcctgggtgacagcgagactccatctcaaaaaaaaaaaaaaaaaaattctgaaaagcagtacagtagtggtttaatctttctggccccagagctactgttccctgcaggctaagggctgtgtaccatcactcctccatcacacgtatactcttcaagtgacagtcagggaaggccttctctgtgcaaggccctgactagacatggtggtgggtggatacagtgattaataaaaacagatttctactcttatgtagctttcagcctgcatataaaagaagtagttgttttaacataatatattttgcaacggaggtattaatccaatgtgcaatgagaacaaggtgagaaagaaagaggattgctgggaactctagatagaggcttgcagaaggaacatttcagcagtccttgaacatgggagaaaagtcggaaatggcataataggcaaaatgaaaagggtggataattccacatttcaggggtagacagtgcggttagtaggttgttttgggaggggcttgaaaagttgtggctggaaggtctggggaaaaggtggagagaggtcttcaggaagcttccattgtgtgtagtctttagtctgtagcacatggaaaggtgtcaaccaaaattaaagctactgaagcagaaatgatgtaataaaggtttattggaagccacaggtgagaatcgatctgggaaaacacaccaacaaagttggacatgttccagaatctgttacaagccagaaggctttcataagaaagtttaggagaagtgaaggggactcctcatatcagagttgtcctttatcattaagaggtacaataaaaaggttccaatcactgacaacagattgcaacacacaggctaaaatgcctacgtgcaagacaatcagtaaaacttcatgattcagaggcaaatcagcatccttttcaatgtcagtagatcacacagtaatcagtacgtcaacaatttgaagagctcacagtaagattgtttacttagcgacaagatgacacacaagacttcttccccaggtgacttaatttggaagtttgccaaatgtgacctgtagggtattatttccctcttttgattaaaaaaacaacaacaactaaccatggaagcattgatgatcagtctctgcttacgttagaagggtagacatccttctttccttccttggctctgcgaaggctcattcccaagaagtcatgtccctgagtggggagaacaaaccttatcatcgcatgtgggccaggttgctagcaacatggggtagatcatgacacgaggttacatgccaatctcctgaataatgaatcaacctccagtctctggacgatcattattttggccttaactgtggaggcatagtttacaaattctggagaattcaggtacagagaaaggtaaatgttttaattttattcacaaaagtatactttacctgattgttttaaaatacaaatagctcctttatttataatttttagaaatatgttttgctatagtattgttattttatttggaaataaagaatgagtattatttaaattgaacataactttaagattgaaaattatgtaacaattatttataaaagtttatcccatttatatttacctaatttatttatttttaacagtttacctggattgctcatgaaaactgagatattggacaaagttagtcattatttcaagttacttccttgttaaccatttttatggcctgtgaatatcagatgttcacttaaggaaggagtttaggttaaatatatgggtattttgctaataactcagaagatacagctttttttcatttaaccaacaagattaaattagtcttacccttcaaaaaattacacaaaaatcattctggttttggctgggcttgtagttctataacctttgtgccaaaccctgacatttaaaaatatctagcagagacaaatataaaattgtcttccaagtataatgaggcaaaagggtatgctgacaatcttgaagacatttctacttttattttatcaataatttaaaaaccagcttgtttattaagggtttacttaagtcatgtgaacttgggaaatatttgtgtttactaatttatgaatgctcatttatttatgttgatttggtaccaggtagacataacatataatacatctaagtaagtgtaaacacatctaaacatacacaaacacaaataaagattgtacagctttcattttagaattttagttctttttttttttttttttttgagacgaagttttgctcttgttgcccaagctggagtgcaatggcgcgatctcggctcactgcaacctccgtctcccaggttcaagcgattcactggcctcagcctcctaaatagctgggattacaggcgagtgccaccatgcccggctaattttttgtatttttagtagagacagggtttcaccatacaaactcaccaatttataaaagacagctggatccaagttatatttctgacaaaattgggacctattcatatggctaaactttttttgcccctatgggtaatctaatgaaagctacagaccaaaagtttgggtaaagcagtttccatgtaagtttgatttttacaaacttcttttaccattttttataagtttcaaatgagttcaattttcaatgtttacattttacctgaaaactgaccaaattgcataacaaagacaaaatctccaagtagtcttgaaatagtaacaaatctatcttttgtttgctgatcttgtttgattagcaaatgcaggtggggaaaaatttttagcagtttctctcttttttgggggaggtggcactttttcctttcagcctttgtagcagaaaaagcaaaatttttgtgctagacacagatagatgattgctctgagctcaagattctgacttattagacctgagggcctaacttttctaaacatttatctttttcttttagattattaattgttcaattaagcatttcattttaatacgagtggctgaatctattttaccaatgccagtggaagatcgggatcataaatggtctggcaaagcttacaataaatcaattggtatcattcattagtttcagtttagaaaaaaacttgttggatctgtatttttatcatctcagtaatttcattctcatgctgtagtcctttcatttgctccttttgttccaaattcatacatttccctcttttgagagagaaggaaatgtgtgcattgtgaaattccaaaaatctctgcctaagaaatgtatgggagctgagggaacaagcagagaaggatgaggaatgaggagcagttggaggtgaaagggacaaagtctctgaagtctttttcacggcagagatagttgcgaatatccttttgtttacctcttgaatggaggcaattttttctttcaaaattttttatggaagcttctaggtgctattggaagtaagtcttccattcaatttgtctaattctaaatccagctttttccaattgtgtgcccaagtaaatcattttaggcatttcaaagggtccccattttgggtgttgctgcttatgaccatgccaagttaggtggatccacttatctaagcacttgcaggtaaaaggaccaaaagtattgtgcataaaaccagctggtgttgattagaggcagtgcactgtcagtctcagaagacctgctttccatcgtgattgttttgagtgagaccagctatgtagtggagcaaaagtgcccctcatgccatcactaaggaaaagtgctttcgccccaaacctccagggaaaaattcacagagctactttaccttgccctaaaattcaaacaaaaacccttaccttggattggtaagagggatactcgttctgagaaagacattgtattttctagccaaggagaaagccagcttcaaaaaaatcacaactttgaccaagacgggaagtttgttgatttcaggaagaactcatctgtaccacccagcaggggcgtccaagctcacaatgggtttgttgccaggatctgcatgaaggctggaagctgtgctggatggtccatggaggtcactccaaagcctactggctacaccataatgttgacagaaattaaggctgaaataacgtgataaaaggtgtattggaagccaaatgtgaggatcagcccaggaagacacatcaacaaagtcaggagtgttctagagtctttaacaagttggaaggcttttataagaaagcttaagagaagggaggggactcctcatatctgagttgtccttttcattggagggtatgatacagggcttataatcattggctacggattgcaacatacaggctgaaatgtctgtatgcaagaaaattagtaaaacttcttgattcagaaacagatcagcattttttcaatgtcagtaagtcatacaaataatcagccacatcaacaatttgaggaactcaaggtaagatactttactcagggacaagatgtcaccatgcatcacaagaccttcccccaggtgggttagaatttttgagctggttagaatttaaagccaccgtgctttaggaaaataactgtaaccaataagaaaggggtttgtagaaggtaaagattataaacaaaacatcgacagtggctgcttcaagtccaggtgaatgtgatggaggtcttaaattaaggcagtggctttgaagacacaggagaagttggtttaagttacatcacaggagtagaattgataacacttggcttcactttgtgtacaggcagatgggattaaacaatagtctatgttgtctggggtttttcgagacttgctcatgggtggagagatgtcaaattcagaaactgaaatggggagagaaacagattgtgaagtagaaaaccaaagccactttgaggaataagctactgcaaggtatatgcagagttcattaactaatagttgatattttgagtgcttacggtgtgactaaagaatcctaaacactctacgttcattatcttacttaaccaaaatccttaggaactctgtgagcttcagtactttattattattttaaaactcagaaaaaagaggttaaaaaaccttttactaagtcacacagctgatagctgatagtcctgagagctgaagtcagctttgtctagttccaaactaaattatttctagactgcatacataatccagctgtagccttggtcgctgcagttataagatagggctgaggccgccattccattactgagaaggaagccaccgcttcaaacactgtgttcatatctgtgagtccatcattacatatcacgtggttactcctggaggccactacatttgccctaaaatgaagactagagatgcaaaacattgagtcagtttagcctaatgccaaaaaaaaaaaaaaaaaaaaaagtgctgacacagctgagtcctggggaacgatctgtttcaaggttagagagaaccgagctgtaaaccatctggacgctttttcgatgtggctatttaatcatctttccactctgctctatagcatctatgttttcaggttttctctgactcagtaaatgcagtgctgggagcagcacccgagtctgtctgattcaaaattaaattattcttaggtgaattcagggcccagaggcaggctgtggccactatcattaacattatcgccaggcccaagggttctgtctttctcattgaccaggaagggagaatacaatcatctatttatgttaaatttgatgtgtgcacccacagagttgcacatagcatcctcctgtaacaatcttttcagtatttgtcttttgttgatcattactcatcttgtatatttagggttttttttcattatgagtttcatgaggaggttgtattcaaaaaagcctctgggtatatttatgctttctaccattcatttcccttccattacttgacaaattgggggcattctatcattttatatctcttttttccctaacaaccaccttttcttctctgcatttattatcacatatgtatttatctactacaggaaaaacaaaccaatcctttagttagatatgtatctcctcagaaacatgcctagaattttatataaatgggatcatcatacatgtagaccaatatttttaaagtcagcataatgttatttaaacttgtgttattgatataactggtagccccagataatgcaaaaggtgaaatactgtatatacccatctctctagtaagtataaaagttatgagcaaaatattaacaagtggagttcagctgtgtaccaaaatcataatatgctaaagtcaggtttaatgattacaacagcatttaaatatcaggaaatcaatcaacaaaatttattagaactacaaaatgatagaaaaatccttatgattaagtcactaggtgctgaaaaagggatctgataaagtttatcaacagctcctaataaaaatccttgctaatgtaagaataaataattgcttaaatatgctaaaggttgtttaccaagaaccaaccatcagtgaaaaccattctaaatgacaaacaataaaaccatttcaattatagccaggtatcaggcaagaatactcaccatcaccattaatatttaatatgttcttgaagaaagtgcaaccaaaccaaatgattcaaataagaactagaaaatagaagaaaaaaagacaacttttttctcataatagaattttatttctgaaaaacctaacatatattagttttaatatacaccatggaatactatgcagccataaaaaatgatgagttcatgtcctttgtagggacatggatgaagctggaaaccatcattcccagcaaactattgcaaggacaaaaaaccaaacaccacatgttctcactcataggtgggaattgaacaatgagaacacttggacacaggaaggggaacatcacacaccggcgactgttgtggggtgggggaaggggggacggatagcattaggagatatacctaatgctaaatgacgagttaatgggtgcagcacaccaacatggcacatgtatacatatgtaacaaacctgcatgttgcgcacatgtaccctaaaacttaaagtataataataataaaataaaatttaaaaaaatccaaatgtcaaaaaaaactaataagaacatatcttaatatggctaaatacaagaaatatattatgaaatcaatagcttttctcttcaccaatataaataccttgaagtgaaaatggagaaaatattccattcacaataagaacaaaaatataaaaagacttcaaataaatctgacatgaactccagaagattgaacaaagcaaactataagatcttgttagaaatttgaaaacattaaaaaaattgtataatattaaataagaaaacaatatttaaaatgttaattatttgaaagttgatatcaaactttaacacaatcctaattagaactctgaaactgctttagtgtaaacattttgcaaaatgatcttgattgtcatatataagaataaacacctttgtgtagccatgaagcatttcaaaatgcatagtaatgtatactcttttacctgcagtgaaaacacacaagaacgacgttatattcaactcaatgacaataatagctaacgctttgaatacttattatgtaccaggtattgtaattactttattaaatttgtgtatcaattatgaggtaggtacaaatattatctacactttacagaggcataaaaaattgagaaattttcagcatctctcatagtgaatggtataaacaggatatgaatcacagtctgtctgaatccacagtccaagcttaaaactatcaaattttgcatagaagtagcaaagagagtgctgaaaaactggagaatttgaaagaagcttccaatataaacaagtatttgacatgagaaacactagggatagggtgacacacttagaacacagtgctggcataactaactcttcatctacaaagatgtaatgtaagtctcattgtacaaatacacaaaattacgttccaattggattaaagccttaaatgtttttaaaagtctataatttggtttcataaaaagagagaaatttttaatcaaaataggaaatcctgaagctataaaagatagccatatttaatttgccatatatgattttaaattttaattttaagaaaggcaaaattagtagacaaacaatggaaaatatttacaatccaggtaacaagtaaaaggagtatatctacaactgataaggaattcttccaaattgagcacaaaaagacaaataaataatagaaaatgaacaaaaatattttagaattagctcaatcaagcctgaaaccaaggcctgctttgtttgggaaattgatacatagagcaaacgttcaggaatgtgttagatgtttttttgcattcactattggcacttggtgagaaggtagacctgcagctcaaaatttgtacaactgctacaggatcccttgaatttgtaacagggccactcgttctgagaaagacattgtattttctagccaaggagaaagccagcttcaaaaaatcacaacttcgaccaagacgggaagtttgttgatttcagggagaactcatctgtagcacccatcgggggcatccaagcttatccaccagataagtggagccacctaacctggcatggtcacaagcagccaagtccaaaatggagactggggtggtcagaaatgcctggaatcacacctaaccatggcagtggtgagtttctcaaagagaaaacaaattctcactgtctccggcagcatcgttagcaattgaccctccatcaaggaatgtgacccggactaatttctaagtgtaaaagttgcattctttgctggtttcttttggtgttattgcgtatcagccccactgttgccactcttgtaacagctgaggatgtaatcattcatttcttcagcaaacatctagggagcatctctattataacccagtcaccgttaggcactgggaatagaaccgtggcaaaacaaactaaaatttgcttcttggcatctggtcctggccatgagactataagaggattggaattaccctcctaacataaacaactataaaatgggataaaatgtggagagaaaaatcagttttcatgtattggacagcaggcagtgcacagctgtgatccccgagaaaagaaaaacaaatgaatgaaccatgccatcccgtgggctttctgcgtgaatgctgtactgcagcacgaaggggaaaaattcaagacctgcagtcttgccaagttaagaagacagaagtcagagttcaagaaaagaagatggctacagtttatgagatggagtacccaaaaggaggaaactagagaatactcacaaaatctatttaagtaattccttttaatggcaaaaccacaattactttattattattattatactttaagttctggggtacatgtgcagaatgtgtaggtttgttacgtaggtatacacgtgccacagtggtttgctgcacccatcaacccatcacctacattagggatttctcctaatgctatccctccctttacccctccacccccccacaggccccagtatatgatgttcccctccctgtgtccatgtgttctcaatgttgaactcccacttatgagtaagaacatgtggtgtttgaaaaaccgcagttacttttgcaccagcctaatacatagatttccctttgagacctcggttaattattgacctttatatgtgaataatgaaacaccaaaaggcagaacaaaataaaactccaaggaaataacaattacagaactctgttagatgaagtattcccagagctcatatattgtcaggaattatttaagtttattctaaccatgagacattaaacagagaccccaggaaagtagtttcttaggatgaggttcaattagcactcaaatatagtcatgtgtcacataatggcatcttagtcaacaatggatgtaggacattggtcccctaagattataatatcatatttttattgtatcttttttatgtttagatatttttagatatacaaaaattaccgctgtgttacaactctctacagttttcagtagagtaacatgctgtacaggcttggagccttggagcaataggctatgccatatggcctaggtgtggagtaggctgtaccatctaggttcgtgtaggtactttctgtgatgtttgcacaatggcagaatcgcccaatggtacatttctcagaacatatcagatatattgttaagtgatgcatgactaatggccactatggaataacccttaaaacatcttttttaaaaaccttgaataagtcaggttaatccacaaataattaattgcctgtcataaaaagtccaatattctttgaaggaaaacaaaaagtcctaaattcaacaagagagaattaaaaatatctggtgttaatttaaaaataaaacatgatatatgcaaaggagcagggaaatgtgactcctaatgaggagaaatatcagttgatagaaacagaactcctgataacaaagataagggaattagcagaaaaacacatgaaaactgctaagataaatgtattccaaatgctcaaggctataaggaaaaccatgaacatgatgataagagaaattaaagattataagacacccagataaaatttccagagattaaaaaaaaaaaaaattctctagatgatcaccaggttagataccacagaagaaaaaaaaaaaacccctaaattgtaagcagtagcaatagaaaactatttaaaaccaagaacaaagagaaacttgaaaaaaaaaaaagcctgaacagcatgtcaataagctgttggacagtataaagtagactaatatacctgtcattaaagttccagaaagtgaagagagaaaagaagataaaacaaacttttgaagaaataatgactgaatttcttccaaatttggtaaagaactcaataaactccataaagaaaataataacaaagaatatgataatcaagttacttaagatgagtgacaaatagaacatcttaatggcagccaaaggagcgagacgtgtttggaagaacaaacctaagaaaacagctgactcttcaacagaggtgctgcgagccagaggacattggaatgagatcatttaaagtgctgggaggcataaaacactgtcagtctacagttctacacaccacagaaatatctctcaaaaataaacattaagaatttgtataggcccagctactcaagaggctgaggcagaaggatcccttgagcctaggagtttatggctgcagtcagctatgatcacaccactgcaccccagcctgggcaacagaatgagacctttttctcttaaaaaaaataatatatatagatatatatataaagatatagatatatataagatatatataaagatatagacatatataaacatatatatataaagatatatattttcagagaaaatcagacagtatttattggccataaacctatactatgagaaacttaagggaagttctttggagtaagaaaaattacaccagatgaaaagttacatctacatgacagaaggaggtgtgccaggaatgataaatgttgtcaacatatggccaggttttgggtggaaatttttgtagaattagttaactagttctttaaaatatccttccttttctcaaagggtcctttaaatataataaaatatgtccagctcctctgaatgtaatctcatgtaagacttctgtctgaacctttgtcctgctctaaacactgacatggaaagtgaaaatataaacacataaaacctttggaacatgttagaactttcttggacaatagtggcaataataaatctgatctaatatagggtggactataactgacagtttaaaggacagatttcctatatcattatgcctacaagctccccttaatactcctggaggattttatattttgtttaaaaggaaagatccaattataagctatctatgttatctaattttaatataaagacatagattaaaattaagtgaattttaaagctgggcatggtggctcatgcctgtaatcccatcactttggaaggctgagactggcagattacctgaggtcagagttcgagaccaacctggccaacattgtgaaaccacatctctgctaaaaatataaaagttaaccaggtatgatggtgggcgcctgttatcccagcagctcgggaggctgaggcaggacaatcgcttgaacccaggatgcagaggttgccgtgaactgagatcatgccactgcactccagcctgggtgacagagtgagactccgtcttaaaaaaaaaaaaaaaaaatgaaatggattttaagagatataccatccaaaccctagtcaatgaaaatcttgaatggctatattaatattagataaaatagacaacaaggaatattaccagaaataagaagaaatatttcataatgataaaggagtaagtttattaagaagacttaagaatcctaaagatgtatgcagctagcattgagctacaatatttgaagcaataattggttgaaccaaaagaagaaatagacaaatccataatttaagttgtagatcccaacaatcctctctgagtaattgatagactatgtaaaaacatttaataaggatacggaagtcttgaaaacactattaaccaagtcaaccgaattgacatgtgtgcatcacatcactcatcaatagaaaaatgcacattcctctgagtgcacgtgaaacattcaccagagtagactatatgctgggccattaaacaagtctcaatatattgcaaaggatggaaattatacaaagtatgttctttaacagaaacaaactagaaatcaataccagaaaaaatatctggaatgtatcttgataattggaaattgaacaacatatttctaaataacaaatcagccaaagaagaaactgaatgtattttaagtgaatgaaaataaaagcaataatatcaaaatttacggtatgcaacaaagcaatacttaaaggggaatttatatctttaactgttcatattagatctcagctttcacttcaataaactaggaaaaaagatttaaaaccccaagtacacagaagaatagttaggagcagaaatcaactacacagaaaacagaaaaatgttagaaaaaatgaccagctgttttttggaaaagatcaataaaatcaatcaagagcaaagataatggaaaaaaaatcagacaccaagcaaacatattaataatttggacaatataaatgaaacagaaaagtccttgaaagacacaaagtattacagttcaccagttaagaaataagtaacctgaatacctggatattggtgtaataaattgaattcgtagtttaaaagccccacatattaaaactcaaggcccaaattgattcacttgatcaattctaccaaacatttatgtaagaaatagtaccaattctgcacaaacttattagacaaatagaagaggaggaagatatatttccaaaattcatttcttagggcagtattaccctgaaataaaaaccaaacaaagaagttaaaagaaaataaaaccacagatgacattccctcatgaacacagatgcaaaaatcctcaacaaaatattagcaaattgagtccaacaatatataaaaaggggtaatacatcacggtcgaatagcttatcccagcatgcaaggttggtttaacattagaaatcaaacaatgtaatttaccatattgacagattaagactaaaaaagcaaaataacataatcatctcaataaatgcagaaaaagcatttgagaaaattaaacatacattcattataaaaactctgagcaaactagaaatagacaggaatatcttcaacctgataaaagatatctattaaaaataccataaatatcatacttaatggagaagaatgaaggctttctcctcaagattagggaaaaaagcaaggctgttcactctcactacttctactcagcattatactagcagttctctagagtgcaataaggcaaccaaaagcaataaaaagtgtctagatagaaaagaaaggaaatacctatatacacaggaaatatgattttgtagaaaattctaagaaatatacagaaaatatctaccagaacaaataattacatgtatcaatgctacagaaaataaggtcaggatacccaaatgaattttgcatattagcaataatcaattaaatatttaaattaaaatatacatgtacttttatatgtacaaagcatcaattatagtacatccttgggaataaatttacaaaatatgggcaaaatctgtattctgaaaactgcaaaacattgctgagagaaattaaagattaaaaccatcttcctttcaaggtgtttacactctaatgaagaaagcaggcaatatttaagataaataggttaaaaaatataaaatatgtattaatatgattagacctagagaaacaaatcagagaaaggggtataaaaagtcggaggcaaggcagttaatatctagatatattagctattgaaggacatggaaggcctcacttagaaggtgacttgagataaaagccaaagaaatgaaaggttgagagcatttcaggcagaagaaagaggagttgcaaaggccttgagaatggcatgtgcctggcttgctttaggatggacagagactggcgtggctgcagtgaagcagatgggactgaggggagaatactgggagatggatgcagagagctaagagggaactaggtccagcagggctgcctggtcagtcaggactttggcttttcccacaggtgagatgggaagctgtgggagggtttcccaggggagcgatgtgatttacatatttgagagatggccctggccgcctgggaaagcaggtagaaggccactgcagtacctcaggaaagaatgcacataccttagacaagggtaatggtggtgggaaagagaagaaatggttccaaacctattttgaaggtaaaccaatggtattttctgaccacctagatgtagggtgtgtaaaacagagggaaagagaaaagatagccaagagtttgacctaacaaccaagctaatggggttgccactatctgagaagaggaaaaaggttacaggagctggaggtgtgggagtggagtagaagggtctcagcttattcccattgacttgaggtatccatttgacactcaagtacagatgtcagggaggcagttggccagacaagcctgaagttcaaggtcaggtccagtgcgggttcaggtggtctgggctggagacatgaatgttggaatcctcagccagactgcgcatggtttttagaaccatgagactggataacaccacctaggaagtgaggagatccaaatatcaatccttgagcactccaacattcagagctcaagaaaacaaggagaagcacaaaatagcatgaaaagaaccagcgagggaggtaggagaaaagcaggtgatgagtgtccgggaagccaggtacagtcagggcttcgaggagtagagagactggtcatctgtgtcaagtaagaggacagctgagaaattatgacatttagcaaagtgagtctctgataaccttgagaagagtaattgtggttgagtggtgggggtgagagcatgacaggcaggagtttaagaatgaataggaggagaaaaatggaagcatggagaatattttcaaggggaagtagacagacagttttctaaagataaaatcaacattgtctaaaacgtggatagtaaggatcaaatgtatccataagcagggaaacaaaaactaatgaggcatgtttacatctacaggagggtcaaaattggagaaaaaacaccttatgcttccagagaagggaagaaaacatgcattcatacatctgtagtgggagtgcacattccaaaaacatttttgaaaaagaatttggcaatacctatttaattttaaaatttgtaaactgttcacttcacccgtggatatctattctatacaaaaatgtgaaaaccacacatatatcaacaaagacatagattgggatcttcattacaacattgtttatagaaagagctcactagaaatgcttataatctatcctcattattcacagcttctatatttccaaattcaaccatgtgataaagtgtacctgtgagccccaaggtgataatcacagcacttttgccatcgttctcaggcatagtggcagaagattcgagttgtccaatgttggcattcccaactgcagcagaacaaagcactattctgctttctcatttcaactttcatgctgtgaacaactgtccttttctgttgttctatttggtgctccatttttttgcatgtttgtaacttacactggtgatctcactgttgaaagtgggtcccaggcatagtgctgaagtactgtatagtatcactaagggcaagaaggctgtgaacgccttatggagaaaatgcatctttgagataagctttgcttaggcacaactcatgggttgttggccatgagtccaatgtttatgaatcaacaatatatattcaataaggtgtccttaaaaagaaagacacataaaacaaggttatctattgatcatttgactaaaatgtttagactagaggttcaaaggaagctaacgttgagtctctcctagaagcaatggttcagtatccactagttgcacatgaactagtgttcatgatgactttatagaacaaagcaaccataaataacaggaatgaattgtctccctttgttgagaattgtgtgagtaaattaaagtatatcccaaggtgtgcaccatgtgatattacgagccctttaaagatcactactcaatcaaaggaacccaagtccttggagtcatttccttaaggtactgttgcatgagaaaactaaggtgcagaggaccataatatgatgtcactttttttttcttttggagatggagtgtcgctcttgtcgcccaggctggagtgcaatggcgcgatctcggtccgccacaacctctgccgtccaggttcaagtgattctcctgcctcagcctcctaagtagctgggattacaggcatgcaccaccatacccagctaattttgtaattttagtggagacggagtttctccatattggtcaggctggtctcgaactcctgacctcaggtgatccacccgcctcggcctcccaaagtgctgggattacaggcgtgagccactgcgcccagccaatgtgatgtcatttctaacctttgtcatctctctctgatttcatgtggttgcctgagcatgcatagagtgatgtccaccaagtcagcaatgtgggctctgggggtgggtgtgggtatctgtggagcaatgtgcttgcagtgcagagggcaggggcaattaaaagaaaacagcacagttgatggtatcatttatgtcggatgatgtttgtactatgaagaaatttgaaggaaaaagtcacagttagtcttctatgtactgacttgtagggatgaccatgttggaaaaagagcaagttgcaaaataatgtgtgcaatgtgattctattctagtaacaactctgcttattatatgtgtcttagaattagtgagaaaaaggtttctaaacatatcaagaggttgagagttttgtagaaaagtttgctttttaacgcttatttctttttcttttcttgctctctctatttttttttctgagatggaatttcactcttgttgcccaggctggagtgcaatggcccaatcttggctaactgcaacctctgcctcccaggttcaagtgattttcatgcctcagcctcccaagtatctgggtctacaggcatgcactaccacacctagctaattttgtattttttttcttttttagtagggatggggtttcaccatgttggccaggctggtcttgaactcctgacctcaggtgatccacccacctcggcctcccaaagtgctgggattacaggtgtgagccagtgcacccagcctttaatgcttatttatattggcttgtctcagtaagtccaataagtatgttttgttgaaatttgaaaaaaaatacaaataaaatatgaaaaaacatcaattagctaaatattattcagctaacaaagaaaggatatagccattttaatagctaattaattttgaaaatggcaccagcagatacaattttattataagattctgacttgttgtatgtaatgctttaaaattctttgtctattttttcttttaggaatcattaagagccatcagatatgaaatatctccagatagagagtatgcacttttttcatacaatgtggaacccgtgagtattatcctttactgcctacaaaataattgtttctttattctaatatctcattaagtatatttccttgactcttctatacttagtgatctttgaatccagaaatactttgtacatcctggaagtctcttttgcatatcatactgccacctaggagagaggaaaggtataaatatctgcttggcaggggaaaaaagtcacatactttagaggctctttcatagacttttcttaggaggatggtaagaacttgtctcttcatagacacaaatcttgcccttttgtgcaattatttttctggctgttttctcagtgaaataatagattttatcctaagaacaaaaagcaactgccaggttctccttaaactgaaataatatgttaattatctcctggtcattgtagtgttctagtgaagagctgaagctatcacttccactatttaaatgcctatttttagcacttcctgtatatatgagcctcccataaaatttcaccagaattttctgtaaaatctcactgtgtattagtagcagtgtaaaacttcctaggccaggatcttccttcttcttcttgttttttcatttgacatgctcgtatttcaaatttcattttggctctttaattttaaatagttggaaggtgaagtttatttgtataagtggagaggatgttcagtttacaagagataagcaactttagaaatgtatgttttaagaactttcctctctggcaaataagatatagagtctactactgcctccctggcatttctgagaccatttgaaatagagtttcctggtgcttctgtgaggtgtaatgactcctgcattttaattcaggtcagaatggctctgtggtgagtttgagagaatcttttctggcatgagacagtcaagctttttggtttatatccactgggaaagctggggtattggtttgtatgaagatgcaagttcaattctgaattcttaaactttcttttagaagttgattggacaactggattactggagatttcaactttattcttccaactgtagatttttttggactctgtttcagtcttccatttttctatttttaaatgtccattctataaaggttttcattttttccatccaaattctttgaaacaatggggcatctttgtctctttgattgggatcagttggtgaacttgacattctaaaaggcttgggactctgcattacctagacacagccttaaacttgcctctttcagcctcaggcacctggatgtgatgttcacgggtcatagaccatttcagcttccttcatcacccttgaaaaccaccagaaatacaatctccacacctgtataaaagaaaaatgttagcagatatttgaaagccttacatggatgtgttctggtttgccccaggaggcacagctaacacctgagtgagaaaagcctagaaagacaaattgatttcaggttatcctcctagagaatctttaatcatcggagcaccccgacagtgggatggaggtaatgagcattccgttcccagaagcctcaaaacaaagtgaggtattgttctccggaatgtgacagaggggttcccgcagccgtgtgatcggaagaggcgtgctctagtcagtggtgctgtggttctgtgcatgatacaattctccaccactttcttcggcttcccagcgctctgtttggaagagtgccctgggatcccattgaaccagaaaccattttgataaagatcattttgctaaagatgagtcttcaccatgtggagcactggctgtaaacaggaaccttgaaataaccctttctcactgggcagcatctgtcggtgtttggagtaagactcttcagtttgtcttctcaactgaaggaaaacctaggaagtttgaagtgtatttacagaactataaaaatgataaaattgaaaatgtaaaaagtctatagaaacagatattttaagttgaataaaataagtaatccttaatagttttcagcactgagcagttactgtatacatgactattcaagcaagtattctctgttcttctggaggaaaaattataagggaaattataacctataggttatgagtagtgtgtcttctctctgaactccttagcgctataccaagatacaatccaagttcttgaaattctatcaaatccacaaaatatgtaataaaaggattacatatgggattctgcatgagaatttggagttagatattaggaagatcttcctaactagataaactaaaatgtaagtaattttagaaaagggaggggtaaatttcaaaggaagagtctaggtctgtgattctggaataagtggaatagaccaggacttcctaatcagtatttagtatcagtaattgttattgctagtattgtattaatagtataatcaattaaaaatattatccattggtattctttaaaaacaattaaaggttccatattcaaatacatttgagaactctagttaaacagataagtttcttgaagttcctgatattctcatgttggttacatagtacttcccaagtgggtattacaacatgtgattccaatctaattataatgaaactagaatttgttatttggattcatgctcaacatattcttatgtgtgtatctcaaaggcagctagtgtaacttgtttatatgaaccaactcaacttttcattaaaaagactatcataaaattgttttagtgtaaaccaactgtccaattactagatatctgtcatttatttcagtatatgtttcatttgcaataaaattttggtatattgggttaccactgcactaaaaaaaaaaaaaaatcctactatcccacatttcgtcaggataattataatctcttcaatctctgcttctctttgttgcctgcccaaagatactggacttggaagtcaaataatcataggttcaagggctcattccgatgctcaccagctatgtttgcttgagtaacccactaaaccttatgcactgcatcttggagccatcttcctgggtgaccctgggcttctgtttctcagtggtgaagggcgacccaatgaatgtcagctctcctacacttccagggtatatgtgtttgagcacagagtagttccgtatgtatacccagggccagatttaaggctctatccaatttcattggaatggagttgatggatgcctacatgaaatcagctgtcttggcagtggctcaagtagaagtgagtaagagctttccagcacagcatgggtggtaagagaaatgaggaaacagatcattaaggagtttagacacaaatagtacagcaacatcctgagaataagagttgaaggaaagatgtttaagtttaatttttagaatatgcattgggtatctcttcttctcatttattcagactaattgcaatgttatatcatttcccagttgtttggcatagactaatttaatttgtccatttttatattgtcagatactcaaagacagggacaggtctttttatctcctatctgtccccacctcagaggacccagcacagggtgatctgcgtacatttagtactgagcaaatatatttgtggtgtgtgtatattctctccgaaccccttagcgctataccaagatacaatccaagttcttgaaattctatcaaatccacaaaatatgtaataaaaggaaaatacctcagttgtgaaatatcctaataacgttccatgtttattctagaaatgtgggatcatgctaattagcatgctttttcctactaaactcttctaatattactaaatgtatagcttggctagcatccttgaacatacacaagttagctcatcttaactatgccaaccctatgtttttttgagagctttaaaagtagcctttaaaaaggtgtttgaaatatcaattatcaagtaaatttgagaaacagcaaacccaattttccactttttcaagcctcagacacctataggttataagtagtgcatctggaatgttgaaaataataaacagtattgtgtttgtatttatgtggcaccagcattatagtttgcaatgtgtgcttatttacaccaccttattttatctcaaaagatcattcctgctccaaagagacaacatgtgctaaatgagttttattttattttatacataaaatttcataacatttctcagtgtacacttcctgaatattctcttgaaattaagttagacattggagaaatagcaattttttatttttaatttgaaaactgtattaactatactaataaagaaaaattgccttaaaacaaatgtatctaattagagcagccatgcttttttatattgagatatatttgacaaatatgaaacatttccaaatctctttggggagagggaaaaagaatgtaaaatgcattatctaagatcatttaaaaatattaatactttttcctactaaactattttaatattactaaatgtatagcttggctagcatccttgaacatacacaaattagctcatcttaactatgccaaccctatgtattattgagagcctaaaaagtagcctagtattaatatcttagatcatttaaaaatattaatttcaaagacctaagagaaaaatattcttccttgaagaatcatttctgaaagagtcactgaagatttgtgaggaatttcattgcaatatttaaaggagttagttgaaatgattgttcttagtcagatcattgccagtggaacatcattctggtccaaatgaaattctgtccaaaatctggtcagattttaagatttttttcctaaaatcccaatcacacagtcattcagtcagtaaaatgggttgatacactgatctgtttataaactgttcatataactgaaacacataaaccaatccgttttagttacttgccactgcatagcaaattatccccaaacatagcagcttaagacaaacaacatgtatcatcccagtttctgctggtcggaaatctgggctcaagttagcaggatccttgcactcagggtcttctataaagaagactgtggtcaaggtgacatccgggctgcagttgcatctgagagctcacctggggaggagtctgcttccaagctcagggcatgggtgttgacagggcccaaatgccatccttagagatgggttctgctcagtcctgagagaagatggtttgctgctgagcttttcatggcaggaattggaagcagttttcatatttgataaatttctactattttcctgccatcgtggtgagttgatagagcccattttgctctctaagggactgtgaaatttataattcatataaagcttgaagaacaccctgatgtggataatcctgatcaaacctgcttggtgaggtgaaccccaactatatcccagaatcttctatgcacccatctggtcgagttacctatttatctatatcttaattaattttaaaaaataacttgaggctttataaatgtaatataagggattgggctataaattattgaacccatattgtggactaaattataactgctggaaatcaattcaggtaattctgagtatatgagtttctttttttttcttttcttttttttttttttttttttttttttggtggtgtctcactctgttgcccaggctggagtgcagtggcgtgatctcgactcactgcaacctccccatcccaggttcaagagattctcctacctcagccttctgagtagctagcattacaggcacccgccaccacacatggctaattttttttttttttgagacagagtctcactctgtcacctaggctggagtgcagtggcacgatctcagctcactgcaacctccacctcccaggttcaagtgattcgcctccctcagcctcccaagtagctgggattatgggcacgcaccaccacacctggctaatttttgtatttttggtatagacagggtttcaccatgttggttaggctggtctcaaactccttacctcatttgatccacccgcctcggcctcccaaaatgctggggttacaggggtgagccaccacacctggccaattctgagtatatgagtttctttgttgcaagaaatatagctattgttataatatggttctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttattagaaataagaattagtgaaatcaaccactttttaagttacaaaatattacaatgatcagttttaacctcaccccctgccctgaatgaactaattgtttttcttagagccaggtaagggcctgccattggcaagcttgcaccttgagttagggttagagttgtcatgagtcaaatgccagccatgtcctcttctgccccccatgggggggcccaaagtgcaggagtgacagagaggaacagaggcagatgggcagcagggagatggactggcaggtacctgtgtcctcacaggtaattacgtgtcattccctctggatggtttctgaactgtgggaactcccccatgtgcattgatgggagaagagccaggcagagacacggtaaggagggcaagttatccatgtgaccttagggatacttggggcaaaagtaggctaacctccgtgcacaccctggaacaaaatctttaaaagagagagcacagaagagagagagagagcactttgcccggaatgagccccataatcagacaccacatctcccaaattagcagcacccttggtttctgggcaggctgagtttcccgcgcgtcggaggggataggatgtagcggtgaataacagtaagactccaaaatcaagtgggtatgtctgacgatctgcctctctctcccccttacacacacacacacacacacacacatgcacacatactctccctcccccttacacacacacacatactctccctcccccttatacacacacacatgcacacacacattaacacacacacacattcattgctcttagtatatttcctccctacctccttaactttgaccattgacaaatttttctctcttaagaagtcttgaggcagtgcactcgggcataactcccttccttgtgatacatccacgtctttgtgaatgatgaatggaacgttgctcacttgttagtaattccaacagacaaagacgtggcctgagactgcccctcacctgctctataatggcttcttgcagcctgctttcctccctccagcgctgccgttagagcctgaggggtccaagggagtcagtctgcccccgtgagtcttcatgtggtgtagatgatgtcagggtcagaaactgacattcaacacgagctgaggcccatggtcccaaaaatgtgtgtgagctgtagttgtccaaagacgtgagaggacaagaggcttgagtcagggaaggccgacggagaagaaagcctggaaggagaggaggatccggggtgaagaagagaggaatggggagaaccttcccggtgcgatcactgcagaggaacagaggccgccatgggaaacacctgcagcgagcatcagcgaggagctgaaagtgctcaggtatcaaaagaaggcagaagaaagagcagcaaaaaggagagaaaagtcaacataaaaatttaacacgggtcccttctgctgacagaagccttcccagtgcctattgcggccaccttcctaatgtgacctcagatccaaatttagaaacagcctctgttccctccgctcccagactgttttttctgcttgccctgcattcatttcttggaagttttttaagtatataagagcccaggttggccagggcaggggttagggaagcaaaggaactggaaacctgtgtccgctgaattgcagagcaggaataagggactctgcagaaaagagcatgacaaagagccgcggatacaagcgagggtagcaggagaaagagctaagaaggcagaggttagttgtttgatcgtgcacttggggaaggtggagggagaaggggccgtgaagagatggaacggactggcagaggagatttgtgtggggaaaaggagacagaggggacaggaagaaggggacagaagagtaaagagcctggaagggccagggaaccctgcctgccatggtcctcccccacttcctcccacacaccctgatgcaactgtgactgccctggcacctcagcagcttcagaacagggaaaggaggagaacacgggtttcacaggaggagaagcaaggaggacccagggagctggggtgccctgtgattctcaaccctgtccacatgatctgacctgggggatgagagcttattagatccaacttgagttgacaacaaagaacttctggagcctttcaggcccttttgaaacaggcagatcttctctgcagtcatgtctaatgcagcaaagaaaacaacagtgtcccctgcaggtgcagggacttctggcctgagacagcagaataatcgctcctggagtgggaaggttggcttgtgtattgtgcgcggccatcagcagcatctcatttcagactctctcatatccccggaatgtcccggggttaccgaaaaggccccattctccttccacctgccttctcctgctgctagaaaccaggatttttgactattgtccctgcatccccacatgtcacccagaggcagccttaggccccctgtcctgggccacccttggcataactggagtagacccgggtgcctaccacagcctccttttcctcaagggcagctgccctctcggtgccctgctcactgtgagcaaatacatatttaaagacatattctgctacttcccaaagggaccagccaccacctgcactcctcgtcctggtggaaacagtctgagtgcttgctttggtaatcaaaggtttcattgagtgcagatgtagtgatcctggcaaaaccctggaaacagaaagtcagctgaaggggtgtttctggagatgaggaattgtgctggttagccacgggcatgtcctgaggataattatttgtttacaacatttctgtgaacaaagaacatatagggacagaaataagttagtttccaagaatcttgtgatgggctccatttatctgacccattgggtttgtagaagaggacagaatgctgctttggttctcctccttggacagtggaactagagaacgggaagctgagatggccgagctgagtggacagaggagggaggaagcccctcacctcgcctgcttcccacagggtcccttcctcctcctcctgtttcctaagcttctcagctgggcttcagatgtcaaggtttcctggcttctgccacttcaccttctcatcttagctgccactggaccataagcatttcaggttgctcagatctctcccaccgcaaaataaagcaaagacaaaaaagttctctctctctcaacccatacccatgtcctcctctggttcttcccttcacagtcaaatgactaaagaaagaagcagctgcactcacctctctgtcccctccccactcactcttccgtgtgtctcccacagagtggaatgagtgctcagggctcagccacccagcccctggggaacagtatgagtgtcttccccatgttatacccccgggggaaggtatgagtgtcttccccatgttatccattaggagacgggctttgggagattgcaaggtttctgcagtgccagggatggagggctgtggttccaggtattcctctctgcaaacacctgctcttgatgggggctctgctgcccctgagcccactggtaactgtacttggcccccaccacacagcaaaactctcacccatcttaccagcagtcttctcgccctggaattcactggtgcctgttttaggctgcctgggctgccatggcaaaataccacagactgggcagcttaaacaacagacgtgtgtatctcagagttctggaggctggaagtacaaggtcaaggtgccagcaggtcggtttctggtgacggctcacctcttgtgtaattttgggtggacacaaacattcggtctatgtgccaatctcctcaggcctcctgtggcagaatttgaggccgctcacccctccctcttcctcagtccttggttccacaggccctggctgccctctggctgcctcctggccacttaggaggtcctcaggtgctcagacttgattggatttcccagtcccacccaaggtcatcttctcttctcttgcgcactcaccctgggcaacttaacctactacggcaactactgcatcggctgctgccacccaaaacgcgatacactgagtggtggcagaagcctccccaggaagcctgttagaaacactgactcgggacccagcccacaccctgatcagtcagaagcctcgcgtggaggagatctgcatatgattcgtgcgcacactgctgagacacatgaacctcaacaacaaggctcccgcatcacatctctgttctggacctctgactcgggtgtcagacctgtgtgctgctgtctccggggaacgtagagggccctcagacacagtgtgtgcaactgatctcatccgtttaatcccacgttggccccacgtcctgcctgcaacatcagcactttaggaaaaacaccattgtcccctccttaccaggaccctggctagagaccttctgtctccctggcccaggcagcatcgccatccccctgcctttgggatatgtcccttccacttccccattgccactgcccagttcagcccaccttacctgttatctaaaaaaccacctctgcctccagggcctctttgcctcagcctccccgccccacacttcttcaatctgtgctggccacgctgccttcagggtgacctttctcagtgccaatcaggtaactcattcccaatctgcacctcttccctaacccccttgctgtcccacctgctccttccctctcacctctgggcctttgcaggcgctgttccctctgctgggagcacctgcctcctccactgacctcacagttctcccacgcccttccagcctcttcagcagcaggccttggactccacaggagtgggctcccatacccgtgcacacccacggggaccacagcactgctgacggttttccgatttcctgcctatgagtccccgcactccaagggactttgagatgcttaaaggtggcttgggacatggctgatccacaatagagcctcgagaaatatccgacccattgcaaaatggaccgtcccccacccccatgcggtttcagggccgctcccaggctgtgagtgtttatgtgaaaggagtgtttgccacgtcgctcgggacgcccatcctggcaatgagcagctgcagcttccaggattttaccttcttaaatgcacttctgttaagctgtgcatgtaagaggtctgttctgttgaaatatttcccagagactttcatactaaggagggctttattgttataaatatttaaacctgctttgcagccagtcgctacgattactcagctcagaaagcatgcacaaagcctgcctctagtggacgatcctgtgctattcatcggcctctcattttaaatgtcttcctgatttcaatttaaaagcgtatctttatataacatatacaatttaactttttctttttaaaaatatgtatagctagtttttgttgtgcaattctatgagctttaagacctggatagacttttgtaaccatcaccacaaattgggatatggaacagccccatcaccccaaaaaactccccctgctctgcttccttcagggcaagccctccctccacccctagtccctggcagccacagacctgtctacagtcttgtagtttagccttttctagaaggtcatataaatggcatcaagcagtatataaagactagcttcaaagtggagaaaactttaggcctctaaggcattttaatgcccgcatagtcttcatctttagggtaattttgctctaaaaacgtttttgctgttttggtgaaatatgtaatactaggatagactatggaagatgtgcttactgagttcttaccctcaatgtcaaaaacccaacagactttcattactgcatcccctctgtacaggatcaaagtgcccacccttagaaagtctgatgagacagagaagaatgacttgcgaggatcaagaaagacaggctgagtgagcagtgtcctggcctgaagcctctgagcactgcggttgtccctcagcacccctggggagtggttaccagaacccccgtgggtaccaaactccacagaagctcaagcgccttaggtaaaatagtgtagtatttccctataacctacacacatccttccgtgtacttgaaatcatctctaggttacttgtagaatcaaatacaatgtaaatgctatgtaaaaagttgttctactgtattgcttaggaaataatgacaagaaaaaatctgcacatgttcagtacagatgcacccatccttttctttcttcccgaatctttttgatccttggtggttgaatttgtggatacagatctcacaatactcagggccgactgtaattctgaaggagggggctttggggcgggagcctacaggaagctggaggcagggcactggggacttgaaagtgaaaaagtcagtcatgagcatgggagaaaggagaggaaggcaggggaaggcactccagatgaaagaaccccctaagtgcaggcttgaggtgggatggcacagtgagggcaggagagggatgatagatggtccacctggagcacagtatatgcagtggaggggcaagcaggcaggccaaggtggggctgagtgtctggagttgaccctcgttgccaccgtcttggagggagctgaatggttccagagtagaggctgatgccacgtgaccaggtgaggtgtcttgttgagaccgggcacagtgattcatgcccataatctcagcactttaggaggctgaggcaggaggattatttgaccttaaaaaaaattgttctgttgaacttattgccttgagacagaggagctttcccaggatggccatttcctacctgccggcctcagctcccatcgcctgcccttatgcccactaaacgcgcttgtccaatctcatggttaaggagccacgggttatggttttggccccatagatgagggagaaatttgctggagggcctgtgggagtctttggctctcttgcaagaggaatacagagttggcctttctcttccccactgtccttgccttcatgaagctgtgctgcccaggctgtcacggtgggacacggagcccagcccctgatggcaccatccatgtgttgctctcgatccctgttctctagattagctaagccagaaaaattagcctgatttgtctaagcgtctgcccatcgggttttcccttacttgccactaaacgagtcctgagtggctttgctcgtgctgtttcctccacctggatctccttctctaccttgtccagctggtgatctcttccatccagaaatttaacttcagtctgagtgagcacctccccagataccccaggcatcaaacacaatcattgcttacagggctgtgtccctcatcaaggagctgtgagcccctcatgagcaggaactgctccttacttctctttgcacctggaaggtcataaatgatcagcaaatattcgttggataaatgaaagaacaaatgaattccatagaaacaagcaagggaaaaatgggaaatgatttcatcaattcttgctaagtcacaggctttcttccttcacaaaaggatgcgcaagagagttgaggatcttgagtctgacaagcagagaggtgcttcttgttgtatttatcaaagcttcgctattaatccctgcagggtcagtgaacgcatgtcagctctgcactcagtcctgctgcacttcggtggactctcaccagaggtcaaaggctatcagctcactccttttgtctgaccaatgccttgggtggctgctctcatcctgacttgagctaaattgggtgatctgcctggagacttagaaccttattcctccccccaaccattcccactgcctttgccttgatctggactcttctctcctcttgccaggaccaatgctgccgctttccacctgtccttccctcctgtgcatcccacacagcctgcagctaagcatggttctgagcaagacacagcttcatgcaaaatattgtacctctgcttgaagacccaatgtgaacattgcccattgatttttgtttctcgatccccaacttcccatgccccaaaatagcatcctgggaccatagaaatggaattgagctttctaaaatgattctgcccatctcccactttacagatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccctggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaaccaaatacctatgggcctcactgaattaataatttatttatttctaaaaaaaggttttattaattaagtcaaaatttcattgtaattttaaaataatcttgtggtctttctccatgtgtctgaagcttgtaatcactcttattgtcctgtgaattctgatatgcagttacctgctagcttagtgggtaaacattttctctattaatgagcaggaggcttattaaactgtgacagtttagactattctttcaaggccattgatcagtgaaaaaacagaatctggatgctaaaaactgtgcccatgtgaattaatttacccccatctttccctgagccatcacctgagtatttgttcctaggtttgttggctgcatttgcttaatttttatcttgtgatttcattgagaggtgtagttgagtgggtgtacttacagcttctgttcctgtttgaaatatcatttggaaacctgatcacaccctgcacaagtatgcttgtgaggcatactaattcaataccatttgagcaggtgcctcctaacgctgccctcctcaacctttctcagcatgaatgtacgctttttcatgtgctgattttaacataatctttggttcacagtaacagagaattttgtttgaaaaaattcagggattgaagggatattgacatgtacctagtcaccatctatcactccatctcaggagcaagtgttccttgctctcgtgactttgtcctggtgacacagaattcatccttgtagaccacttactttcttcccaggctgggcagttctggcttttgcaaagttcttcatcagctaatttaagtctgctttttaaaacttcccatctgctgaatctcattccaccttttatgcggcagtgtccactgcgctttctgcagtgacggaaatggtctacagttgcactggccaagatggtggcattacccacacgtggctcttgagcatggggaatgtggctggtctgacaaaggaactcaatttgtagttttctttaattgtaatcaacttaaaattacataggccatatgtagctagtggctaccctattgggcagtacagttctaaagcaatgctgaatatttaacgaccttcagatatttgcagacagctctcctatccacatctttagccttctttggcccagccgaacaagtgtttcagatcatgcctctggactcctttctgtctccggacttcgtaacagcatggtcacccttcattcacctcattagatatctgaagtaatgacggaagtaatcgattgagtaaattagtgaatgaatatgtgattttaattcttcacataaacctcatcctagctaatcctcttgtcttctttataagctgaggtttttggttttatgactgtggatgggaagaggggatgcagaggataggaccaagcaaggtcgtattttctttaataaccacatccccacctgtttcccagttgggaaaaacacaaaccgatttgctctcgggtaccactagtttattataataagatgtacaaagcaaggcagatgaccctgcagtgatagcagggatggtcacttgtttggcagaatggcccaggggagcatctctagccgtttcaatcccaagaaagcaccttggggtagagatgatgcaaaaccaacctgtacatcgaaatctattttttattattcaaaaattacaacctggtcttctgaaacttatttttttatgcttttacatctcctacagccttacacataatttctagtgtctttttagaacctctcagtattgtaacatttaatgcgttctcagcagcgggtaggtccgtgttatgtttgcatttgaagtagaagagctaagctaaaaaatatgcctttgtttactaataaggtagatactatttttttgttgctgttgtttgatatggagtttaactcttgttgcccaggctggagtgcaatggctcaatcgtggctcactgaaacctccacctcccaggttcaaacaattctcctgcctcagcctctcgagtagctgggattacaggcatgtgccaccacacccggctaattttgtatgtttagtagagacggggtttctccatgttggtcaggctggtctcgaactcccgacctcaggtgatccgctcaccttggcctcccaaagtgctgaaattacaggcatgagccaccacgcccagccgatactattttttactcaaaccaaaaaatatattctgcgagtaagtgatccactgtatctcagcccataatgatggcctcgacaaggaatgagatggccacagtcagtgtcacccactggaccacagtgatgggcgtggtgaaccaagaagtgtggacatggcactgtgctgggttacagtagtgagggaagcaagcttagactagggagcaaaatcaacctgtgatgagttgtgccttcctttaagcatcttggcatttgttgttggcattgaggttatagaccggtggtgcaaagacgaggccacaagggccactggagaagagggaggagagcccaatggctagaatctggaaggacagccacacgtttccccctctgattctttaattcacccacaacatatgcccatggtgagttcttcaattgcaggcttttggtacaggaaatgagctcttgctagagatttaagacggagtcaaatcatgggtctagccctaatgatgagtaactgatggtgaggatgagagttgtgacagtgctggtggtcatgaggaggatgaggatgatgaagaagaaaacagcagtaacaaggacgatgatgaaaacctgctaattatggtgctgatgccagggataattatggtagtgataatgatcatgatcccaggaggacttactgtcattatttctcagtggcttttctttgggtagagagtgagataattaaagtctggaaggagacaggaacagggggcgtgcagttcctcagatccatgggtcccgcccagctgcatgctgggagtgaaactatcaagattaagagctatgctgtttcagcagcatttccactgtctaaatataaacagcctcaggccctgatccagcagaggagaccacagctgccaaatgcatcgccagctgcaggccctggctgggtttctttaggggaaaaggccatcccaccatggacaggttccaaaaggcatgagcctgcgaatagaatttgaggttcaaggaatgctagactgtgcgtctgtgttcagggtcacagagcgagtctgaagggagcaggatgaggacatgggtgccctgcctccagggcctgtgctctctgctggtacagacaagggcctggtgagatggtagaacaggggcggctactgcagtggtgccacctgcgtaggaagacgggaatctagtggggatgggcaggggccaggctccctttgctttcgcaggcacccagctccagtggcccctcagtcccagctacagatggactttgagatctgatgacaggatctgctgttatcccacctctggatcaacggcgccatcatcggtgccccagctagccagcagatgtgggccagagtaaggcttgactggtccacatgtcctttctggcttaagacactgcttatcttgactcagggagagaaggaaatggaagaagaagaagaaagaagatgcatttaaaacatattaccaaactaatgccatgaacacatgaaatgtcagccttttgattccctcctgccaatacgcatccgtttatccagtgctgacttactcagccctgaacatgcaccaggcgctctcgcaggcacagggaatactgtggtggacagagccggggaagcccctgcgctcgtggatcttacatcctgctggaaagaccgtgcataaatagatgtgtttatcatgtgtcaggcaggacacgtgctccacaggaaagtgacgtaaggtaaaggacagggagcaaaggggagtgtctgggggaggacggcagggacggcagggacggcatggaagcagtggcccagcagacgcaggacaaggtcctgtgatccgaggaggggtctcagggtggagggacagggagcaggccagcgtggctacagtgcatgatgtccaggatgagcaaacggagtgatgtttgaacatgtcatccgggaaaactacacacaggggcaggctcacagccactttttccccagctgatcttgcttcctctgttaccaaaccaccctcaatacagcctcgcaaactgagcaacagaggagggggaacacaactaataccccatttggcaggctggctgaaggctgttgaagaaacagcagaaacacctggtaatccttgcaggcgtcacccaggctgcgggccggagctgtcatgggacaagcaggaggctggaatggagctgggatgggaaggaacacaggccatcagcttcccaggccccacgttaattgtgtaatatcatcacagcagggtaggatgccctgtgagggcacctaacaggtgttcatcacattcatcagcattgccctaccaacgaccgtatttacatcaggcataaatgcagtttaccgcactctgtgagaactggggattaatagctccggtccagctagattctgatttccttggtaggaggaggcagaacagcacacatcttgactgaataatcgtgcattttgcatggttaataattctgagagcaggaaagctaccttcctaggatcacagagagcttactttcttttctacgaatctttgaaaaaccaaacagatgggattttaccttaagagttagattgcactcttacactgtgctgttcaaattatgaattggcctcacttggatgttggactattgattatcaactctggcaagctctttattcagaatcttaggacatgcacattaaaagaaaaaatcctctctttgacctggttgccaccaatgtgtatctacataggatgaaaaaatgcatcacgtactcagaagaacgggctgcagccccggagccccagtccttctgccagctctggagcagggggagctcctggctgcacctgaggtgtcagtctccaagaacctgagccctttccacacgcatggctctgttctaggcactcgggggagctcaaacagaaagagagtaaacctgctgctgttcagtcagagacccaagtcatactcacaaatgatcaagctagtgaactggatggcattttcacagctagatcttgtactgcaattatagattgtcaccataaagcttttgagagcaatttaatagttaataacatcctaattctatgatgtgagtaatctgtgctctgagaacggcctacatataggcagaagaaccatgaggagctctcaaagaaaatgtgccatatattcaggcacctggggagtggttgtagaaagtgtgaccttccaaggcaattgattttggttgttctttaaaggatcactctagcagtccggtcattcttatgggtcctctggtctagatgcccctcatggaggatcttctaatcttgcattattagaaatggcagctaagtggattatggatggaaactttcatgttgtaaaaacacaccaccagaagtcaaccattcttattttgcccacgtattaatgctatttccaaaactgcccgacagctcacgggtgtaggggtttaggggtctatattccttgttagactcaagctccttgaaggtagggaatgtgtcttactcattactgtatcctcagtttcttgccccattgtgcaagctaaataaacaatgaatgaatcaatgaatcaatgatgaataaaaggaaattagttaaattccccttagatagcaataattgtccttctcaccccaggttatctacagccagataccatttggattattgaattcctaggatgttccttgcctctctgattgtttgccatctaatcatatccactcttatgtttttatttaacttcttagtatacatacctgattcccacctttaagtatcctaaaggaacacaatgccttatcttgctttccctccgcccttggcacacaccacctaccacaacgttgaacttacagtaaacgatcaaggacaagtttcggactaatgcatttggatggaatggcttctgtggctttcaaacagaattctagatctgacctagaccagacccagatcctgcctggatgtcaggacttccctgtctctagagaggcagcatgaacagagacacaatgccgggcggattgttctgacctggctcccagacccaggccaggggccagggtgtgtgtataagggcatttgtattctgatggcctttgtgggttttttaaaccccaattgtatcattgattttttttttggcattgacgttaagattttcattcaatggtgatggattttaaaattgccctgccatgtggggtgttactaaagctcatgtggatgaaggctgttgaacgcctgtgtctgtgctcacactggctgctttgctttcctttcctgcctgacacgtcctctccatcttccccttctccgttgccatcttcctgcccttgtctcctgccagcttcctccttttctgcactcagccttaccctttcttccccttatgcttcctttctgggactcccaaacccaactgtgctttagagaaagagtcctggactcaacgccagggaaatgcatgcccgtgttcctgccttgctgccttctactctgaccttgagaaggttatgaactcttgggcttccattttgccatctctcaagccagtgagttagaccatggatgaaagaccgcccatcctaggattataaactgggtaagatttgcatcaatgtgagtcttcacactgatgctggctccaggtttcctttctccactgtgagctgagttaaaaactctctattaggaggcatttcacataccattgtcgaggaggtgggaaataacaattccattcatttgccaagtagaaaagcccttgccttcttggttcattcagcagagggaaaagtaagctaggcggaggcaggaatggcctttatttgcaaaggaggctgtgcctcactgttcttcaacaggatgcctaatgagttagaatttgagtagcatggctgggtgcagtggctcacgcctgtaatcccagtactttaggaggctgaggcgggcagatcacaaggtcaggagtttgagaccagcctggccaacatggtgaaaccctgtttctactaaaaatacaaaaaaattagccaggcatggtggcaggcacctataatcccagctactcaggaggctgaggcaggagaatcgcttgaacccaggaggcagaggttacagtgagccaagatgtgccgctacactcctgcctgggtgacagagcgagacgccatctcaaaaaaagaaaggttatgcctcacaggttctgacattcagtaggatttgcactttggtgcatttttctttgtacataaaaccctcatctcacttttagaacagtgcagtacttaactttttccaggattaggtattcatttcagtcatgaaaaagaaaagggcatttgacccaaattacaaaaactattgaagtaaaactgccctattttttccttcatgctttcattgcaaaatgcagtgactgtctgctgctggatgagtgtgtatttgggggctctgagggatggagaaggagaggcacgactcgcaagtgccaggaattcacattccgctgacgcgggaacacgggcagtgtatagacattgtacagacattgtaaagacattagagcacaattttgagaaaacgtgaaaggatttccacaagtctttatgtcctctgtatattaaggtgttaagacaatggatagcaagagaaagatgggattttgtggcagaaacttccaaaaaaaaaagttgacatggagcaggtcctcaaagcaggaggcctcagagtactttgtagtttaagtaggagggaggactcgggtatctggagatgggaatggaattaccagaggagaggagcattgaagaaatggcgtcaacactgaagaatgtgctgctttataagaataatgagcccttaaatgccagtctgaatcttagcttgacaaatgaggcgaatctgaacacctttgggataataatagcgccttgctctatttgagataaaatccatttcttctgacttctgaaaggaattattgtattggtccatttgttttattttaggaaattttaaaatatgaggtagaaaagtataaagtattctccaagttattagctaataattggctgatgtcacccaggtggttatataataaactgtctcagtatcattaaattctagaagtccagaagaagaagtcaaggacttcttagtattttgaggcagagggaagaactacaaaaaaacctcagggcaggaaaattggacctgttgcaggccctgaaagctggtgtgatttgagtacagtgagagagagacacagagacagagagggagagaagacagagagagagagggtggggagacagagaaggagagaagacagaggggagacagagagagacagtgggggccagtaggggaatggaagcacaattgtgggttggtgtctcctggctcaatgcctaatgagttagaatttgagtagcatggctgggcaccgtggctcatgcctgtaatcccagcactttgggaggccgaggcaggcagatcacagggtcaggagatcgagaccatcctggctaacacagtgaaaccccgtctctactaaaaaaagaaaaaaatacaaaaagttagccaggcgtggtggcaggcacctgtagtcccagctactcaggaggctgaggcaggagaattgcttgaatccaggaggcagaggttgcagtgagccaagatcgtgccactgcactccagcccgggagacagagtgagactccataaaaaaaaaaaaattgagtagtatattactttgctagggctgtcgtaacaaagtgctacagactgggcgtcttcaacaatgaaaatgtattgtctcacggttctggaggccagaagtcagagatcgaggtgtctgcagggtgggctcctgctgaggctgtgagggagtgctggctccaggcctccttcctgcatctggtggttttctggcaatctttggtgttcccaggtgcaccaatgcatctccagcctctgccttcgtcttcacatggtgctctccttgtgtgcatgtctgtctctgtgtccacattttccctgtttacaccgacaccagtcatttggataaggatcttttttaatgacctcattttaacttgatcacccctgcaaaggctccacctcccaataaagtccctttctaagtcctgaggataacgactccaacatgtcttttctaggagacacaattcaacacatagaaaacagttaagaaaaaaaagagaaaatttggtaattgtcttctgtacagacttctattaaaacaatgaaatgtttatttaccaaaatcaggaccaagttacaggccagtattaatatatgaaactgcttgcgtttcacatgtacacttaaatttccagtcctgattttcataccaagaaacatggccaagtcatcacttcataaaggaaaaccgttttggaaggtaaaaaagacaattactgtttgaaacagtctaacattgaactttagatgtaaactatgccgagcaaacattttttccaggtaacgttatttgttgcagacagcctttggccattgtgtagatcccaaatgtggtgaaatgggagctcccagatcattgcccagtttccagctgccatcccgagtttgttggtgtcactgattccaagaacaaaacactggtgcatgaaattaacaaccttataaatagatgacagcacgtctgttagacaaaaggctgcagttatcccctagaaacaatcaaacacaattccagtaaaagtcttgccaaatacctctttgtaattcaaggaacctaacaacagacaatatgcagtgcctccttgtttatgttctggaactcagcgctgctgcagtgtaactgagaacaggctagtacaacccacaggcatcttgaagtgtgcaaggaggctcagagaggtttatagcattgttgttttgttttgtttttcatggttctttatgtcattgtttgttttataaagtgttatttatagtatgttcatccttagggacttttccttgaaaccaccacctttaatgctgatgattggtgttcccatggaccttgggttaagggggccaaatggtatagatgccctggggagagcttgctattggcctttgggagagaccctgcagcagtaggtttcagctctcccagtggcagagctgggtgataactgcactttcttctaagggcgatacattttgggaatgtgcgtggtgtgagttttctgccagcatctttatagagcaatgtgtacttgcaaataaatacaaccaaagtcaacaaaagagcatattgatgctttggtagagaactcagcagtctcccctctctgtagcgtaaaatccagggaaaacaaaggccccacaatggggacagatggccccgcataggtctaaggactgccattccgttttaaagttataaagtactctcacactgtttacctcttttatttcacaaaaccaccgcattaagtggacagggtagaagatattatcctcactttttatatggagaaaacgtggctcaggtgacgaggtgaatatttgtgggtaaggcaagaactttctttctttctcagtcagttctctctactcaagtggacttctttttattattattattattattattattatcattatactttaagttctagggtacatgtgcacaacgtgcaggtttgttacatatgtatacatgttacatatgtatacatgttggtgtgctgcacccattaactcgtcatttacattaggtatatctcctaatgctatccctcccccagccccccaccccatgacaggccctggtgtgtgatgttccccaccctgtgtccaagtgttctcattgttcaattcccacctatgactgagaacatgcagtgtttgattttctgttcttgcgatagtttgctcagaatgatggtttccagcttcatctatgtcccttctaagctgaccccactccttcctttcatggtaggcacacatgcaccgagtaaaatggctgaatctgggctccaaaatgttctcttcagtcccgcatgttttggcaaactttcctctctgctgtggcacttcaatcccgctcttctccataaggtctatccttttcttcataaaactttctcatggatggctccagtcccaaataaagctatcctcctgctcctggcttactccaatttcccagctcttttgggaaatgtaaactttatggtgtcattattccttttatgtaacttccttttttcttttctgagatggagtctcactctgttgaccaggctggagtacagtggcacaatctcagctcactgcaacctctgcctcctgggttcaagcgattctcctgactcagcctcctgagtagctgggattacaggcacttgccaccgtgcccggctaatttttcgtattttttgtagacatggggtttcaccatgttggccaggctggtctcgaactcctgacctcaggtgatccacctgccttggcctccgaaagagctgggattacaggcgtgagccaccatgcccggcccttttatgtaatctcttatcctgtcccaaagacaattttataaaataataataagtagcacttttgggtgattaataggtgccaggcaccatgtcaaaaactttctgtccagtatctcctttaatcttcacaagaaacctattgtggtaactcttacaccattttatagatgatgaaaccaaggctaaaggaaatatgatgaaatgtccagggtcactcggctgggaatttgggaagccaagttggaaactcagatctactaattttcaaagcttgcacttattttaaagtaatggcatatttggtttgttgtcatagtttaatcatgaactgtttcaagtgtacagaaaagtacagatggcattacttaaaaccacttgcagccaggcgcagtggctcatgcctgtaatcccagcactttgggaggctgaggcaggtggatcacctgaggtcaggagtttgagaccagcctgaccaacatggagaaaccccatctctactaaaaatacaaaatttgccaggcgtggtggtacatgcctgtaatcccagctacttgggaggctgaggcaggagaatcgcttgaaccctggaggcggaggttgcggtgagccattggactccagcctgggcaacaagagcgaaactccatctcaagaaacaaaaacaaaaacaaaaaaccactcacatccagaatgctcaaatttaacaagtgtgatctgtcttgttgaatgcgtccagggtcttgaaggtgtgtatgtatgctgatgcacttggatgacctgttgtaaagtatgtcaattaggtcaaattagttgatattttgttccagtcttctatttaattacttttgctgtgaattactgtgtaagaagtattgaaatctctcattgtatttggagatttgtctagttctcttttcaaatctgtcacgttttgcttagtaaatattgaagctctcacagtaagcacatatacatttaggattttcttgtcttatcattgaattgaccttttcatcattatgaaatgtccctggtagtattcctttgtctctgttaatattctgtgttcttcagtccatttgtttgataataaaccattgcagctttcttttgattcatatttgcctggtagaactttttctatccttttacttctaacctcttcatatgtttacatttaaagtatgtttcttataaataacatgtagttaggtcttgctttttttttctttcagtgagacaatctctatcttttaaaaagaatatttagagaacagattagcaaattatggcccctgagcctaatttatcttagtgcctatttttgtaaataaagatttattggaaaacatccatgagcatttgttaggtattgtccaaggctgtttttgtacttccaaagtagttgcaatacagaccgtatggcttgaaaaaccaaaagcatttattatatgtccctttatggaaaatatgtgctgactcctattttaaatgttacatttgatgtaattgtcagcatgatttaattgaaatctaccatttgctattaggttggtgcaaaagtaattgtggttcttgccagtaaaagtaatacttgtttctttatgcttctctcttctgatttttggttcaatttttcctgtcctcttttggctacttgagtttcttattattccaatttattttcactgttggattaacaagctctttgttttactttttaatggttgatctatgtttacaatgggcatttttaagttatcacagtttatctttgattgatggaccacttttggtatatcgtgtaaaagcctacagcagtattcttccatcatttcaccataccatcctttctgatattttgttgttcatttcatttctacatatgtttaaatcccataatacattgttattatttgtagtttagaaaatcaactgtctttaagaaaaaaaacagctttatatttatctatttcttaattcttgtttgtttttgttttgttttgagatggagtctcgttctgttgcccaggctagagtgcaatggcacgatcttgtctcactgcaacctctgcctcccaggttcaggtgagtctcccgcctcagcctcccatttctcgagtagctgggattataggcacccaccatcatgcctggctaattttttgtgtgtgtgtttttgtagagacagggtttcaccatgttgaccagactggtctcgaactcctgacctcaggtgatctgtctgcctcggcctcccaaagttttgggattagaggtgtgagccagcatgcctggcctatttcttaattcttaatcctttttttttttttttgagacagggtcttactctgtcacccagcctggagtgcagtggtgcgatctctattcactgcaacctctgcctcccatcttaattcttttttatagaaacgaatttcctctggctttattttctttctgtctgaagaatttatttaacattgtaatgctggtctactggcaatgaattctctcaacttttgtttatctgaagaattatttcgctttcattttttaaagtttttttgctacataaagaatttcaggtggacattatttttctttcagtacttaactatatcattccttgtcttctggctagcttagtttctgaggggaactctattaccattctcatctttttttcctttgtgtatatgtttcttttctctcttgactcattcaagattttatctttatctttgattttcagcagtttgaatacaatgtgcatagatgtcattctctttgtatgtaatttgtttagagtttgtgaactttgcacatctgtttttggtagtcttccattcagccatgatttcttcatgtgtttcttctgtcccatcctctcttgtttttccttcggggtctactcttacatggatattcggccattttaatcattccaggctggctgtgtgcggtggttcatgcctgtaatcccagcactttgggaggccgaagtgggcagatcacctgaggtcaggagttcgagaccagcctggccaatgtggtgaaaccccatctctactaaaaatacaacaaaaattagccgagctaataatcccagctactcgggaggctgaggcaggagaattgcttgaaaccaggaggtggaggttgcaatgagccaagattgtgccactggactccagcctgggtgacgagagtgaaactctgtctcaaaaaaaaaaaaaaaaaaaaaaaaaaattatttcaggctctggactctctgttcttcttttatttacttatttactttttcttcttttctcataaatataatgttaagaagtagaagtcagacataaaagaataaaactatgatggttccatatctgcaaagtcaaaaaatgcccaactaatctatgaaaataaaagtcaggttcggatgtagggttagaatgtaatgattgataggtgcacgtgggatttcttagtgtctgataaagttctgtttcttgatttgcatggttgttagaccaggtgggttcactgcaaaacttcatggaactgtacacatgatttgtgtactttttctggacatgttattcttttacttaaaagtttattttaaaaatcaaaaatagctttccgtgtgtttttcttctaaaagtcatacattttgtttgggtccataatcttttcagaatgtatttttatttatactctggagaaggtaagtttatttttctcctacaataatagtcaactcttcatcatgaatgttgcatcatttcctggtagtttttatcataatcttggccatgtatgcacgatccttttctcgtctttctcttctgttctatttatctatccttacacaataccacacattagacattctatagctttatgacaaatctttgcacctgatatggtcagtcccttctaattctcttctttaaaaattgccttggctattatttgccttttactcttacatgtaaatcaggaaacagcttttaaattttattaaaaatcctattgaaatgatattgaattgagatactaagttggagagaattgactactttatgatgttgaattatcccatcctggaatatgctagataatataagcacaaagacttcttttaagtcttctaataaaatgttataatattcatcatagatgtcttaaatataatttagaataattacttctgcataattttaaaatagggtaaattagtgcttctttttaatcacacactttgcattgagtgttaccagtgaaaggaaatgctaaagactcattagtaggaatcttgtatatagtgaagttaccattttcttgctaagttcaaatggttggattctcttggatagtctatatggacatttgtaaacaatgacggttttgtttctccccgtccttgcctatctcttttgtttgtttgttttgtgtcttcctacactggctactcttttccatccaatgttagcccagaaaccatgacagcatgcactttagtcttcctcttaatttaaaatgaatatttccatattttcatgcctaagtgtgttttctgtatgctttggtatctcttttttttttttgagaagattaatatagatctcttctatcccttgttttaattttcatattttgaattataaatatgcactgtgttttcaaagaatttatttttctttgcatatagaggtgatcgtattgttcctttttgtttaatctactactataatgatttacctaaatgaaatgtccaatattaaaccaaccttgattatattcctaaaatacaccttatttaaatatgttattcttttttaaatatacattgacagatgtactttgagggtcctcatctttatttgtacatttttagtcagttttacgagcaagagggtatctgttccatctgagcttgatcctctgatgattcattaattccttttaaactactgtttcacttcctttaatggttatacttctattcaggtatatttcttcctgagtcaattctaagatttgtttagaaaattaccaattacatttaaatgttcaaaattatttaataaagttttgtatattttcatattatatttttctactaattacattttcattttctgtccttatagtgtttgtcccttttctgttttgatcttgatcaatttttatataattttgcatgttagtactattctcaaagacctatagtttggttttcattttctctttttatctttgcttaatctctcattagtacctactcttattgattgattccttctttctgctatctttgcatttaatctatttttaaatttttaagataaaatatggcacatttattttcagttttctatcctttctatgaaataatgggtacaaatttttctctattattttagctggatctgtgagtcttgatacggagtgttcattacattcaatgctaaatatttcatattttgcattataattttttactcatgtgttattttgtttccgaatatatgctttatttacccttttcacaaaaagttgttgattataataaattaggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactcttttgtgcctgtggtataatacactatcttatactctcaagcatttcaatacctcttccagtgtttctagatcactctgtctctctcattcacacacacatgcacatgcacacacatatacttttacacatgcatgcacacacatacatgagcacacacacatttacatacatgctcacacacagcacacagtgggacagtctgttcacaaacactacagaacaaacttccttgtctgtaggaagatatgtgtgcacctggcctctttgctgttcttacgacttgcccttcccaagttatttctactttacctctgtggttcgtttgatagaatttccagttaatgtattataagttataatatgccttttctggaataaatctttgctttcaatagatccattcactcctttccagaaatgatcgctgctttttatattctccttggaaaaacaaaagcacctgccttgacccttgtcttcaatatcacatataaccatacaaaactaaaaacaatccattcatttattcctttggttaatagatttttgttgggcagctatcatgttgtatgcggtgtgttagatgctgggtatgttctatgaaacaaaatagtctctgacccctggaagagaaagaaagaaagaatatccctcgccttacctttcttgacccatagtccaactgaagagagaagacgtctgttaattaactaacaatattaagtagcaaattctgagtaccaaatgagtggtattgagatcagctgcctatttgtgggctgatatggttccaaatggcttcacttgacagccttgaaattgagtcttgaaaagggtgcagaaatctaggtaaaaaatatcgatggggaggcatttcaggtgggagaaggaaatgaagaaagaccctgaggtgttacatggggtcaaaagaaaggatgattcaaagcaaggagagagcagagaagagttgggctgaaaattgaatttcctaccacttgtaggtaccaagttgtgacaatgagcttgtcatttcttgcagcacctgtcttatgtagctaaaagtctctttgagttctgcaatggcatattgcttctacggccaacattctgtctttgatagtgaggtcttacattagcattaaatcaaatgttatattgaaccttgagtaaaatctcttccaatttatgttttttttttattatttgtgtctgtgttgttctctgtgtgtgtgtgtgtgtgtgtgtgtgtgtgtgtgtgtgattgtgcacctgtatttgcgtttctcatctggaaaattctcttattcttttcccagggtttgcactgattttcacccttattcactcatctgaaatatcctttttcagtttaatcccagcattttatgtggtgctagactttggcttattggattgtaatttccaacttctaacctctcacctttgtaagacattgacactgaatcatctttcctcactctcagtataaatggtattttaactccaagctggctgcctgttaaattcatttactgtgctagagtgtatctggtaacttgcctgtgatgaatttgtgtccattattacattatagatggtttcatgcagccatctctgcaaagggcctaattatagctgtgatggccaaaactacttgttacctcgtgtcttctgactcatgtgacttgtacatgttttgacaatgaacagttctaccctccaccatggttagataaggtggaatctttttgataggagacctatattagttcagataaatgatgttgcttgttacgtacgaacacacatcactttatctcgttagcttgggaaatggatacgggcagagtgtattattcattttatatctagtgctgagagaggggcacttcacacaaaatagtggttcagcaaatgtttgtgggatgccaaaaaagcccccacaacaaaaagtggacctctttggttatccaagagagatgttttgtcttttggttctagaaattttttcttgcttcctcatctctcatagacatcctagaggagtgtgtgcatgtgtgtgtgtgtaatattaagcaaccagccattctttaccaatagaagatatccttgtttctaacaatgagacttcttctaatagtgctaacactttatctcatgtatgttatttattttttgaagatatagctttgcattttggaataattggagactcacatgcaattttaagaaataatacacaaagatcccatgtactctttgcccagcttcccctaaagttaacatcttgcacaactatagtacaatatcaaaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagcccaatgaaaggtgtttaggccatggattgatactgattacaaaaacagcttgagtctgtgagcttgctgtcttgcccttctgccttcctccagagacccttgacagatgtgggccccttgatcttaagctttccagcctccagacctgcgagccaatagatctctgttcattacaaattactgagactgtgatatcctgttttagcagcacaaaaaggactaagacaccaccatagtcaagatacagagcagttctgtcatgaggacccctcgtgatactctgacagccacagccactccttccctccctaacccctgacaaccatcaatctattgaccgtctctaataatgtcatttcaagaatgttatataaacagatttataaaatatgtaaccttgtaagattggctttttctgtttagcataactcctgagatccacccaagctgttcatgtatccatagcgggttcctttttattgcggagtaatattccatggtattggtgtaacagtttaaccattcactcatttatggatatctgggtttattccagttttgggctattacaaaggaagcttctataaacattcaagtatggtatgtgagtgtaagttttcatttctctgggattcttgtctatgaattcaactgctgggttgcgtggtgattggaagtttagtttattaaagaaacagtcactgtttcccagaaagactatgccattttccattcccaccagcaatatgtgactcagtttccctctgtcctcatcaacatgtggtgttttcattatcttgtattttaggcattctaataggacttgtcttattgggcttattgtcttatttgggctactgtaacaaattaccatagactgagtagcttcacagaagtttatttttcacagttcaggggaaagtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctgaggtcgggagtttgaaaccagcctgaccaacatggtgaaaccccgtctctactgaaaatacaaaattagccaggcatggtggtgcatgcctgtaatcccagctactcgggaggctgaggcaggagaatcgcttgaacccaggaggcagaggttgtggtcagcagagatcgtgcaattgcactccagcctgggcaacaagagcgagactctgtctcaaaaaaaaaaaaaaaaaaaaaaaaaaaaaaaaaagtagatgaagcaagttgctcaaatcagacacttgtttgagtcacaaaataatcaatggtagagctttgtctgcaaccctacattactccctcattgttttatgttgtcctgattaaattgagcttctaactgataataaaatctattattcccaaaattgggccacccattccccaaacgtcctaccttcattctagaatgtcaaacacaagccacagctgagcagcaggacctccatcagcatgcaaccacatggccagccacgccctgcgccaagcctccagatggagaggatttggtgggaaatcatttctgctgctttccgcattccgcatacagtgtcttcttttaacatggcctcttgagagccactctccagcggcagcacggccagcctctgtgcctccactctccaccccaccttgcccatccacagctgtcttccctttctcttctctctttgcagctattctcccttcccaatccagcacagcagtgtggctctccttcctgtacactggtctcctattttcccttctctcatcacataaatcaggctcacatagggttagcttgcgttagcttcttttaactggttgttctgttggttttaattttcctatttttgggattggtttaattatgggaggagttagaggctattttaatgaaataattatggaattagcctaggttttttgaaagaaagaggaaggaaaggtgtgttccattctgtttgcattttttcttctgtatcaagctttgatgtagctttttttccaggcagaatttaggtgcaaatggaaaggtctcaatctgactcaagtcagagtactgtgtgtggttgttctcaatggtttattaggttttatagctctgttttcttttcttgacaaagttatctcacctttgcttgaaaaccatgtttctctgaactatttggtggtttcatgattgcttgtgcttaaattaatgtcagcagcaaggcaatcagtagaaacttcaagtttaaattctcctgaaagctaactttaaatgttaatgtttcatttaattgaagcattctgagatattagcattaaccatttagagcacttttattagataaacggaagaagggagaaggcctaattattgtaagtcatttctgttagacatttatagagaacttgcctttgatgagaaaattgcaaaagaggccaagtatgtcaaatgttgttgtcttccaattcccatttcaatgtgcaaactaatcattcacttccctcatgggaccgctgtgagtttaactgggcaaatacatgtggagtccatgggtgaatctttcattcagtgcaggctacgttgggcgctgtggtcagctggaggcccctatttgacaagagacggtcagaacttagtgtgtgttttctggggctgttttgattttcctgtacaggagagttttgcagggaggcatattgggctggaaatcaaaaggccgtggttcttgcccatctttatcatgggtagatttctggagccagaaccagagccaaataacttcctgacctgcaaaatgaggaggcctggaagattatcctaacgagcctctttgctctgtagttccagcaattatatgtattctgtgaaaagccaataacgtgcaattcctgatagtgaaataactctggagcccatgaactcatgcttcataggccagccctacagattaggaaatgggtttcttcctagggtttttattcaccgtacaatactttcacattttctttccaaatgactattaatcacatattgaattttaaaatattataatccattttccctccagtttttgtggaaaaaaatgtatacacataacgtttattattttaaccatccgtaagtaagtatacgattcagtggcattaaacacattcacaacgttgtataaccatcaccactatctatacacaaaactttttcatcacccgcaacagatcccaatgccttttcaacattaaatactgacttccccttcccactgttaccattcacaatgttgtgtaaccatcaccactatctatacacaaaactttttcatcatccacaacagaaactctgtccccgttaaatactaactcccctttcctactcttaccattcacaatgttgtgtaaccatcaccactatctatacacaaaactttttcatcatccacaacagaaaccctgtcctcattaaacactgactcccgcttcccactcttcccagccctggtaagtctccctctgcctgaattccccaggagtttgcctattccaggtacctcgtacagtgtctatctttctgcatctggtgtattgctcttagcataattactccccctccagttttaggagaagcttcttcccaaggagatttttgataagaacaggaggcggccagctcagcttcctgggatgatttgggtacagccccacccagatgtctctaatttggcgttatcagagtcagtcaccccactgaaaagcccgcctacccatgagcttgggaagccctacatttacaggatggtcagctgtccccatgcccaggagtggttctgtctggagctgattcacagctccatcccctagaaactgtaattcaacaggtcttgggtaagatttagggatctgcattctaaagacagattccattgatcccagtgccttttcaacagtgaacactgtcttctgcaaacagctcacaattgtccatgaaattttgagcttaaggaagttctaacgcccccctcccctcctttatttttgagttgaaagagggtagaatcaaaaacaatactgagaggggtctaaaaatgcaaacacagagagttgctggtttaggagggctgggaggctatgggagaccataggcatagagaaaacattccttctctgtgactctcgggcgcgagcgaatccccaagggggtcaccagagaatcatttcctctttgggaatacaacatgagatggttctttcatctggacctaggttcaattaagtaaatagagcaaatacaaataagagaagaaaagcagcacaaacagtgaaactaggtctttacatacctaaggaggagccgtgagcattcgcctccagggaaccacagtgacgggaaacatgctggaatgttaaacgttccatctcatttgtaggaagcagatgcctacatcttcaaattttgtcttcttaaaaatattattttatccagataaaaatctataacctctagcaaagaaaaaacaacagctgcaagttggagatcatgaactgtctttccaaagaatctccacgtgtagctgatgtcagatgccatcagcagtcagccttcatcaccccaacgccaagtatttgttcagtttctgctccatatgaatgcatcttggatagaatgtgtttggtttggcttttaagaaggctcactgacttagcccatgacctaaagcatatacttaccaagccttggaattcctacagagggccctgcactttgtgtttggtacagagaccaaaaatacaaacccagctttgaggacagaagggcagggaagcaggctctttatgctgtgagtctctcactccaccccatggtccactctggaagcagaagaagtttctttggggatataaaatgtattgttggcaattgtttttgtgtgcagttaaggatcctggaattacagcatctaatgttctaactctactgccatatccatcttaggaatagaaatgcaattgcaaatggcaatttgaggtaagcaatccgattgtgcgaataggtcatatcagatggccaggaatcaagggtcatctaatgagactcactgaccacaactgaaatcagccaccagactctattttctctctgacaattgtgatatggagcaaagaacttcacctcccaccaccatccctgcccgttggtgactgctcgtgaacatttggttgatggatggacaaatgtatgtgtgaacaaataaattaataaatatgtaagagtattggttactggagtatgtattactagagaaataagcaaagacctgctccatacccttcccccaagaaaatagcaaatcattctcagttggaagactaaagagaaatgctagagtccaggccaatggaaaacaagttaaagacagaaggtttagtagcactggaaaacccaggaggacaaagattctccaggtcatcgggaggcgtcgtgctttttttcatgggaaagaaaacttgacccagagtggcttcattaaagaagggagagggacttcataagtgaccagtcgagagctaggccataggggctgcagacccgggactcaaacgatgtgcaaaggcctcagtttctctcttggtctctcccacaatgctgtctgctcacacaggctttccccctttgcactgttgctggttgcattctcgctctttcccccataaggctattaaagttgctgctggaaggttccagagctgtatgatcccggaattgtaccctgtgaaaaagcatagctgcttttctcacagagtaaagaggtccagccctgagttattttgcccctaatgggtttccagggtcgtgtcctttcccaacccctgaggaagctcagcagagatgcttcaggatgagattaggctcactgagcgggtgaacggagctgtttgaactgaggtctcagggagaccagccctctaactgcagcgagctggatttcagacccttcctgtgcacacacactgttgcttgcccagacatgcttcccctttgtcttgttagaccattgatttcctttagaagatcaaaatcagggtgcaggtaggagccttagacaatttctagtttgactctcatcatatttttaatatagccctgcattttcctcatatgaaagcagaaacccacagagtttatgatgtgctcagagccacgcacaggatcgctagaagccggggccacagcccagcttccaccctcctgatggggaccatatccatgtgctgctcttacatgtactgaaaactcagcacatgcctactaaatgctctgtaggctttatctcattttaacttcacttactcatgtaatctcagcactattatcatctgcatgtcacagaggagggagctgagatgcagagtatgtttgtgacttgcccagagttacacactgatatggtttagctgtgtccccacccaaatctcatcttgaattgtagctcccattatccctacatgttgtaggagggacctggtaggaggtaactgaatcatgggggcaggtttttcccatgctgttctcgtgagagtaaatgagtcttacaagatctgatggttttataaagggcagttcccctccacacattctcctgcctgctgccatgtaagatgtgactttgctcctcatttgccttcagccatgatgatgaggcctccccagccatgtggaactgtgactccattaaacctcctttccttgtaaattacccggtctcaggtatatctttattagcagggtgagaacagactaatacgcacataccatcgattggcacagcataggcactccatgttcatgactccaaagggtaccatctaccacctgttaactgcctactagtatcttcaaatcaacgtaagcctcgtagcgttacctattgctgccttgtcctaagcaatcatgttaatggtatctaggttggatgagctacttatatcttttcaattatacaggaaaaacaatggaaaattgtgataatgaaaagaatgtttgctcacaaaccactgaagatggcttcacctgccaccagtgatatgtgaacacacttatgaaactctcacctatattacacagccagggaggctagtgtatttgtggctgatgagggatcaataagcttatagcataacaatacaggtaaaaatttgtgaaagagccctggtcaccttcagggatggaattgacagcagaaagcccacagcaccaaggttaagtactttgttttgtgtgtatttatgtgcagaaacatagatgtgtatatgtgtagatatacaaccacattatacgttatacttagaagtgcgggttgcatacgccactgcacattagaatcactatacagaatccagcaaatcagattctctgatggtggggcctcaacatcagtacttttttaaaaagtcccaggtgatgtctaagtggagccaggtttgcaaaccaggtacctaggatagaggttttcaactcttggtgtgctcacagagaagcacttgaagtatctgcacagctttgtcaaaatgcagattcaaagcctcaaagattctgatgcaggtaatctggggtggcccaggaatccgcacatttcacaagcacgttgaatgattctgatgcaagtgaagggtctgaggaccacgccttgaaagctctgcacagaccccagctcctctagaggacttgcattgccatctggtgaggactgaagacccacattagctaattacatcagtatttttaactctgggaaaatgtaaaaagaatttagcacccagtgtaaatatggaaagattctttcttaaatgttcagtagaggaccctgagcatatggtgactatatagtcagtagcgactgatcactttttaatgtcagtttcatcgtaatcatacggcttccgaatgccacacattaaaatgttaggtccttttcttcccaacccaggattaaaattcatctcaaaggcaaaacatactgtgatttctcaaatgtttttggaactgtcaaaaccagaggatatatttagaggcctttaatgtagaacacaaaatttcactacacgcagaattgccaattaggatgggaggctcagaaatgatcttaatgacacaagtgtgcagtgtttttttccttctgcattacatgaataatttcaagggtgttttcactctgaatgagttttttttcctccatttggcactgcctgtggagtcctctctatagcagaggtgatgttacgagctgtaacgacgtccccgtcagcaagtagcacatgcttttccattagttatacttccataccttcgtttgcagttttgtttttacatacaggattgaaacaaataccagatagtacttttccaaattgttttggtggactcctccccatccacagcggcagacaactcacattaaatatgaagctttcaccacatacaatcagaggcctatcaaaatagcttcaaacttcaaattaatgccattttaggatcactgatgcttttctttagaatgccatacacttgaaatcttctaagactacaagaactgtatggacatttatagctgaaaagaaaacctatttttagaactcagagctgaaaccctacctcaatactacccctatgttttcaagagttcctgtttcccaatgctagtcaactctgaacctgaattttaaaaattatttcctctctgtttcctccctatctgagaagtcatttatttgatggttttagcttctactggcaactacgacatgatttggaagcctgctaagaatgagtctataatatgtttatgtcatgtattaaaaatctccacggtcttataacttaatataaccctatgtgtaattagttgaccgagagtccttttcaacattgattttgatatatgatttctaatttatttgtttatttacttatttatttttgagacagaatctcactctgtcgcccaggctagagggcagtggtgcaatctcagctcactgcaacctccgcctcctgggttcaagcgattctcctgcctcagcctcccaagtagctgggattacaggctcatgccaccacacccagctaatttttgtatttttagtagagacggtttcgccatgttggccaggctggtcttgaacccctgacctcaggtgatccgcccaccttggcctcccaaagtgctaagattagaggcatgagctaccgcaccaggcctctaatttttaaggttttaattctaggccgtaattttttctcttccaacatgataaaaagggtcttcccatgcccttctcttggtttctcttccctcctcatgcctaccgtttatctgtttccatgacctccctgcccacctcaagtcaggtggcacttcaacctgctggcaaacagtgccacccaacactggcacatgagtccatagaatgtctgggaaaagaggcttgtcgtaccatgtgatgtaaagtactaactgtgcaaacgtgcggcactcaacaattttaggagctttgtgattccttcttaatgatgtgcttaatatatttcccccaatgattgcttattttctctggttttaccctcctttatcaggtccttattgaatttcttcttttcctagttaaactggaaaagtaacttattactctgccaggcagtaggatcactcaccaagagacggtaatgagggagaccacatagcccagttggtctggtgatgcctgttttcccaacatagttattaatagcaccactttcactttgccactttggatggcaaatgatatagcgacaatggcactacatttgctactggcagctcaagaagatgttacagaggctggttttgacggaatcacatatgccagatatgtggcatatgtggaaatagatgggaattatgctggaaataggtggaggcccaattgaccctgcttgctcctgtttacctgtagcctctgcttttctgcttcagcctggaattgtcacagaatatcccagacctcctagtctgtacagggtctggttggacaagacccactggctttttagaattactccggaagtcctggcttgctgatcagaagacttgattcttccagaaagaggtagccaaggagacagaaaacaagctggaatcagagcaagaaagactatgtctaccaaacatccccgtctcttcctactctaactgtagatacacgtggataccatagcagcatgaatgagaccaacaccatcgaatgaccattaaatgaatggtcattcgtttatggggaagcagtactgcagggattatgaggtcttatggtttaaagtacagcacacatggaccacggtcccagccagggcagcctgctgtgggaatctctctcagcagatttttgcctgttagattccagaaccttctctggtcactttcatccaatctaattgtctgtcttacccaagaagggatttgttacaagggacttggtggattaagctaaagcaatcttaaatgcagaatgccaggtttctgatacagataatcaatttcagttgctgcagaaaactctgttgggggtgatggagagaatgcactttgtggacccgtctggattgtctcctagtcttgtatccaggtggcactgagcctcatcagtggggtccactctgttatttcctggcctttacttggtgagataaacccttcatgttcagcagccttgtaacagtttgcagaaaagtctccagcctttgcttatgtgttgggtgcaagtctactgatacatcctgagggtgtatgctgttgccggtgcgttgcactaaatgcctgctactgaaaatatgcccagggaatatttctctttatatctgtggaactttgtccatcgctgtgctggaaacaaactattccctgggcagtcagtggtgcgcttttaattctggcctgtgtggtggcagtgggaggggcggtgccttttgctgcgtcgggaacctcttgatcccaccagggtgagctgaaagaccttgaatatgatacttcaaataataaaaatgtatgtgtcaccttggatctgcccagaaaaggggagaggattttacaaacacacacacacgcacacacgcaacacgcacacacacacgcacgcacacgcgcacacacacgctgacacacacgcacgtacacgcgcacacatgcgtgcacacacgcgcacacacgcgcacacacacgcacacacacacgcacatgcacacacagagtcattcaggaaaaacaacaacagaaaacaatttagcacatttttggtgctctgaaaatataaattgggattttatctaccaatattaccatttatcaagttataactatgtatagcatttaattgatataaatacacacagcataaacttaccccaaagtatttatgctttaaaaatttatttacaaataatctgggagaaaaaggtttatttcaaaactatatagagggctgggcatggtataatcccagcactttcggaggccaaggcaggtggatcacttgaggtgaggaattcgagaccagcctggccgacatggtgaaaccccatctctactaaaaatacaaaaattaggccgggtgtagtggctcacgccagtaatcccagcatttggagaggccaaggcgggtggatcatgagatcaggagttcaagaccagcctggccaaaatggtgaaaccctgtctctactaaaaatacaaaaatcagccagacgtggtggcgggtgcctataaatccagctacttgggaggctgaggcagagaattgcttgaacccgggaggcagaggttgcagtgagccaagatcacgtcactgcactccagccagggcgacagagtgagactccatcttaaaaaaaaaaaaaaaatcagcttggtgtggtggtaggtgcctataatcccagctactcagaaggctgaggcaggaaaatcacttgtacccaggagacagagattgcgccgctgccttccaacctgggcaacaagagtgaaactctgtctcaacaaacaaacaaacaaacaaaaaatatatgcagagaagagagtacttaggagcacagtgggagggtgagatgtcagggctcagcatctgcttccgaagttgtcaccaggcatttgttcagggcatgtgggcactaagaggatgaccccgtggtggtcaggtaccttgctgctctgcacacaaacaatagaaagcaatggagcccttgttagaaacacatatttctaagctccaagcctggagcctaggaaacagtgtctcccaggaagaaacctgttaatctgcaccatgtcagggaccccaccccaggattcttaccagtagtgatgggtgagaaacactggctatgctaacagaagcaggcacacagcggccccgtcttcctcccatctgtgagcatgcttcagggctgagcatatgaccaacattttacatttcagagttggctcccaccttaacacacacaacaatgtggacaccaccataaactgtgacatcaccatcacccggacaccagtgggatttatgttgtgtggattaatggccagtggataaatatacagcaataccaaggggcaggtcaacagcttaaagattaggagaaaacaatgagtcagaaactgagcaggtaatcatcagagcatccgtgaataatctgacagactcctcagtcttccacatgtgcacgtggggcagaatgttgacatccaagtgggcatggtaagcagctgatgaaaagttaaggatggaaactttaggcttgaaagtcagcaaagtgaagctgacttgccaagaataaactaagcagctatgtggcatcatgcagatacacacacagacacttttttttttttaagatagaaggagaaacagcaggagagggaagaagtggaaagaaagatgctgacttgactggactcttcactgctaacctttggtgaaggataagtttagacacaggctgcctacatgcaagcatagagatatttctagtgtgccttcttataaaggaagcacaggtagatgtttgtctttgtatggttgtaattaagcgccaaatgatgtcctccattcccttagtgacctaggaagagaaccagctgtgcagcaccatctctttgtctgtttttggaagtgagcccaatgcacttgaccctcagtgctatgagggaccagggggctgacaggtgaaatacagcagggaaggctgcaaagaagccccaagctgctgcgggcagggtgtgtgcaaggcgcacggtacagacagacccaccctgtgtttgtggggcaagccccctgtgcctttccccctctgttgcctctttcagctgccctcagtccttcccacaattcatcccatctcccagcacctgttttggatttggagccagtatatgcaggagagaaaaagaagacagtaaatcgagcaagaaaaaggaaaatgttgtattctggagcagaattacgaatgagtcagcagcaaggtctgacaaaacaaaatacaaaggcagtaaagtaggaggttggctgccaggctggtgtgaagctcggatacctgtttctcagtggccgccagtagaagacagggatatgacaagcttgggaagaaagcaggcatgctggtgtgcatcctggaaaattagttaggaggaaattctcatgggtttcttcctttgaatttcctcctagcaatgctatggctgatttcatttgtttcccagaagatgagctgaagacacataggagcagctattggaattgaaatgtccaagtggagactgaaggaaatatatattttgtaattactcagctatttctggatgtcacagatgtttttgaaacgcatatttggaaacacagttgaaatcacaagtgaaatttttattgttcatctcctaaatgtaagctttttattttatttagaggcatcctcggttttaatcatcttgttatacttagatgttctcctcttaacgactcattgcaaaaagaaggcattctatgtgaagggtacagagaatgcgagaaacattctctatcaatgacctgaacaactagggattgatcagaaaagaaggaactaaggtataatagcgttgggtgtggtatggaagtagaagtcgtttgagatacatatttgaagaagctacaggttcaagaagaactcaccatttctactctcttaaatgtaagttttgtgaaagaccagtgactactataagttagtttattccaggaggagagaaagagctgagatataaatactgaatcctaaggatttgtccattatttttgtgtttggaatctgacaactgtatgtcttctatattttaacccttgtataaatggttgcagtaaattgcctagagcagtgaaggaaagatgtgcagccaagggaaagatcaagaaccttcggtttacatggagctatttcctaatatttgttttatgtcatatgagctaaacatctttaccttttactaaatatttcaaattttatctggggtccattagaaattttttctttttttttttttttttttttttttttttttgagacagagtctcactctgtcaccaggctggagttcagtggctcaatcttggctcactgcaagctccgcctcccaggttcaagctattttcctgcctcagcctcccaaatagctggaactacaggcacccaccaccacgcctggctaattttttttccttttttttttttttttttttgagatggagtctcgctcgctctgtcgcccaagctggagtgcagtggcgcgatctcggcttactgcaagctctgcctcccgggttttcgccattatcctgccttagcctcccaagtagctgggactacaggcccctgccaccatgtccagctaatttttttttgtatttttagtagagacggggtttcaccatgttggccaggctggtctcgatctcttgacctcgtgatccacctgcctcggcctcccaaagtgctgggattacagacgtgagccaccacgcccggccttttttccttttaagtcattataacaagacgtttaacttcatgcaaatggtataaaatatattggcaaggagtgcagaaatgtttgccaaatatggtcattaatatgggggtgactacgacctgcttgagagaagagaagggaagacttctctagggaggactgattcattcaggaagttttccatcatccttcaacttccgcatcaggacttacagttcactggaccatcagccacaggagtgggcccagacaccagacaagaagtcagaagttttggcaagatgccgggtctttgggtgagtgcccagtgagaggtacaaatgcaacaggagtctgacgccatggagggatgtgacttctgcagaatcttgggaagggggcagtgtgggttttgcatgtgggagggacttaaataacttttatcacagccaaatgtgacatgctaaggcctgaatgcatttattcatggttcaggcagctgtagccaacaacaagaagcagttaaagttatgtacccactgagagcagatagcggggaggcagaggtcagcacctgcttgcctgggagctgcagggtttctgagcgggaaggaatgttagtggttgctggttccatctcaccaattcctgcattcctgcattctgaatgcaccaacaaatggcttccatccttctattaacaggggctgttgagccttttcagtgttgaagtatttcagactaccaaaagacagtttcatggttctgaaatctatttccttctaatgtgtacttgtcagccttattcttcccatggaagcaaaagagaccaggcctactgacatgcatgtactcatgaagttctctaaaaccttaaagacatctatccctctcccccgggtcgtctcttgtctgtgcagaatacttccacttgctccaagcatctctcaggtagctttgtttccagactcagccaacctggtcatcttctctggagtattttggcttattggtctcaccactagaaaaaagtgacaccctcaactggacctgttacttcaaatgttaagggagaaggttttagacaagataggacaacatgtcttcccagaaagaccttatgagctgggtagctcttgtctccgcccacattattagagatgagctcgtttattttaactatccaaagaaggatctgggtggaaaatggggaaagtctgcttctgcctcccctgccctgaatgcccacctgataattagcccttccacaaagcgagtccccaggggcttcctggaagcacagcagctgctacatcgtgcaggaccatgacagtggatggaattaattactaaaaccagccaagaccaagattaaggaagataccatgtaaatgtggcaattcgcgaagtatttctgaaaaatgaggcatctgtttcctggtctcacctctcctcatgtcaggtgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacacttcattttctcattttcctcagttttagagccaagaaatagaatattttccagcttctttttggtgcttttatttttttccttcaggttttactttttttcccttctcacccctgacatctcatgcagataactttccttttttttctcttttttaccacccagtctctaaatctcactttcttttctctgtctcatctgccttttctctgtgttaacttttccagtattttcagccttgcttctcattatgttactatattgtgtttctttaactgtgtatgccagccatggggttcttgattctagcttaagaaaatctgactctgggctcatctacacctcctgttatttttcacttcctctttgaatggaattgtaggattaaataaggaaaggactgtggaggtcccctgaagcaattttcctgcaatgcatgcacccattccagaggactccagtggtgcttcgagcccctgctcatatgctatccatgctggggagctcaccacctcagggagaccatccatcctcatacatgctctaagtggactgcactaatgctgaccagacacccagtccaaaatcctgggtaacaatctcagtcattgaaggcagctgcaactctgccattcttaatgggattccggtttgccaagagccccagagagtagaaaagtaagagtttcgtggactctacacaatgctggtaactagatcatgcaattctcagaatttagaaaagagtgttttttattcctttcttgtgatttgaatttcctcacaacccttagccctgtattacacaaaaggaaactgaggctcagataagcaacttgtgcaagttcacccagcaagtgaataacaggctcagatgacctctgcgccttactctaaaactgcctaatagtagtagctgtgtcctactccagagctacacctagccaccctcttctgctggcctcagcctggtgcattgttaggaagggaatatctgaggtgatgtggaggagggaggggagcacaggcaggccagacaggggcaactttggctactccagcatcccaaactagggccgtgctagagggtagaaaacgtggtgtaaatttaaggggcattctcaagttacaaagtcaagtgaaacttggtaatcatgtttacatggacagtaaggaaaataagcaaggggaatggctgatgcgaattccaatatttttctgtggaaagaccaggtacatggaaggaaacagagaattctttagcagaaaaagaatgtatctctctaatgcccagtgatgatgagctttttttcatgtttgttggctgcataaatgtctatgcagccataaaacaaatgagttcatgtcctttgcagggacatggatgaagctggaagccatcattctcagcaaactaacacaagaacagaaaaccaaacaccacatgttctcattcataagtgggagttgaacaataagaacacatggacaccgggaggggaacatcacacactggggcctgtcgggggatgggaggcaaggggagggagagcattaggacaaatccctaatgcatgcagggcttaaaacctagatgacagattgatgggtacagcaaaccagcatggcacatgtatacctatgtaacaaacctgcacattctgtacatgtcccagaacttaaagtaaaatttaaaaataaaataataaaaaatttcacctaaaaaaaagaatgtatttcattttcaaaatattgaatttggggttaaagtttggcataaaaacatccatgtggaaaggtccagcccaagctaaaaatataagtttagaactcagaagatacatgaagcataaagacgtaaattcagtaggaagctgtgtcagaaagcagaaatgatggggacctgccagaccaaggcttagaccagtgaggaaggagcccctgggatggcaggttggtgcctgccttccattcgggtctgcagcagcaggagagaaaggtgaagagcctggatggaggggcaggaggcgaaggagagcaggtcctggaatcaggaaaggggaacagctcctgttgccttcatcacgtgctgcaggctggaaatcagaaagatgccacgtgtttggtagataagggttagctgggagaactcattttgagaatgctaggagtatattgcagtgggttaaaagtgaatagaaagtgagccagtgaagcagtgtagactttgcttgtgaagggccatgatagttacaagaaggaggctgggtgcagtgtctcatgcctgtaatccaagcatttgggaggccgaggcaggagaatcacttgagcatgggaggcagtggttgcggtgagccaagattgcaccactgcactccagcctgggcaacagaacgagactctgtctcaagaaaaaaaaaaaaaggaaggagcagttccaagggaatatggccagaggttttttgtttgttttgtttgtttgtttgttttcaatgagggagatttgagttatattctacagaattagaagaagtaataggggagaatgagtggttagaaatgtaaggcacagtggagaagttgttaaagttcaacaagaagcaggagggtatgagcttagtcttgcaaaggaagatggcagtttcaaaacgtcagccggattcaatttaaagcttaattaagcagtgaacaatttgcaaattgggcagcctcctgagccacaataggctctgagactccagtgcagccccatggtggtagaagatttatggacagaaaaaggaaagtgatgtacagaaaacagaagtgagggacagaaacagctggattcgttacagctcagcattcaccttatttgaacatgcttcaaacaattggctacgtttgattagccaaaacttggtgattggcgcaagagtaggttatggtctgtttacacctccactggttataattcacaatgtgcagagaaacctttaggctgaacttaaaacatgtaaggaggcagctttaggctaaacgtgacttaacggtagcttctttgtaggagaggaaggatggaggagaggcctgacttagggcacttgacctaggaaggaagagtagaagatggatttgagaaagacttagaaagttactgattagaaattgggcgctatttgattgaattggagtaggggaagcaaggggtcaaagaatggagggaaggaaaactacattttcaactcagcttactgagtgcatgatggagctaccaactgagatagggattatcaaaagggagcaaggtttgggggctgctgaagagtttattctggagcaaattgagtttttggtgcctgtgagacataggatgcagtcatctgatatattggtctgtagctggacctgtgggagttactgatatttaggtaatttaggttacggtttaaaatctcaagaatggaagatttcataggggaggaggatgtaaagggagtagatgagtggccaaagaaaaaactcagtgtccacgatggtacagagaaagaaaagaccttagaaatctaaagtatgggtccatcggagagaaggaggggagagggtagaaatttcctgactagagggaaattttagagagataagaagcagaccaaatatgaactcaccctgtgacaaatcctcaactgctttctaaaaaattattgaatgccaatgtcaactattttgtgtgtaatatattaaaaaaataatttgctgaaactgtttttccatcttgtggatagtgttttgggaaataagttctcctttattcattttccaggagagatattaatgtaatgctataggatgagactaaaataactcatattcatgaacttctaaaaaatggcactcttagaaaaataactgaaagcagccttactaatttccaatctttgtattttttatgatcagaaatatttagtctattttattttttatttttatttttatttatttattcatttagtttttgagatgaagtctcgctctgtggcccaggctgaagtgcaagggcatgacctcagttcactgcaacctccgcctcctgggttcaagtgattcttccacctcagcctccggagtagctgcgattacaggcacccgccatcctgcctggctaatttttgtatttttgtagagatggagtttcaccatgttgactaggctggtcttgaactcctgacctcaggtgatccacccgcctcagcctcccaaagtgctgggattacaggcgtgagccaccactcctggcctagagtctattattttaaagaaagaaacataaatacaacattgaccacagaaaaagaaaaagactttatctctctaaggaacaaattctttcagtgagatgcagctttcttagtgcctttctagataaaacattgtacaaatgaaaacgcttcaatttgcactctttaaacagtcattccctttgtgcctgcagttcttttggcttgatgttgaggaagattttgtggaagacaatgatattttattgcttcatcttggagcaaggagaaaattgtttctcttcttcccacttccccattttttaagagtagtgctcgagtcacacttgcacttccacgctgaagccttctatttgtatcaacagtgtgttctggaatgccactttcacattcccacacttggcagacccagcttctcaggttttctctatttcttgactttattcatttttgtttcagcctttcttttttttttcttttttttttttaattatactttaagttttagggtacatgtgcacaacatgcaggtttatatcatatgtatacatgtgccatgttggtgtgctgcacccattaacttgtcatttacattaggtatatctcctaatgctatccctcccccctccccccaccccacaacagtccctggtgtgtgattttccccttcctgagtccatgtgttctcattgttcaattcccacctatgagtcagaacatgcggtgtttggttttttgtccttgcgctagtttgctgagaatgatggtttccaccttcatccatgtccctacaaaggacatgaactcatcattttttatggctgcatagtattccatggtgtatatgtgccacattttcttaatccagtctatcattgttggatatttgggttggttcctacccaaaggattataaatcatgctgctacaaagacacatgcacatgtatgtttcagcctttcttataggcgattccattttccagatattctattctagtccccatgcatacattttggttttgatttggtttggtttgggggtttcttgcctaacggtacagacgaacaattaaaagcagttctctcctcctcctcctcctcttcttcctcctcctcctcctcttcctcctcttccccttctccttctccttcgtctccttcttctccttcttcttccttcttctctttcttcttgccatggccttgatagggttattttaattgctctccccgtttcttatgagcaccacttaaaagatatccacagagctgaattgcaggggtgtgtagtggtatattcaaagatgaatgtaaagatgtaactctaggtgtttgttttggggatggcataaccagggaatgaatttaaatcactgtttctagatggattaaagcaatggaccttcaaccaggaaagatggcagctattcttactttgcatatttattatatttgttgctatactgaaattttcagctgacaacagcgaacacggacttctgacttgagagttacgagatacaagcttggttcaggcaatttccaagggattgtttagagagagacagaactcaggtcaaatcccacttgactttaacttaaattccttaagattttattttcctacctgtacaaataggacaataatatctgcctcataaagactaaatgagttcttgcatggtaaggagctgtcagagtacctaatatgtggtacgtgctccataaatgccacccacccccaccacccacttcagctcaccactgtcaccatctctgggacttggcttggctgaagtaatatcaaaggcttcctctgagtgcttcagtctgtgagtggtcctctcccagcccctcaccacctctgtcctgatactattttaacaaggaatttatctgtttgctttagaagttgctggaagtttacaaagaagaaacccagtagttcagaagaaacgtatctaaatctgattttaaaattatctgttttctctggatttaaactagctatattacttacctattgctgtataagaaattaccccaaactcagtggcttaagacagccaacatttaatcttgcagtcactgtgggtcaggaactcgagaacatcttagctgtgtggctctggctcagggtccctcatgaggccagcatcaagacattagccagggttgcagtcatccgaaggcttgaccggagatggggaacccatttccacatccactcacatggcttctggcaagaggcagtctaacgggtatgagcctcagactctccatggggctgcttgagtgtcctcacaacatggcagccagcttcctcagagcaagtgatatgaaagacagcaagaaggaagccacgatacctcttataagctggctgcagaagcctaacaccctcactgctactgtattctgttcatgagggtcactaagtcagccaacactaaagggtacagaattaggttccatctcttctcttctctctcctcctctcctcttccccctttctctttcctttatcctcttcttctctttctgtgcctcagtttcttacctgaccaaaggtaacttctgccccctagggatgctatgaaaacaaagtgagatcaatcatatgaaaaggcggttttggagggagagttcagaaactctatataatataccatataccataaccatggaaacctgagatcagctctgtctagcttcctgctcttgcatctgaagaagccgttccagctcacacaggcatggcttagtcacagtgcagcatggggtcctttaatgggtcctctctgagcggtgacctgctcaggacacaggagccagcaccaggcccttccttccttctcctgggcaagcagcaccactcatcccggcagaaatagaaaaaggagttaagttcctgtgttccttattagattgctgtagcagctccataaagctctcctagacagtcctgtctgttagtggctgtttctttatgactaaagcagcactttcccatctgctgccctcaaagcaaggggccccgggccgcatatttctggttcaggagtctcaagatctctgaaagcaccagattgttgggatttaagtgctgttgtttatttttatatctgggtcctgttcctccaaataactccaagaccattgtgattttcgagaagttaattcagtggtgcaggctaggtagggaatggtggtattagcaaatcctacctgttttctttgcaagctcatttccatcattggtcctccaaatgcatttccctgttcaaagtactctaccttggatatgtctgcctttgcctccacgtccctcacctattatctttagaaaggtggttttaaatgttggtcactgaacatttagccacatagggcaccagctctcagaggtttcacaagtaaaggaaagggttgggggaaatgaaatatggttcaacgcaacagagtaacccacatattccgtatgttcgacaaggtctctacccaggaggctggcgatgaaggatgctaacatttcttgaaccgccatcttctcccttcttttgggtaaccctcgaattctgcttatggttatctatggattgtggagtcatttcctggctcaggaggttaagaaaggcgtccgagatttgagggttacaggagtttggaagcactgtttttctggttttctgttacctccattttaaagccgtgatacttccaactgcccttttttcagtaagttcttgttgactactctcttgaaaccaaaagatgcatatcccgttgtacagggggtcaaaagtgtgcccaattaagcctgccttgacttcaatattgcaactcactgaagacacacagtggaatttctggtggaccccttcccataacccacagggaactctagccgtacatgggtcttactgacccgttgggtctagctgacggtgcctgatggtctccaatgaccaaggtgtcctcattagttctgtgctatatttagttaagcctgaaatctgtgcccctaatttaatcacacaccaggtagccatggagatgacatcaagcctctggctgccctataaaccattgcaaatgctgaaaataaaataaacaggatatgcaaattgacttcctaagtaaataaaagactttgtctccaggtgttgggattagctgcttttggttcactgatgtttgttaggattcacagtgatttgaaaaatatcatcgtaacagcctttgtctcaatgcctaccttttttcctttttgtctgttgcagatatatcaacactcgtatactggatattacgtcctgagcaaaattcctcatgggtaagagtgttcttttctttcttttaattagaaatatgcagggcaaagtgaagggtagaacatggacgagctgtttaacccttagggcgggaaatggcgttccagttctcacagccaagggtgctggtatcgtggcacctctgggactctccctagataatgacactaaggatgtcagggggtcacttgagtccactcacttccccatttgtgaagcccccttcctagagcaactctgccctcttcctgtgctggttcctgcagttgaccctggaggttcttcagagccggacattcccctctgctttgtaatcacctgcagcctcctctcaggcaaggtgaggtggcccttggcctcccacgagggttcctggttatacccacactagcagaatagaagcctctctcagcccaccacatgtcatcagagacaaatctggaacatatctatgggattacggtaaactactctggtcagacattcagcagtgcattgggaatgggttgggcaagtggtattagtgctgctctacccatcactccgagggggtttcagcggcgtgttgttcttgttttattgtcctttctgagcttggctgtgctcccagggccgggtttcagtgcctgcttttgactgggccccccggcttcattctttcatgacctcacattgcactgctaacctcatctggtctctcaataatgtattgtccagagcaggagcgagtttagttttcagtgctgggcaggcgtcccccacacgaccctcagatgcctgatcagcttcacctttggaacccagagcagaaaagacattggttagggtttggtgaaaccacatgttgagtcagacacagatgaaaaatggttgcagaactaggaaagtctgtcgaggagaattttttgttgttttatcttcattatttcttcgtctcctcttccctcctccttccctcccctattctcattcccttctcctggccttcctgttccccacctcatgtttctctttcctgtcttctgtggtttctactgtcatgctttgcaaaggtgaggtgctcaggaaaggttgataaagaaactgaattgtgctgcagatagtgtcatgtaggctcctgtgaatatctaggttgaggcatcctcatttcccaagcaaattttaacagcaggagtggctagaaagcatttttccataggtgagcattaatcacagcatgagcgtttatagctgctgctctctgttttctactcagcttagaatacaggcaagtccttggaaaacaaactcgaataaactaatttaatgtgggctttagacaaagggaagacgcatgtggatcttcagcaaattgtgaccaatagtttctgttagattattagaaaagtgaagcccaaagaaagcaaagatggcccaagttgcaaaaataaagtattcatacaaatttttcattaaaagtatgttttaaatagaaacccaaatattcttcagtaaagaggaattatcccattctttcccaagcagatatatatcttcagaggtcatggcaggcaggactataattatgccttgagatttatctgccccttctgggaacaatagaatttgttgtagatgatagatatttcgttccatcttatatcaatttgtaaaactcgaaactctaaaagcagttgatgcctaacgtattgtgttaatattttactgcatcagtcagcatttggaggaaacagattctaggaacttggcacaggagtttgctgaacaagctagcaaagctcaggccatgatagtctgtgttgaaggctcggcttctgcacttagatacctggagcctggtgatgatctgccttatagatgaccccaacacggagggagctgcttctggtgtctttaatggaatcagagcaagaataatgcccctggtttattggttagctttcatatacctttatccctgttcaacaacctgcaagaaaagcatccttatttccattttaagtgagagctccaagaggtcatcaccttcccctcacctcctagctactgtatgcttgagtctcagcgtaagtcaggctgactcgaaatcccatgctagtaaaaaaactcgtggctcacacctgtaatcccaacactccgggaggccaaggtgggcagatcacttgaggtcaggagtttgagaccagcctagccaacatggtgaaaccccatctctactaaaaatacaaaaattagccaggcatggtggtgcacacctctagtcccagctactcaggaggctgaggcaggagaatcgcttgaacctgggaggctagaggttgcagtgagctgagattgcaccactgcactccagcctaggtgacagagtgagactctgtcaaacaaaaacaaaaacaacaattgggattaattcaaaggtcacaatgcagagaacaaacgtgatagctataaagatgagattttttagtgacatactactttctcttcctagggttcttataggattgaaagatgtagcaagtacatttattggaaaacaacctctgggggtgccaaagtcagtgtcccaccctgtcaccatgtcactgaacacagcgcccctgaagcggcgttgctcaacctgctcaattcttcctctttgtcataaggccattgatgagaaattagccaattaattcattgcaaatattgtcagagtcttatttgtcttaatgagacagtggatctctgagcggtatctccgtaggcctggagcttcgtgaccccttggtcatcactgtcaccggtgtgcgtgctccaccaggtggcagaaaaagaacacagcccggagctctaagtctgaggatctaggtgggttttggatagggaggaaagcacaattgtcttttaaaaataaaaatgtccctactaaaatatttgaatatacattattcatgtagaagaaaactaagagattttcttaatttagaaaacacatatctgtacctttttcactaattctcatctttcctttcctcgctcctccctctaaattaaagccagaggccgtgcaatcttcaggatggttttgtcatttatagcttgatttttttttcttagcttcagtctttgcaaccagccagagaaaatggtctaattaatgttctcatgccctctgatttctgttgtccttccttttggcaaatggcaaaagagtttcaggacggactacccctttcccatccccctctcactccccagtccccgctgttagcttccttcctccgatggctgtgacctctatagctggggccaggtagagttctttctgtgtggaaggtgggagttgcaatgagactcccaagacagctgaattttgatataatcaaaaatctattacctaagggtaggtttgtttgactttgacataccaagcttccaaaaattgtattcttaaattgtatcctaaaaggacatatgccttttacaacaaatctatattttagcggaactaaagctagttatttttaacataaagcatttcactagaagtttttatatcagaattttaataaaataaggaatcttccatggtggagtcaaggatctgttaggtgtttccatataagtatttttgtagacttggctactgcatgacattttcctggcatgacttctttttctagaattagttttgtctttatattttttagggtctaaagccaaaggcaaaattatctatatttatgtctattatctatctacctagctttctatctatctatacacacacatatacataatacacacttttaataatagtaataatatatttctaaaatgtagtctcatatccaataggattgttctgaaagacatatggacttttttctataaccgaaatcaatttgaagaaaaattggtcctatcactttattatgtaatgttggcaattaggggtctggcaaactcagaactgtaatagaatagaaactgctgggtgttcaaaggcatttttttacgtgactggccatgttctgtggatattgttgctctaactttgcttacctactcgtaattttcaggcaccaaacaaaactgtgaaaaaattgtgttcctttagaattgtagttgactttttaaagccatattctgtatctgtggaaataggaaactgagacatcacttccttctacctggaactgctctctaagtttatagactgagatccagaggagcattctgtttatttgggaagtagatatctaggtcgagaatgtacagtgcccagtgccagcctaatagcatcatgccaggcagtgacttagaccctgcagccacatagacctgaacttgaacccatcgtgctgctgacttctggttgtgtgaccttgagagttgttctacttccataggtcttaggatccatataagaagatcataataatagtgcccactttggcctggcatggtggctcatgcctgtaatcccagcactttgggaggccgaagcaggtggatcacctgaggtcaggagtttgagaccagcctggcctgttgcaaaaccccatctctactaaaaatacaaaattagctgggcatggtggcgggtacctgtaatcccagctactcaggaggctgaggcaggagaatcgtttgaacccaagaggcggaggttgcagtgagctgagattgtaccattgcactccagcctgggagacaaagcaagactccatctcaaaaaacaaaacaaaacaaaaaaattagtgcccacctcataggcttgttagaagaattaaatggaatggctgggtgtggtggctcacgcctgtaatcccagcactgtgggaggctgatgtgggtggatcacttgagttcgagaccagcctggccaacatggtgaaaccccatgtctactaaaaatacaaaacttggccgggcttagtgaggctgaggcacaagaatcacttaaacctgggagtcggaggttgcagtgagctgagattgtgccactgcactccagcctgggtgggagagcgagactccatctcaaaaaaagaattaagtggaatgatatatgcaaaacacccagcaaagaattttgcatctagtgagtgattagttaatattgtagtatgtacccaatatatatttgtagtcttataattaaatattatcagactttagtttctagccatcttgaaaatcttttctgttacaaatgaaggaataatataatcctaaaatcatacaattctctttaataatttttctaagctgaggcttgtttcatgacactcaggtaattataatgtctttgtaattttaatttccctcttaaaagaagtatctatggcctcaactgtctacaattctcaatactcaataattttttttatatcatctcattctgaccttctgcaattaactttccagcattcttgttttgcctccaatggaagcagaaaagatactgtgtcagcaaatacttattgaaatactgtctggagcaatgaaagcatggttgctatccttaagaaattaaaaatcttgttgcaaaggaaagatacagacttatataataaaatgttataaagtctgttaagtgagtaatttctttttttttttttttttttgagacagagtctcactctgttgcccaggctgaagtgcagtgatacgatctcagctcactgcaacctccgccccccaggttcaagcaattctcctgcctcagcctcctgagtagctgggactacaggcacccaccaccactcctggctaattttttgtatttttagtagagacggggtttcaccgtgttagctaggatggtctcgatctcctgacctcgtgatctgcccacctcggcctcccgaagtgctgggattacaggcgtgaagtgaggatttttaacactacccaccaaagaaggaggggagggttgaaggtgtcaccatcataaacagtctcaagaaggaagtttgacttgaagtgagcctgatagctgagtttttgtttgtttgtttctttactttttaatagatgacaggagggagatactccaggcagggtaaaacatgaaatgaacttgacctttgcatgagccaacacttcctagaattaatgaggtgccctgccaggctgctgctggagtgttcacgtgggactcagcatgggtaggcatagggttaggtaggctttaggaggtacctagagtgcagacaactgaaatactcagtgtttaaaacccagtagtattggtctttacaataagaacatagcaaccttttggagcagaagaggaatgtgatgaaaacagtaggcgcagattagttttgtgcttatgtatagcatacactgaagaaaaaggaagatcaaaattctggattcaattagcagccaggttggaatggtgggtcgggagctcagccaatgtagaaaccacactaattgtgattatgagtagctggtgttctcttggaaaatgaagacagatttcaagtgtttatattccatgtccctctaattaaatctgtggcagcctgggctccttgtgagttgagcctggtgccatcctgagaggtctctctaccatgagtggtctgtaggtagtgagttcaggagggcagcgatgagaattctcagcacccatgttggttagtgcattcctttccagccctttcttcctgtgtgtgagtctccagggcctggctgctgcacacacggagataggctttggctgtgcagagcaagctaccttcacagctgccggaagttacagaactaggattgtgtgtgtaaactggggaagcaccagtgtgaagcaaaaatgcagaagaaatcttaaaatggctttttttttttttttttttaagatacagagtctggctctgtcaccaggttgaagtgcagtggcgcgatctcggctcacttcaccctccacctcccaggttcaagcaattcttctaccgcagcctcctgagtaggtgtgactgcaggtgcacaccgccatgcctggctaatttcttttgcattttagtagatacgacgtttcactgtcttgctcagggtagtctcgaactcctgagctcaggcaatccacccgccttggcctcccaataaaatggcattttatgtgtctgtaccatggcattgaagaggggagaattccactgttacttgctttttttgttttgtttatttgttggtttttttttttttttttttgagaggaagtattgctctgtcgcccaggctggagtgcagtggtgtgatctctgctcactgcaagctccgcctcccaggttcacaccattcttctgcctcagcctccggagtagtagctgggactacaggcgcccaccaccacgcccggctaattttttgtatttttagtagagacggggtttcaccgtgttagccaggatggtctcgatctcctgacctcgtgacccgcccgcctcggcctcccaaagtgctgggattacaggcgtgagccactgcgcccggcctgttacttggttttatggattttcagaactgtgaacaactcatacatctgcctgtaagacttggtctcagccatttctccctccccttctcccttcccctcctgtcctccttctatccctccctcctgctgaaatccagacttctagtaaccatcaccaaaaaatgtggactttagagtcaaggagatctgggcgtaaatccccagtcttcgtttctacttgtgtagtcatgaaacagttcctttgctcctctgggcacacttactccatccatatattagttgcctaatgcatggggtttatggtgaagtttctgtgaaacactgtatgatgaggtgatgtctttaagggcctgctttggttcatagaaaatactgagggttgccaggcgcggtggttcacgcctgtaatcccagcactttgggatgccaaggcgggtggatcacaaagtcaggagatcaagaccagcctggctaacacggtgaaaccctgtctctactaaaaatacaaaaaattagccaggcatggtggtgggcacctgtagtcccagctacttgggaggctgaggcaggagaatggcgtgaacccgggaggtggagcttgcagtgagccgagactgtgccactgcactccagctcgggcggcagagtgagactccgtctcaaaaaaaaaaaaaaaaaagaaaatactgagggctctattcatggtggacaccaagaccttccataatatggccaaatctaattagccacccttcatcaaatttccctaaatttgggacagaaaataaatctcatactcactgttaactctgaccaattgacaatgacttcctggagctctacatttaaaaatagactaaaaccatgcccaggctctttaggaaagaatgccacaatcagtgagttttgcctctgaggtttctattctcccatccggctgtgtaagaatgaatcacatcacgcaatgtgtccagtcattgctcccaaacccggaatgtgtttctggttatccacacctctattgacttcattctcctccccaccacacgagccccctcccacacatgcgcactacagaaatgtcctggtcattgtgcctctcatactcaaatccttctgacccttcaagccacagcgtcaaaacctccttctctaaaaaaaacctgaatgctgagagtcaatactgcttcttatttcacgctagaatttatcgttttgttagatggctacttccattgttgtagatagaatttttctaaaggggatatttaggaatgctttccatatccatgtattgcttgacttctttctctccgtcattctaagttgtcagagagaggggttgggtgggaagggtgtggactctgcctgtaataccagtagctgttgcacagggtgacactgtgactttgaattgcaaaagtggcgaaagaggctgcaccaacaggtcttatgctctttccaggtgcaggtctcagataacaagctgaaggtagtcagtgactggaatgtcatcggccacctgcaaagggagtcattgcagctactcttttcagtggaatcatttagttccctcagggactttcttagaaagtctaaaagattttcaaacaaacaagtctctttgaaaatgaggtgaaaatgcccaggagtcctcatttggtcaggctccttgttcatcttaaactctacacccatgtccctggttcctgatactgggggaccccataaatgttggttaatcactggaggaaatgaattaaggaactaagccatgctgaggagcaagaatgtgtgtgctggggccccaccacaaatgggttaaataagagcctctgaagagggaacctcaggatggctttgaaggctacctgggtgattttggtgtccagctggggtcatctggcctgctcgcccctttacttgctgcccttgacaagtgacacccaggattgccgtggaagctgagaaataacacttctgtctgaatatgccagtaaagtttcctctcaggcattaatttccttgtccactcaagaaacttggagaaataagggtagatctcagattaaccatgttcttggggatttacttaatgatattcagtaaaggggttatagtatcaaagtctgcagcatggagatgaagcagagccggctcttccggggtctgtccacatcaaggggcaccagacgttggttgtgattgttcctgagcctggccaacctcacatgtgccctgggctccctctggtgagctccggtcttcaccttaaccgcgcatgtttgcattgcggggaatctgtgcttcagacagacacgccagatgttacaggtcactgcatctaagatggaaggtgttctgtttatttatttatgttttaattttggctgttgatcactttcttgtgctggtgaatcagcacgcgtgttgaaccagccattaatctcctgggagagagctgttgacatcctggagggtggcactcttcctgtttacagatgttaaagagaaaggcccatgggtgtctccctgggtggccaagcctggttcatgtgtgtgctgtgctgtgtgttccttcttccacacaatcactgagcctggccgggcacagtggctcacgcgtgtaatcccagcactttgggggaccgaggcgggcagatcacctgaggtcaggagttcgagaccagcctgaccaacatggtgaaaccccgtctctattaaaattaaaaaaaaaaaaaaaattagccgggcatggtggtgggtgcctgtaatcccagctacctgggaggcagagacaggagaatcgtttgaacccttgaacctgcgaggcagaggttacagtgagccgagattgtgccattgcactctagcctgggcaacaagagcaaaactctgtctaaaaaaaaaaaaaaatcactgagcccctcgcaagtgccaggcctgatgcgaagcactggggatggatagggaaaggccccacctgtcccttgctgtctagtttattttgttttgtttctacgtcacctcctctctcccctgtgctcctgcagagggttggacacaaataccccactgtgtctgcgctggggacattggcctaaatcaaacatctagggcagcctcagccaggaaagggcatcactcaaggagagggagcaggtcagtctgtctggatagtggtgggaagagcatacaccaacaccaactgtacgtatgtgatttcaagtttattgtggtacaatttacttctaataaaaatcacgctttcggccgggcgtggtggctcacatctgtaatcccagcactttcggaggccaaggtgggtggatcacaaggtcaagagatcaagaccatcctggccaacatggtgaaaccccatctctactaaaaatacaaaaattagctgggtgtggtttgggtgcacctatagtcccggccactagggaggctgaggcaggagaatcatttgaacccaggaggcagaggttgcagtgagccaagatcatgccactgcactccagcctggcaacagagcgagactccatcttaaaaaaaaaaaaaaaaatacactttttaaaggcatcgtttagtaaggtttgacaaataggtgcaatgaatgacataagctccccacaagcaagactcagggcagtcccacctgcccagagcatcctccatacccctccacccaggcgagcgctgccatgccatctatcccacacttttgccttttgccttttctggaatgtcatgttgagggggttgtacagtgtgttaccttctgcagctggcttccttagcataattgcttttgagattcacccgtgttgtgacaggtgtctgcattcatttgtttttcactgctgaggagtggtctgttgcatggatatcataatttgtttcttcattcaacatttcattgatatttgagtgtttctaattcggggctagtatgaataaaagtgctgtgcacatttgcacacagattttcatccaacgtgttttcctttctcttgggtgaatacctagatgtagaattcccagatcataagtaaatgcacctttaactagattctaaagtgcccaactgtcttccaaagtggctgcaccattaagaactctgcctttttcttaactcactaccccaggactgacttttttgaccccctgccctccgcccggtcactgtgtatggcaggtggaatccaccatgccctgggggtggttccacctgcagctgtggggagaagcatctgtgctcactgcacatagatctgtgccctcaatgccagcctgcacctgcctttctctacctggcacctggggcctcatgggggatggtgtccggcctgcaggagcagcagcctgactgtgccatctctcatctctccaaatgatctctctgtggaactttctaaatgacatatcagccgcgaagacaaataggaaataagaggcaggaggcaagacagacactccccatggagcggattccacgtggccctgggcactcacctcaggagtggttgagaaagcctggttcctgcttgctccatgaagtcctcactccttgaccagattttggagagaggaaggtttttcaataactgcccctcttggtagtcctcctaaggaagagcaaaagaaataaaacagattcaaaactgtgggcctgcgcagtgattcatgcctataatcccagcatttggggaggtcaacgtgggaggatctcttgagcccaggagtttgagaccagcctgggcaacatagcaagacacccatctctacaaaaatacaattaaaaaattagtcggatatggtggcacgtgcctgtgatcccagaaacttgggatgctgaagtgggagaatcgcatgagcccaggaggtcaaagttgcagtgagctctgattgcaccattgcactccagcctggacaacaaagcaagcaagaagagaggagaggagaggaaaggagtggagaggagggcagaggaggggaggggaggggactatgcatatcccagtagcctggctctgggctgggtctgtctgttgcttaaaggcttaaaaaaagagcacagagccatctgcacttggacatcctggtgacgtggcctaacttccgacattggggtcctgtaaaagaagataagccatggtgtttccttaatgagaaggccttaattccaaagtgagggctggcaaacccaacagcacagcactcagaggagaagacacagttgttgattgagtcgagctgtctggcttcccaggaccctcagctcagtcacagcacagcgttaccaggatgtcagacacccaagggcagtgctgacatgcagcctgccactgtggccacagcactcgggttaaaaagaaaccagataaaattcgtgtttctgcttgtccagactagaaattaattcaaacctggcctgtagcagctgtcttctctacatccaactggatggatgaaggccgtcctacctagtagagggaggttggaaggatgagaactgtctacaattaaccttttcattagcacagaaaatttagacaaccaaggtcccaatttctaatgtaaaggtcaatttcttacatctctgtgtacatcctaactgattcaccacaccattgcccgaaggtacatttctattggttttttgaaatgctaagaggagctctcaggcagtgttaatgtatgcactcacgacttcataggtaccagtactgcactagcttccagtatagcactaggtactagtactgcactagatactagcactgcactaggtactagcactgcactaggtaatagcactgcactaggtactgtggatttgaggggtcagaggggaaggaaaccattctgattgtcaaggaatttcctatatagttacagaaaccacattcattagagaatgagtaaattacctttgtgctcctattagactacataagaattgtacaatgtgatgtcctggggttacataagtatagttttaaatcaactatatctgcagcctgtgaaaaacctattccccttttttcctagttgcagttcactccccagttcgtctgcaccctacctcgatgagatctccccttccgtgggctaaacaaaaccccaagcagttagctgttaatgatacgagcaccatgccggagctagggccaaatgagtcagaagaatcctttgcagtgccgcggggccctaattgtgtcaggtattttgcccaaattagcatggctgaggatcggctgctggttctaaaatagtctcgaaggactgtctccaaattgcttcggcaacattactcattctcagcacgactctggtttccgccgtcccaatttacagatgggcagccgaaagggaaaggatgagatggctaaactgaaagtcacaaaggaaatcctgggccaacatcaccccttggggcttcctccagctgcggtctgtgcccccacagccccaggatgctgggcggttttctccaagaattggaaaccttttcccagggcatcctcacacaaagccccactctgaataacacgatgatttcaggcctttttctaatcataagcccccaaattagataagatcaacatgaaaggtctcaggtatcccttaagaatttaaaggaaggacagaaaaggttgagctctgtagtgcgtggaagaggagatggcatgatcaggatactgtcctgagaattagcagtaggatcttacagtgaaatagggggctcctccgcaggctcccaacacatcagctggtaattatgcccggcaccaggatactggggcaaggcagagccactggaacacatcctcgcctgcaccctgctctgctcattagccatagcatcaaaatcacttttgctccaaaggcgttttttttttcctatactgtacattcttttgtgctttctaatttattactttttttcccctacctgagctgttggagatttagtgttgaatggcttctctgtatttttctttagtctaattcattatcactaagtctgtggtttttttttttttttgtgatcaatatacacacttagattggtttaaaataatcccatggagagcctcattagtgtccttggataatagatgcagctctctgggagaagggagcgtttatcagggaccacagtgacagagcccacaagcacacctccctgtgtgtgtgttgaacatgctagaacatgcacatgtatgttgtcaggtcctcaggctgcatgaagctgctacatgtgcaccatgtccctgctgcgtccctgctgttcgttctgagcactgtgagagcctgaggcgtcagagtgcagctcattgagacccagacgccactagattctcagtcttctgcatgtttttcacacctcttatgtttactgaaactacatcttgagctgagtgtttgagcaatttgttctcaaggccaatatgggcaaactccctgagtcggagctgataccagcgaacggcttcagaaagtaaaaaacatgggaaagaggctgagaggaaagaacgctctgagtgggaagagaggagggagcacctgtctgaactggctccgttcacgtccattcattctttaaggaacttctctttgtccttcataaactacagtgttcccctgtctcccaggctggggtctcatggctcttgccacaggccaaaaagaaataagatttcctcttggcaacattttttgttctgtaatgggattttactgaaaggcaggaggaaaaagcccttgaggtgaccaaaaacttgtttttaacacatatgatgtaaggtaaaagctttaagaaggtaaacagagctgggcatggtggcacatgcctaacgccccaacagctcgggagaccaaggtaggaggatggcttgagaccaggaggttgaagctgcagagagctatgattgtgccaatctactccagcgacagcatgagaccttgtctctaaacatagatagatagattgacagattgattgataaatgatagatagatgatagataaatgatagatagatgatggatagatgattgataggtagatggatagatgacagatagacatatagctagatagatcaatccatggatgatagatagatagataatagataaataggtagatagataaatgatagatagatatagatagataataaatcaatccattaatggataggtgatagataatagactgattgattgatagatgatagactgattggttgagagatgattgatagatagaaaacaaacctgttttttagtttcttcacagagtggcacaagcatcatctcattccattttagaacattccacccccacctccaaattatgctttagcatttactgaaccccccaaactcatttctgcttccccgtcatgtcttcatttcacagagtttgttgagcactgatcttgatattaggtttacagtgacagagaagacacaagctccctttaattacaaagattccatttccgtgtgactgtgtttactacggtcagccctccatatccatgggttctgtatctggagattcaagcaacctccctcaggtcaaatacctggaaaaaaaaaaaaaaggatggttgcatctgtactgaatttgtacagactttcttccttgtcattattccctaaatgatacagtatcacagctgtttacattagcaattacattgaattagggattataagtagtctagaggtggcttaaaggatacgggaggatgtgcttacattatatgcaaataccacacattttatatcaaggacttgagcatctgtggattttggtatctgcaggggtgtcccggaaccaatcttccatggataccaaggatgactgtgctcatatttgtgatcatatatgttaaaagcatctctctgaattagagagggaatctgtcacatctgtcactaatattttagaacaggccaccccgatccatctttagtgagtggagcatctctgcctgaaaacatctatatccaaatctttctttctttctttctttctttctttttttgatacagcgtctcgccctattgcccaggctggagtgcagtgacgtgatctcggctcactgcaacctctgcctcccaggttcaggcgattctcctgcctcagcctcctgagtagctgggattacaggcgcatgccaccacacccagctaatttttttatttttagtagagacagggttccaccatgttggtcaggctggtctcaactcctgaccttctctgatcctcctgccttggcgtcccaaagtgctgggattacaagcgtgagccaccgtgcccggcccaagtgtttcataaggaaaggaacttctgatacaccatagagtgtctgggaaaattttaaaattactaatggaatatgtgctcaaatattggcccctgaggaagcatttatgcccatgaggattcctgccctcaaaaatttaactgtgtcatttagatatacacaaaaaatgaatatatatgaatatttaaatgctacatgagtttaaggtattactgaccctagccactcagtgactggagattagactagacccacttattaatccacccatccactaattaattattcaattaatatttattgagcatctaccatgtgtcaggttctcttttagaactgggagtgtatcacacatttttatattaccttccatgctaagtacataggaagactcagaaaacacatatgattagacactgagaatgctattttttggtgcctttggtgataaaacgttaggatccaggaaagcaattgttaggtttgccccctcactcccaaatgctgttgctgttataaagcttttcagtccctcaaaatcacttaggaagataaatgagtaaacttcgctgcactaatttactcttcaaatttcagcatgatttatgccctgttttgtttattgctcaaataagcaaaatcagaatggattgtgtgattattttgaaatatagttaagtccagatcactttattcttccttcatcatttttttttaactaatccatctctacccaggagatgattcatcacacagctgccagggctgctttaaaataaaggaataaataagaagaaagaaagaaaagtgaaggagggccactacatagccccaaagtaaatcactgtacaccttcctgcattctctttctctctgcctgtcttcctctctgtcacacacacacctctaagaatttcagcagaatccgggacatgctggaaaatcatttgatgcgaggaattggggcttaagccaagtgtgctgccgtggcctaaatgtgcaaggtggggccagggacttctcccgcaggaagccggctcaggccagaagcccagggggtgggcagggcaggggtcatctcccccagggtttgcctctgccttgctctctgagggtctccactttgtcccttcaggctttgactaaatcttcacgcagacactggtcagctacctggccctgagcaagtcgctttgggccttggtggaactgggaaatgaagggacattcgcttcctagggctgcggtgagaaatcgccacaaactgcgtggcttaaaacaacagaaattgcccctcccagttctgaaggccagagatgtggacacagttgaaatgacagtgacagagaagggtgtggaggagaggagcggggctgcggtcacgcccaggacactggattttaaagggtgggcagagaagatcccacagagacgaggaccagagagggaggtggggggagagctgggagaaggggcagtcgagagggaggtggggggagagctgggagaaggggcagtcgagagggaggtggggggagagctgggagaaggggcagtcgagagggaggtcgggggagagctgggagaaggggcagtcgagagggaggtcgggggagagctgggagaaggggcagtcgagagggaggtggggggagagctgggagaaggggcagtcgagagggaggtcgggggagagctgggagaaggggcagtcctgaacatcaagacagagaagcagcagccgcagcatgtgcagggagagaccacccaggcccagcacggggaggccacggactttggcacctcgatggacacagaagatcttcagagaagcaatttcagctttaaaaatggatggaagccatattgcagtgggttagggacaggagagaaggtcagaaagtggccctcagatttggaccactcactggattggaccaagaccggtaggcgttgggctgatgatgggttagaggctgcgtggggaggaggtgctcatgggtgggtggagaggctgcgtgggaggaggtgcccagagatgggtgagaggctgcgtgggaggaggtactcatgtgtgggtggagaggctgcgtgggaggaggtgcccacagacgggtggagaggctgtgtgggaggaggtgcccagtgatgggtggagaagctgcgtgggaggaggtgctcatgggtgggtggagaggatgcgtgggaggaggtgctcatgggtgggtggagaggctgtgtgggaggaggtgcccagagatgggtggagaggctgcgtgggaggaggtgcccagagatgagtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgttggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcataggtgggtggagaggctacgtgggaggaggtgcccagagatgggtggagaaactgtgtaggaggaggtcctagttgtctgcatttcctttgggagaacagccttagggaaaggaaagagactggtggagcaaaatccgagaggctgaggcagcataaaagtctctcctccatggaaaaacttggagccaaaagcgcacattcctcagtgaaagacgccaacctgaaaggctacactttgtatgattccaactatgtgacattcaggaaaaggcagacttatgggggccttaagcagatctgtgcttgccagggtttggtggggtgggaaggatgaatcggccgagcacacagaggtttggagacccaaaagacgtctgtatgatcctgcaatggcaggtgcaagacggatggatttgtcacaactcacagaacacacaggcaaagggtgaaccctaatgtcagctgtgggacttagttaataatgtttcaatattggtttatcaattataccacatgcaccacactaatgcaagatgtttgtaatttggaaaactgagggcaggggaagaaggaggatatgggaactctctgtagttctgttcagtttttctctaaacatgaaactgctctaaaaatataaagcttattaattaaaaatagtaataaataagaaaagtttaccaggaaggtaaatggaaagtatttgatagttctaggatggaacaaaaaaggaggtacaggaggaagtgctggccgagacggaaaggggatgcctggtcattggagactgagaggagggaggagcaccaggtacttcagtgtgtccgggaggaagccttctgcagggaagcagggaccctgggccaagctggagcctcccagaggcaaaggctgagagtgaggctgatggagagggaagccctgtaggcaaaagggagagggagtgggtgtgggagggagagccttcagtgctcctctgtctgccccacacctccttgtccctttagagtaagggggcagtaggtacaagagagatgtaaggagagcaggaaagattggaattggcattgaggacagacgtgtctcacactctgggtggttgtgatgatgggaatggttagtggtcagctgaggttggagacattgcatttgtcattcccaaaggtcattctcaaaggtcaaggtgttgatgtggaggaggtagattcggcataaaaccaagttgggcattcgctagtctgggcagagaaggagttgtgtgaggaaagccattcagtaggggattggagcagaggatgaatgaccaccaagtggctcatccaaaagggaattcccacagtggagaagaagttggaaaagtcactctcaaatcctcttttaacttgaaaggaaaagaatctgataccctgcaagaaatcaaattccaatgcaaaaatataggttcctttcataggaacagatgtggagaatatgattgaggattgagaccctaaacccagtttcccacctgacacagggattgagcccatttgtttttgctacagagttccatagagtaaacttgtcccaatatctgacatattactgggcctttaaaagaaattacatatagatagttgttgtaataacattttatcaatattcaaccattgatccttcctaattaagtgaagggttaagggaacacacatatacatctacacattcacatatatacgttgtgtgtattatattgcatggtcaaattatttaccagtttatcaatgaataaaccagcatttatggaatatctgctaggaagctctgtgctatctattttcacatacaatagattattgcgtccaaccctacgaggcaaacatgattattttcattttatacacaggaaacaaacttggatccagttactctattgcctcaagccctttgcttctagtggcagagttcagaattaaatttacaccttcttggaattatctccaccacttcacaacttcctccccacgaggaacatcctggtgtttttgaagacagattgccacgactcacttctggcatcttggagtcacttgtttaacttatagagactgagaaagattgagaggttgagagagtcactagctagcaaaaagaaaacaattacctctttggactatggtagagtttataaattaatagccattgtttctcttgattttcatgaccattctgtaggacgagggtagctattgtccccataggagaaaataagacgcagagagttgctgaaggccgtgtgatccacacgtcataaggttgggactaggatgcaaacttttgattcctggtgtggatctatggaaactcctgtaacgtgttggtggtgagggaagggaaatgcatcttagcttatggaagaagtaaaggactccttgagcacaggtgagccaggtaataaaagtggaattagtgaatcaccatcgcatattggccctagtgttcatgcagtgatggtgaatcaccatggcatattggccgtagtgttcatatagtcatggtgaatcacgatggcgtattggccgtagtgttcacgcagtcatggtgaatcaccatggcgtattggccgtagtgttcacgcagtcatggtgaatcaccatggcgtattggccgtagtgttcatatagtcatggtgaatcaccatggcgtattggccgtagtgttcatatagtcatggtgaatcaccatggcgtattggccctagtgttcatgcagtcatgatgaatcaccatggcatattggccgtagtgttcatatagtcatggtgaatcaccatggcatattggcgctagtgttcatatagtcatggtgaatcaccatggcgtatcggccgtagtgttcatatagtcatggtgaatcaccatggcatattggccgtagtgttcatatactcatggtgaatcaccatggcgtattggccgtagtattcatatagtcatggtgaatcaccatggcatattggcgctagtattcatatagtcatggtgaatcaccatggcgtattggccgtagtgttcctatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtattcatatagtcatggtgaatcaccatggcatattggcgctagtattcatatagtcatggtgaatcaccatggcatattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggccgtagtattcatatagtcatggtgaatcaccatggcatattggcgctagtattcatatagtcatggtgaatcaccatggcatattggccgtagtgttcatatagtcatggtgaatcaccatggcgtgttggccctagtgttcacgcagtcatggtgaatcaccatggcgtgttggccctagtgttcacgcagtcatggtgaatcaccatggcatattggccatagtgttcatatagtcatggtgaatcaccatggcatattggccgtagtgttcacgcagtcatggtgaatcaccatggcgtattggcggtagtgttcatatagtcatggtgaatcagcatggtgtattggcgctagtgttcatatagtcatggtgaatcaccatggcatattggccatagtgttcatatagtcatggtgaatcaccatggcgtattggccatagtgttcatagagtcatggtgaatcaccatggcatattggcgctagtattcatatagtcatggtgaatcaccatggcatattggccgtagtgttcatatagtcatggtgaatcactgtggcatattggccgtagcgttcacgcagtcatggtgaatcaccatggcgtattagccatagtgttcatatagtcatggtgaatcagcatggcatattggcgctagtgttcatatagtcatggtgaatcaccatggcatattggccctagtgttcacgcagtcatggtgaatcaccatggcgtattggccctagtgttcatatagtcatgtgaatcaccatggcgtatcggctgtagtgttcatatagtcatggtgaatcaccatggcgtatcagccgtagtgttcatatagtcatggtgaatcaccatggcgtatcggccgtagtgttcatatagtcatggtgaatcaccatggcgtatcagccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtgttcatatagtcatggtgaatcaccatggcatattggccgtagtgttcatatagtcatggtgaatcaccatggcgtattggccatagtgttcatgtagtcaagatgaatcaccatggtgtattggcgctagtattcatataatcatgatgaatcaccatagcgtattggccatagtgttcatatagtcatggtgaatcaccatggcatattcgccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggtatattggccatagcgttcatatagtcatggtgaatcaccatggcatattggccgtagtgttcacgcagtcatggtgaatcaccatggcgtattggcggtagtgttcatatagtcatggtgaatcagcatggtgtattggcgcttgtgttcatatagtcatggtgaatcaccatggcgtattggccgtagtgttcatatagtcatggtgaatcaccatggcgtattggccatagtgttcatagagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatattctccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggcatattggccatagcgttcatatagtcatggtgaatcaccatggcatatcggccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtattcatatagtcatggtgaatcaccatggcgtattggccgtagtgttcatatagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatatcggccgtagtgttcatatagtcatggtgaatcaccatggcgtatcggccgtagtgttcatatagtcatggtgaatcaccatggcgtattggccgtagtgttcatatagtcatggtgaatcactatggcatattggcgctagtgttcataaagtcattgtgaatcaccatggcttgttggccctagtgttcacgcgatcatggtgaatcaccatggcgtattggccctagtgttcatgcagtcttgcaaggcactgcatattatttccagttagcatttatgggaatttacatttgtcgtatcaaagaaaagttaatcccctgctgtttctgaatatcttagatacctactgaaaatcataatctaacaaactgaatttcaatattaagtaaggcaatggagtttaagtctttctgatgtcccactctgccctctgtgcttagaaaattccaaataaacacaggtcaagtgaatttgttaggcttgtctctaaactttcaaaaggatctttgctgagagccacctctcgaacctacctttatttactaatttatttgtttgttcataggcacataatgagggcctgtgctgtgctccatatggaattctttttttttttttttcagtttttaaaatcaagatcacagtatgttgggagggcaattatctgacttttcattcctatttaggataatttttaaagccaatgagatataagctatgaaattctttttaaaaactttttattttgaataattgtagacacagaaaagttgcaaaagtagtgcaaaaaaatctcccatatttctcatgtcaccactcctagtgatagcatattgtataactttggtataatgatcaagaataggaaattaacatgggtgccatattgttaactcatctacaggcctcatttgaattctaccaatttttctaccaattttctacctgtgtcccaggaccccatgctgcctttagatgttctttcttcttagcaccctccagtctataacatttcctccatttctccttgtctttcatgaccttgcacttttgaggaggactggtcagttatgttgtagtgtccctcaatttgggtttttcccagtgttttctcatgattggagtaaggttctgcattttgggtaaaaaatatcacataaatgattatttgtccttcccattgcattatatccaatgggctccagtgatgttggccttggtcatttgcttaagtggctgtctgccaggtttccactgtaaatttgatgatttgatttatttaattatttatatcagtaaagactcatgggtatttattttattctatgggttaatccagtactaacattaatttttgttgttgttgatcaaactgttctagtatgagtcattagaaactcctttaggttagctttcatgttctctcaataaacccctatttttttagtattccattgctttctggtttcctaaaatattcctgactcattctgtattttccctgccccagcccagatacaattgctcctcccagaagccctattttcttttactgggtgatggtatttagacaccaagatctgggtgctaactgtgctcattgctactggggtgtcattgtttctaggccttctcagtggacagacgcaggacatatttgtatgtatactaacccatggacacacacatatctatattttggatctatctgtgtacatagagattaaaaaccatgagtttatacagatacctctgatttcaaacttcacagtttattttagtgttccccttttccttataacgttttttttcaacagtgaaaaacctggctttcattatctccaatatatttacatatttgtcccattctagcatgcacacagtctcaaaattgatcctccaaacccctgggagaaacaaatttactcacggaactacagagaatcttccttctctcagcagtcccatctttccaccctatttccacctataccctataggtaatcaatctggttcctggtttctgcttcctacatttcctttttcacaaaagactcgattcatatatattctcatatccctttcttctatgatatataattatatcatactatatacatacatatatgtgtgtatatatatatatatatacacatatacatacatacatacatacatacatactataacacatactcttgggctttgttaactctgacatggaaatcactccatatctgtttatagagttattcattctctcttacacctgcaccctacttcattgtattgggggggtatagttttggggggttttataaattgacaaatgataattatatatatttacagggtacaatatgatattttgttatatgtatacattatgaaattattaaatcaagctaattaacatctctatcacctcatatacttatcttttttcattgtggtataatagttaacatctattctcttatctattttgaaacatgcattacattcttattaactataatcaccatactctgcaacagatctcaaaaacttattcctcctgtctaactgaaactttgtatctttttatcagcacccccccaatccctcccactcccagcctctggtaaccactactactctactcactgctcaatactattcagccttaaaaaagaaggatgtaccgtcatttattcaaccacatattgtttccaatatttgcaactacaaataaaactgcaataaatacaaacttgtgcacatgtatttgtgcattgtttgaggtgaattctctaggagtctagaagtggaagtgttgggctgaaagttaagtgtgtactttattaggtattgtcagatgtctctctgaaatgattgcaccagcttgcttcccgacaagcaagtctgagagtgcctgtttccctacagtctccccagcaccatgtgtcatacttttttcttctttttccaagtctcataggtgagaaatgatatctcaattaattttaattcctacttccttaatttcatatgtatttgagtacctttcatatgtttgattgagggccatttttatgtctttttgtgaattgtctgttcatgtctttttctcatatttttatcttttttttttataaccacatttttcaaagtattttgtatgttagggatattagccatgtgttgtaaatacttttctcctggtttgtaagatgtcttttgtttatgatgcatctgtcatgcaaaagttttatgtttttatgtagtccaacttattaatcttaatttctggctcctgaattttgagtcatcaaagcttttctctacaccagggttcaagaggaattaacctatgcttatgagaatactttgaaacatcataacatacaaatgttggctgggcacagtggctcacgcctgtaattccagcactttgggaggccgaggcagacggattccctgaggtcaggagttccagcctggctaacatggtgaaactctgtctctactaaaaatacaaaaattcgccaggcgtcgtggcaggtgcctataatcccagctacttgggaggctgaggcaggagaatcacttgaacctaggaagcagaggttgcagtgagctgaggtctgccactgcactccagcctgagcgatagagcaagactccttctcaaaacaaaacaaaacaaaaccacgcaatgttaaaaactcatctattaacagaacctgcaatattaggactcgcttgcatcttccgatcactgggcagctgccttcccagctggtttctaagcggcaatgtcttctctgaattggcatcgtcactctaccctcaggcttcctggcttctccaaacccagacacttcatctaaaactacctggggcattctagactctctagcctcccccatctgtctttactctaaatgtagtccttgtttttcctggtagttttattcagccgttgcttttgtattttctattgattccagtccaccatgtccttagccccttcaccttccttcccttcctgcctcatctcctttgttcatgcaacccctgaagtgcagcatcctccctttccaaaggccattcaaccatttctttctacagatgagtgggtgcattcccagctatgtgtatattttatatatatatatatatatataatatacacatttttttttcaagacagagtttcgctctgtcacccaggctacagtgtagtggcatgatctccgctcactgcaagctctgcctcccgggttcacgccattctcctgcctcagcctcccaagtagctgggactacaggcacccgccaccgcgcccgactaattttttatatttttagtagggatggggtttcaccgtgttagccaggatggtctcgatctcctgacctcgtgatcgaccgcctcagcctcccaaagtgctgggattacaagcgtgagccaccgcgctcagccccacataagaaattatagctaagtgatagggcgcttacctgacagagcccagcagactcagcagaacacagatatcattcttcacgtggaggggtgtcatccaaaagaaacatgaaaatgaatcttttctacacgttggagacagcagtagctacaaaatatactgaaatatttaatacttataaaatgttagcacttttcatttttcccaccatgacctttactcactataacctttaagtacttagagaggtttttgttgtggtggtattggtatttaatcagtacattaaggataaaaaatataaggaggtttgaaaggaaatacatctttcaatttatccccttcctccctctctctctcgacttgtatctgtcaacacaaaccaacacaaaacctgatgccaccaggtttgtaaggtcataatgacctgcgttatacctagaaaaaattatcttctaggagaaccaaagatggagatacaaattgtggaggtagatcactgcatggttctgcattttaatttttaactttgactgttctggagatttaagaagttgatccaaagacctcactgcatgtcctctcttaatgagtatttactatttgggttaagcaatgatggacctatttcagcttcatataaattatatacatctgaagaaacctaatagagactaaatgagacatattacttagtaacacaagagacaagctcttgaaatggataccatggaaggagaaaggagttaagttataggtaggggataaaattgcagcagcttaaattcttggttcccaacattttgctttgtttttgtttgtttgttcaattttcagggatcctcaaagtctggacccaccagaagtcagcaatgcaaaacttcagtatgcaggatggggccctaaaggccaacagctggtaagccaatcaagttcagtaactatacttgggttttgaggaagtttctgttttctaagctgaatggatctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgacatggttaaagtggtgcctaactgtagctgtgtctatggactccagatgaatcatgagctcaaagagatcaacttcattaaaagaactgcagatgagaatgatccgaatgattttgtcatctaaagatgctctgggaactcagacttcttcctgtggagggtttttttttgttttttgtttgtttgtttcttttgagatggagttttgctctcgttgcccaggctggggtgcagtggcacgatctcagctcactgcaacctccacctcctgtgttcaagcgattctcctgcctcagcctccccagtagctgggatcacaggcgtactccaccacacccgactaatttttgtatatttagtagagacagggtttcactatgttggccaggctggtctcaaactcctgacctcaggcaatccacccgcctcagcctcccaaagtgctggcattacaggcgtgagctaccgtgcccagcctctgcggagggttttttaagcaagtagatttgctggccctgatggagccaggccagtcccgtcaacatgcaaaaccccccgtggtcattgcagccttctcggtttctatcagctatcttcatggattccttctcaaattggcaaaactgctgggtttctgtgaatgggaaggacagtgcagagaaaaaggccctgaacactatttctaagatgagggctcccaccctggttctcactgccgagctggccttggacagcacctcccgctgtcaggctgtaggcagcagcccagccatgtagtgaagaatttggataatacggtccttcaggtttgttccaactctagccttgcgtttgactaaaacttggttatatttgtccattctgggtaacatttttttaagacattgtattgccacgtgcagaaagtccctcaggtttgaaggtcagatgacatggttgctgttttcaagtcaccattttcttctgcctctttaagctgattacctaagcctgcatttgtaaagctcctttttcctaaaatagcacaaaaaatgatcgtatctaaaagctcccacagaattgtatcggataggctgtcatctatcttacaaatgaaaatagtcttatttctccccatagtacaatcacattttcttggttatatattaattccactgccttgaattggtttgaaaaagcaagaagatcgaggcggtgaaactattaatattttagctattattaacatgtctctaatgctaaaactgataacagaggttttgaaaagcatatgtaactgatcaaaatcacagggtgacaggaggaagtgaggcagctgagagctgaccttgaccgaggaacaccaatccatcagttcagtcacaacaaagagacaaaatttgtcttttctcaaaggcattaactcttacacagggaaaaaaatgcaatttgataagagattgtagaagatctaagttttcaggactgatgcgcaactgaatctctaatagttgactttaaaaccctctgaaagtctgtgattgaagagattttcaatatccatcaaatcatctgtgaaagtggccattacacctccatagagagctctccctgcctgctgcggatccattacaagccagtacccacagctctgcacctggcctcatcaccccactacagggagaaggatgggaatgtgtaaccttactgagtgatcattgtccagcctttttatagtagtcaggagaagaccatcataatgtgaccacatgtcaaggtctctttccaccatacctgcggcctcgcttcttatcacccagcggctgtaactcagtgtgtggactcctgcctcattgtctgcacatgcaaataaaccgggtcccgtagtagagttggtacttgtcctgcctctgggaacagcttgtaacataaaggaaatttaacccacaactgtaaaaggagttgctgtgcatgcatatgtgtgtgtgtgtgcgtgtgcatgcacacactttagaattaagtctataattgtcctcttgaacaactgaccttcactcatgtcatgctccgttggagatgaggaggggataagtgattatagaagttatcttgtttaacctcttacagaataagtagcaacaaaacaaagtaaatgacaacttctcagagaaggcttcctgacacctcccccaacacacacatgcacacacacacacacacacacacaatggtagctagccatcctggggcttcaggtttcaccgtgcaatctcccagcacacatgatctcttgttgcctgtagacatgtctctctccttggttaggtggtgatatggtgtggctctgtgtccccacacaaatctcacctttgaattattataatccccatgtgtcaatggtgggaccagatggagataattgaatcatgggggcagtttcccccatgctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacacccagcacagtgtctggtgcccagtacacatttgttgaggtaaaagatgaaagcacaaacagattgattaattcattagttaatacatttttgtggtttcaaaccacttcagcatgaagaattggatggtggcaaatagccagcatctatgaatatgttctaggacagtactagaggtgacagaaatttgacttcctttctgcttcaaagaaatgaatgttcaggtaagtaataactgttaatacttgagtttagtaccaaaggtgctatatacttgtggaacttttgagtttttaaatccatttgacctttaagagcgttatgatacatgcatgtactgagcttaagacgcaatatagctcattgttgagtgagtaccctatgtgctggagcaggggccgccttcttctgcagaaggtcagatagcacatgtttcagtctttgcaaacagatagtttctagcacaatgactcatctcccttactgcagcatggaagcagctgcagacagtatagacaagatgggcatggctgtgttccaataaagctatacttcccaacacaggtggcttggcctatgggttatagtttgctgacccctgttttaggggatcatatgctgtcttggttgttctcatggggaaagcctgaccccagagccaccacctcatcacaggtactccccacacctgctccgtctgcacagaaaattcacaactcaagagcaggccttgcaagccctaacctattaagtgatgccaagcaacacacccctcattgccattttattttaaaaagtaaatattgctccctaaagtcaacctactctaattataatgagtcagattgaagtgagtaattctcctttgggagcagagaacacagctgcagttgaggtttgcaaagagctttgggaacatgtagcctcctgtgctgactgatttcagtgatgcctttgggtctggagcccctatatcacaggtgatgacccagggaaccagggatgggtgagggcatcttttcccagtgcctcgatgtggttgccaattagctcttaccttttagagtaagtgttgtgagacccatagaacatttctccggtagtaatgactgcagggggagtggcctgtgtgttgttagtggagtgggtgggaggaggcccccaggctgccagaagccacttctgtgatgatgctggtctggggctggagtttatgacaaatgacaagattgcttccaaacgtttgctgaggacccaggatgtgatctaggaaatagacttggccagattaaataggattaaatgagaaatcctaggtaaaatgttaacacagtgtctctcctttgcttcctcttcctccaaactggagtggtcagtcgggaaacataaacgttcaaaacatatgctgtttcaacgtatttctctgtaccacttctttcctcattgtgtcctcttcagatgaatctgcctgaactgagatttcctccatgtttctttcttttttttttttttaactggaatctccctctgtcacccaggccggagtgaatgttgcgatctctgctcactccaacctccacctcctgggttcaagcaattttcctgcctcagcctcccaagtagctgggactacaggtgtgtgccaccatacgtggctaatttttgtgtttttagcagagatggggtttcaccgttttggccaagctggtcttgaacccctgacctcaagtgatccacccacctcggcctcccaaagtgctgggattataagcatgagccactctgcccggccatccatgtttcttttctttgatcttttcatgaagtcctgcccccgaccatgtgtttgtctgtttatgggaggttttgtttctgctgacctagaatgtgattagttgtctggtttaggaatgtccacatatttcctgatatggtatttctattagagacatttcctggaagcacacagactttgaggcagccgcggtggccttccttgttcttggcacatgcacttggagttgaagctgcctcagggtgcatttgctggttgatctgcaaggggagggagggcatgtgaatttggtgcatcatcacgttttcctttggaaacaagtgccatggaaattttcccaagaaagactgtgcagcattaggcaacattaagaattcaaagccggaatctttgctggtacactcggaagatcagagacaaagtgaatgggtctctctttggttggcttgctaccatgatagtgataaatgaagagctttgaatgggaaatttaatgagtccattgggaagtcttcaacgcagagagcgtcaaaatgtgacagatgaagagcagtggagtagttagccgggaaacctgctggaactggggagagagctgtccccaagagatagcgttccccaaaggagcaggtgcaattacaaacaccatggagggaaactaaggaattctcacagccatgcttcacagcttagaaggaaaggccaacttcctcatcatctccagaccaagagaggctgaggggtggtgaatatcagtgagcaactgtcctgtgtcagtcaggagaaaaacatgtttatcaaaatgggagatttgagtcagactttaagaagaattgccttgattatatggcattttagatcctggaatagttttccacagaaggtcacagaatagtttatcggagaacgtcaataaatccgcatttaaattgtgctgtgttttactgcatgttctcactcataggtgggaattgaacaatgagaacacatggacacagggcagggaacgtccacaccggggcctgtccgggggcggggggctaggggagggatagcattaggagaaatacctaatgtaaatgacaggttgatgggtgcagcaagccaacatagcacatgtatacctatgtaacaaacctacacgttgtgaacatgtaccttagaacttaaagtataataaagaaaaaaagaaaaaaaattgtgctgtgttttaatggttaggatggcagctcccttggtgaagtcttaggagcaggtagactggactcccaaagatgttcccagccctagggctctctggaatggcacatgtggccagcgattgccatggtcacaagctagcttagtgcacgggaccctgcaggccggtcctgccgtgcatgtactttcctgtcattctcttatgcactcgtttgtttacggattcaatcaactcttcttgaatacttcctgtgttctggatactgcctgatcccggatgcagaagaaggacatggtccctttcctcactagcttctgcttctgatggcacattcacctattggcacattcactcgctctccccaaccgcgaatgctgcccgttgccctgctctggcacggtcactctcataactgtccccgtctgttcacactgcccaagctttcctctcctgtccacagcaggggctgtcacactatgtatttgatattcttctcatttttcaccaagatccttagatcctcaagtcttaacaaagtgatgcccctgaaaacaaagccatccagacaggcctcatcgcctaaggggtcattccgtacttgcttgatacagggcccatgaggccaatccagctctgagaaaaacttctctccaggggcggggacatggccatggggtgtgctgtctggaggtccagctgtccttacctcctacacaggtgttccgggctacagccttgcagcatgctgtctggaggtccagctgtcctaaccatgtgacctcctacacaggtgttccgggctacagccttgcagcgtgctgtctggaggtccagctgcccttccccatgtgacctgctacacaggtgttccgggctgcggccatggggcgtgctgtctggaggtccagctgcccttccccatgtgacctgctacacaggtgttccgggctgcggccatggggcgtgctgtctggaggtccagctggccttccccatgtgacctgctacacaggtgttccggctacagccttacagcatgctgtctggaggtccagctgcccttccccatgtgacctgctacacaggtgttccaggctgcggccatggggtgtgctgtctggaggtccagctgcccttccccatgtgacctgctacacaggcgttccctgactgactcacacagacactgtacccacaccctgcaccggccccaccttagtgattgctacaccctctcaagcctgtggcagttgtggctctctaagccacacctcagtgtgaagcgggatttaaggaaccagagagaccggatggagtgcaggagggtgtttattttaaggtgtacacaggcccagtggacatgtgtcctaaaggctgagcccagaacaaagaaaacgagtcccttttaagcattttgaggcaggaactacgtgaagcaggcttacagaagcgagaactaaaggctgctgtgacacttttgcaacatggcttacatctctgtgagaacttggtttgcggcttgtgcttatctgtcttgtgaccttgcagttgtggggggaagaaagaaacaggagtttacagagcctacaaaatatgtggaggatagatatggttattgtttcttgggacagacagttaatatactcttctaacttttaacttcagcggggctgcttaaattctcctcagccttggttaatacagaatttcattctatgagctattgttatttttcttactattattataatttttactattactacttatgctattattctgttgttttcttaatttcccacttcaagtggacggagcccattccaagcaaactattccaaggatagctgtttttcttcttaatacgccaacagcgagagagcgtgagccttcctttacctacccatgagcatctgccagtgatccagcgggcactgcttcctcccagaaccgtgtcttgacacttttttctatgaatcagtgaaagattcaagaaaattggagttgaggggttttttttgcactcgtgctgacttaccttatggcattggggtttttgccttcaataaaaataattttttaaagtagcccattaaaattgtaaaaatccatgccttcaaaatgtcagtaattcaacctaagatatggaggaagagcttgcgcttgaaactccaaaacgctttgttagagggacgaaagggcagtttgatagcagatcggagggatggagggcctttgcttcacccatcgctcacgtgtgggcgtctgcacggggaggagcgcgtggggagaaccatcagatttcagtgtgacagggaggccacgtgggtggcactgcagcagcagcacagagccagcgtgagggcaggctgggtgcagccaggagccagctgggagtgggaacccagccaggcctgggatgtggaagcccccactgagaaactcccttgtagggtcccaggccacctcctcagcctcagaatgggaaggtcctaggtaagaggtgaagccggctgggcttctgggtggggtgcggacttggagaacttttctgtctagctaaaggattgtaaaggcaccaatcagagctctgtctagctaaaggtttgtaaacgcagggatcagcactctgtaaaaacacaccaatcagagctcctgtctagctaaacgtttgtaaacgcactgatcagcactctgtaaatacgcaccaatcagtgctctgtgtctagctaaaggtttgtaaacacaccaatcagcactctgtaaaaacggaccaatcagcactctgtaaaatggaccaatcagcaggatgggggcgggccaaataaggaaataaaagctggccaccgccgcccaacagctgcaacccgcagctcgggttcccttccacgtggaagctgtgttctttccttcttcacaataaatcttgctgctgctcgctctctgggttcgcactacgtgtatgagctgtaacactcactgcaaaggtctgcagcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcgagggtctgcggcttcattcctgaagtcagcgagaccaagaacccaccagaaggaaccaattccggagaaacttgttttaagcgtgagaaggaaaagaatattttattttgtttgttttgctcttaaagggtcattagtaacaaaagctttggagtcaaaagggccagattcagatcgtggttgcagcacttactagttgcgtgaccttgactgagagacttaatccctgagcttccatctcttagtctgttaactgaagtaacagtgcctaccttgtagggctcatggtggagagtaaaataatctactcgaagtacaggctgtggagccttgtgtaaataacgttctcaataaatgtctttgattgttgctgcttttactatttgggttaatcgtctgagaatgagaaggaaaataagcatttcatcagatggaagtctggtgtgtgtcagaaggagagttgggctgcccttgataaagcagagaaacgcaggatagagacagaagctagggttggtgtccagagggcttcatgacgggccagcccccttgtccatcaccatccacagtgtacctgtgtggactcacaccttgctcttctcccactcttagggagggagggggaatgttcagaaaacaacatcaatttctacctcctgaagtcgtcagccccttgtaactattcaggagcctgtggctttagaaaaggccattgtcaggtgacagcaattcccctacgctaatgccacgccagaaattatcccttgaatggagagagtatgtttcttataagaagctgggtgtcctgcttcctgtatccagtccaggaagcctgcatccggtccgcagttccccattaccacctgggcaaccaccagggagctgagcagaaatgggcccgtcgcctcctcctacaagttacagcctggctcagggttagcgctgcccacccagtcccatggctgtagcaaagggggcagggagcactttactgaagtggacaaatccagcgaggggaggaagattgatctttccagcaagaggagagtctttaatgaaatgtcctatatgtggagaagaccagactaaagtgacatcccattaataacttataaaagcctctaatcagcttgggttaatttggtattcattgtaaaaacattcatcatgggcactgaggtctgtgacagtagccaagaaattaatatcccacggatggaaatggccttctgtaccctcagataatggatggagacagtttggtgagtgatttgttagcactaccaaagggacccttcaaatgtaacacaatatgttatcacttcctggctctgtggggctaaatcactttaatattcacttgcactcaagtaaataagctgagtttttggtaattaataggaatggatggggtcgtatgacagagatacctgatggtcatggttaaagagtgaggagaattaggaaataattatggggccctttcctgccaccaagaggctcttctcctgggatacagggatttcagaaaggaaatgcgtaatcataggattatgggggaagtgagagaagaaaaatataagtaggacatcaggaggaggtggagatttgttttaactctgtgtaaatggaggaggcataagagaaaatttatttataaaacaatatgaaaatatgcagaaagagtcatcaagacattcctatacaagatcacagaaatccctctaaaaagaagcccaaagctatatcaacaaacacattcataacactgttatccataacaggaatttctaaaagctggaaatgtcctaagtgttgagagctgagccatttgctaaatcatggagtatccataggaagaggtattatataaccatttaagattatgattaggaagactgcatgggagcatggagcatatatcatctatcaaacaatagcaggactaaaaataagccatttggtatgttggcatatggaaaggattagaaagtaatatattagtcaaaataattatttggactggccagactgggcttttttcccccttctaaaactttcttggttaaagcaacattatatatatattttttttaaaaaaaaattaaaaagagaagaaaatgtattgttaaaaatgggatttaggaactctactcaataaacatgtgctcaagtagtgttgagggtaaagaagaggcgctttttgcagagaatccaaacatgaataagccgcccatcaccctccggggatcacagtgccgttaattccaccggtttgaaagctctgttgcaaacccttcagagatattttctgggactcactctctttttgaaggagagaaagcagaataacaaaattcaaggtcacagattatgagtgtttaatatctaaaaattatttttaattgataagtcatcatcgtatacacttacgggatacaagaggactatagtcaataataatgtgttgtatatttcacaataagagaatacatttcaaaaaaaaaatggtaagtgagccttgagactcactcttaagccagaacaaaattaaggaaaaggtggatgcagggttaaaaccgggcctgacctgcttgcccacgttggccggtgaagataaaccctattttcttcctcatagcttccttaattcaattgcgactgaaacagtgtatcatttcttaggaataatcaaatttagaagggtgcccccacatcagcctcggcaatattaggttagagaatttcaagatcatttatcaaatagaatttaaagcaggaccagagttgtacattaaggaagagtgcacttagtgatagattcttgagagaatataacaaggcagttagttataaatgaacataaccttttgagacctttggatgatggggcgtggagccgcaccacacttgcggccatggcagatcctgtttctcgtcctgtggagggagcagcttctgaacatttggaggcttttccggtcgcctcgggtagggcgggggagggctgtactcggtgctgccaagaattctccttcgtgcacctaatcgggttctgtagattactttgtggaattctcccgtttgggtggagggaacacctcttcatcataattcctaaatgtttcaccattggaaaatatcaaagtaaaggttccatctcctggtctttgtagaataactgcgaccttttcttcctttaaagtgctgaaatactgtcagtcccacttactgtagcagttaatcttatgcctctttgttttattattcaactattttgcttttgaataactttatttcccagaccaaatgtaagctgttgaagaacaaagaatgtttttcattagacttttgtcttccacagcccgttgctcagcattgtgcagagtgtaggttctcaacaaatacttgtgaaatgaatgccatccagaagggaaagtaaaattaaatgtcagatttatagacataaggtccaacattcatggaaattggaaaactttgacgttataacctaaaatttttgagatttaacaacttgtctgatggcaaattaattcagcagttcagattcagttcagattgtgagcaataccaaggaagaaaatctggattttcgagtcagacatttgtcttaaaatgtttgttatgctgtgaaagatcttaaaaggaagatagagagtgctcctgattaaaacctgtcaggatcaggctgaactcaacaaggcgaaaggacctgaacttcttgtctttccaaggacgtttcagaggatgaaagcgcctcacttcttgtcccactaggacaccgaggtgatcgtctccgcagtgtcataaggaacagtgaggcctcgtgggcttgtgcccctcacgcactctccggtttgaaattggggtcggccctcattctaatgccctgtgagggcctcagaggttattgtctgggttgttaaacgtggagacagagagggcacagaacagaagataatttgctcacttaaaacaagaggtttctaagaacgtttggagaaattttagtgtgtccaagtcagttatttgtgaatgattcttctggacctttctgcaaagtagacttcacagggctcctcctttgcagaattttgttagccctgattgattattagaggttaattatcaatactggatactaacgtacttctgccctttgacgtgggtatttgcacagcccacgaggttttatttcacttctctgatgtgtggggaacacagtgccttactcgtgctagagcagtgatagacgtgagcacagataatcaatgagtcaatttcaatgacagaccactttggtttttttttagactgtgggttttacttttgttcttttgtttcatttttttgttgttgttttgttttgttttttgtgtaatagctcacatctagttcagctatttccactctaaaaaaagttagcaaattagtgaattgatttttctgtttgttcttcagtttgaaaacctcttcatttatctgaatggttttagttttccctttaatggcttttatggccaggaactgtttgaaatatgttttaatttcctccattaggccagatttaattaacgtacactatgcatgttggtgagctgagtgtgccgtctgacctccagcctagatcgctctagagcctgcgcctgtcccgtgagtgtgaggccaactgtgcactccagactcagttcattcataaatctaaactcactattgtttctgccaaagctctgccctgtaagtggtaccaccatctcttctgtgccaggtcagccaaattcttgactccccttcctcccccaccggcttgatccactatacattttatgaattctgctttcttggtatcatgaaaatccaccttcttctttctgttcccaccatcacctcatgcctaggttcctgtaacagctgccttcttggtttttctaccccaaaactacccctactccagaatgttctccatctctcactgagtgatctaaaatgcaaatataatcatgtccattttcccatgtaaaatccttccactgttttccactgcctttaggatagaacccaaaccccttcacatgctttgtgaagcccacctgaggtgccatcactcccctgacctctcctgccacccagtactcccaggctggagaccagccataatgagctacatccagttccgcaaatgtcccagaccacctctcactgcgaagactttgtatttgctattcacaaagtccagaacacactctttttttaaaaaatgttttaaaagaccatgtctagctctatcacccaggctggaatacagtggtgtgagcatggctcactgcagcctcaacctccttggctcaagcgatcctcccacctcagcctcctgagtagctgggacctcaggcacgtgccaccatgcctgtttagttcttgtattttttgtagagatgggggtctcactgtgttgcccaagctggtctggaactcctgcactaagcaatccttctacctcaacctcccaaagtgctgggattacaggcatgagccactgtgcccagcccaggacacactcttaatcccccacccctcacccctaactccaatccctgaagattgggcttgagacccctctgctctgtcccctgccactctgccattgccttatcaccacactcatcactctctgcttttgtgacctgtttccttgttattctcccccagccaaatccaagctccttaggaacaagcacctctcgtgttcactgctgtgtcctcagccactttgtgtagactgttagtaagcattaaatacgtgttcaaaggttgaatgggtgactcagtcaattaaggcatattatttacccaagatgaaaatcaattacttttttcaatttaagcgtaaactcgatttatgaatttttatgaaatttgtttctgtgttttcacctattggagatgttggctgacctttcatctctagccacaccctgtggcatcctcctttaaattttagccttttcagccaccacatgggtcccaattaccatgacaccgtgttcaaacccaggctcaccagtttctagttacccttcagataaaaaggttatgattgcacgtacatgtatctatttaattaagctagttttctccatggccatacaaagtcgtgtttctaaaattagctgggtgatctgactgtttagtggaacttgagtctttagaaggtcctcagataccactgctgtctacttcctgtaaatctaatcatcacaggacaaggtgcaggataggcttgcttagggaatgctgccttttaaatttcctatgttactgcatgacaagattagttgactctgataactccctacaaaagactcagaataataaaggaataaattaatcagtcaatggaaaagcaaacgatctataccaggctgatgaactataatagaacatctcattgttacacagagtcagccgtctcccactgccctgctgaatcctatctgaacagtaaatctgtgttgtaacagagccagcatggcaagcagctgctcagctggcctttcccctcctgtctcataaagaaaaatgccaatgtattcgtaatttcccagtgaggtggcagagtctgtaaatccttttttccaataaccctaaaattttactagccaacggttcaacagcctggtacacatttagggaaacaaaaggtttatggtggcagatgattgtttagaataatgtttcttaactcagctacacttcaacttgtgtaactacgaatgctgtggctgcatgcccagaggctctggttcgtttggaccagggtggggcctgggcgtcagggtatttgaaagctccccaggggcttctgatgtacaaccatgtctgagcatcctgggtttagatgcttacaggcgggactgggactggatgacctctttaataaactttgaagtttcaaggtcaacattccaacttcataataaaatatagaatctcttagattatatttttaatcaccaggcccatcacaagggaggtgctgaatataaaattgctggtcattaaaacattgccagggaaattgttgcttcaaaaaggcagctgtacttccttagatcaacatgcatggcttggccacgttgtagtttactttgctcctggtcaattcaacttaattcaactcaaagttaagatcaggatgtgataaaattattttgttttctttttctttgaatcctggatgagaagtcattgtccaaatcattaggtgttttatgcaatattaccaatctttagtgtgattttccccccatcaaacctataaacaataaacttttctaaaagaaagcctgccatgatggaagcactgggtttcagacagcaagtctcactgcatggctgtgcaggttgggacatactaacttgtgataacagcggccttttagatagggctcacaatgttcccaccaccatgctaggcactcagtgtattactgtctcttttgctcacaatatctctattcagcagtgagaaaatagaaattcagaaaatggaagtaattttccccgggtcacatatcagggatggtgtcagaactgaaactgaagaagtcgtgtcccagcttcttcctttggaccgaactcttaagtctggactctgttcagaatgacttctctcaagaccaaatgttctcaagtctatgagaagcctttgaacacctcttaaatgcactgtaaatacagtgttattaccatgaacgtgatatttgtatatttgtattcaaggccaccataaggatttttttttttttggcaatgcacagaagctggatgtctcccgatacagcatctggtgtaattaatccgacacccttatctctccccactgagcattctcaaagggaatgaaacattgacctaactgatatttccctctaaaatctttgcaggttccataaatgagctgtcagagccccagggcagacactgaaccccaactggaataaaacgttcctcctggagagggtgggtcagttatccagcacagcattcctcacatcccaggggtgtgcagagccctttcagagctggatcaaacaaatgaagcttgtatgtctccttttccagggggtgacctaagtatttgatgttagttttctacgcttcattattttttttatttcggatgcattttaaatgttaatgaaatattttatgaataaagagtaataaaatgagcactcacatgccctccagtcagcatgaaatacagagcattcccaagcatgcccagagctcggactccaggtccaccgggttccgggtccctcctccaccagaccaaccactcctctgaattttctttatgtttccctgccatttatggatctctaaacaatataccatttacattttgaacattatgtaactgttaccagacagtatctatactcatgtgacttgaggttacatcaacatagtatagatactgtctgtcttgtcactatacagtaacatgagtgtagacgcttgatgtaccctgagtgtacatactgtctggtaacagttacatcaagttatataaagtctcctatattatcttgtatgaacatgtggaagcattagctgtaattgagtctttttcagttttctgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaatatgtggtatagttcccagtttatttacttaaaaaatactttctccataaatttttataattttctccaaaacagcttgcaaagctggtttaaatttactcttacatatcttctttggatatttttggtacatgtttcattttgtaaatgtaatttttagaatttatgtctgctagtgtattagtcagggttcagactaattagttagagggacagaactaacaggatatatatattaacttacacgatcacaaggtcccataataggctgcaagctgaggggcaagcagagccagtcccagtctcaaaactgaacaacttggagtctgatgttggagggcaggaagaggccagcactggagaaagatgtaagcttggaggtttggcccatctctctttttcatgtttttctgcctttttcatattctctggaagctgattagattgtgcccacccgattaagggtgcatctgccttccccagcccactgactcaaatgttaatctcttttggcaacacccacacagacacacccaagattaatactttgtatccctcaatccaatcaagttgacactcagtattaaccatcacagctggttaatagaattgcacttgacattttctattgattttgcatccagcagccttgctaaactcatttacttccaataattgatctgtggtttcttttggatcttgtatttagataattacaccctctccaaataatgacacatttatttcttcctttttcatcctcaactctgccttatttcctgatcttactccactctccagaaccacccacactatgttgagcagaacagcaatagtgaagatgcaaccctcgccttctagctcatcatagaggaaatgctcccaagtttttgccatggaatgtgaagttgctgtagattcatttgggaatgaccttggtcagtttcaggaaggccatttctatttctagtttgcacgatttatttgggaatgacctcggtcattgggttttgtttctttggttggttgttgttgttggtcttgtggtctgtgttctgtttgtctttattttgaatggattttgaattctatgaagtatgttttctgaatctattgaaatgatcatgtgggttttttttcctttaatctgtcagtgaggtgtattgtattgtcagtagaaaaccagccttatgtgactaggatagatgtgattgattgggatgtactttttaatatatacctagctagatttttttaacatattttctttaggatttttgcgtctgtgttcatgggtgaaattcgtctacactgtgggacattattgaatttaaaatcagtttattagaatggtaggtacttaagtaggtacaaacacaaaactatgcaactataaagccatatataatttaccaattcacttcaacaaatctacgaaagcaggaaatttaaaaacaattatatcaatttgcagtgctgatgttttactgaaagtctctggcagctggaatatgatgacaatgctgactgctccatgaattttcctttcttctcctgcattaccacgtgacttgtcatgacttaatttcccatgcattttctttatttgacctatagagaaaccttctttggaacaatacagccatgttattgttgctttgcttggcaggaatacatctttcgcatgtcaagtcccttttattcttttctcactggcccacaataactaaagcagtactacttggcaccagtgtgcttataaacataaattcaggccctaaaatcaggatagaaggacttgcttattggatagtcatccaggtggtccacaatatgggatatacattttactaagattctcatcaaaatgaacatatgaaatgtcagtgttttataaggacctgtgtcctcagattcccaggttgttatcactcagtttgagaagcatcccatccagagtttttacagaaggaattgttagtacagtttgctaggctgcatttgaaccaatgtcggccttcccttaggaccagcagagacggtaagcagaacttaggtgagtggtaaggagtcttttagagaagtcctcctccctcgagggcctcactcaagatctgactttgtagaaagcagaacttcacactgactttgagtaactgtcttccatgatgagctggggagagaatggaacggtgcccatgagactgtaggacttcatgaccttcagctgtttctccacacagagtgctctcagcctacagcgagagaggaatgatcccaccagctggaaatagagaggactgcaacccaaaccaccccccaccccgcatcatgaggcagcaagagttggacatatcttctccccatcttcccctggacacaccctacagaaagtcctgtggaaacaccccactatgaggctgccttattctcatgttagcctgatttgcaatagggaaaatgttgaggacacaaaaaaccctggctttatttgccctgatcacttcatcctcatggtggtaaaaatgccccatccatgcaacaagtcttcaagcacctctcatgtgccaagcagcccctgccttaggaccacccgctgttaagtgttcactggtgatgccactgtcttaccttatgagcactaaatgcttaagcagggctggtaaaacatagaacatttctcaggttattgtttcaaaatacactgtggttgtcaggcggaaaaggtttccctcttaggatcacctgtgacgagcaacgtcaaagtgttttggtgcaactcaaatgctttgctggaactgtttttctccatacaatgtacggggaaggcttccatgtcatggaacaaagtggtgaatgttcaaatggtcagggtgtgatttcatgggctgcatggattaaggaacattgaaacataaagttgaggacattgctctgttttcaattctctcaaacttctgttttccgatgaggagcatgattttgacacctcctaattcttgctcatgtctctttttaacaaatggagagtgagcctcaggcccagaactccaagcaggactgggcagaattcattatcatgttttggttttttggtatttattttatgcttatcattacttcactgcaaagaatactggtgttccatttatagtagtaatacaaaatgtccctgataaatgaaacttgtttacataaagagggaattgactgaaaagaaaataaagcagccgggcgcggtggctcactcctgtaatctcagcactttttgggaagccgaggcgggtggatcaggagttcaggagatcgagactatcctggataacatggtgaaaccccgtctctactaaaaatacaaaaaattagccaggcatggtggtgcacacctgtagtcccagctactcaggaagctgaggcaggagaatcgcttgtgcccgggaggtggaggtggcggtgagccaagacggtgccactgcactccagcctgggtgacagagtgagactctgtctcaaaaaaacaaataaataaataaatgaaagaaaaaaaggaaaagaaaagaaagcaaataatagtatcagaggtactcacaaaggtggttagtgtttaaccagccttgggaagtgctcctgtcagggaaggaagccagggtttagcaacaacacacgttgggtggaaacccagccctcactggattgatgatgtgtataacccctctgagcctcagtttccccattcatgaatagggcaaaaagacctcccagggatgctgtgaaggttaaaggcaataacttataggcagcattccttatgtggtaaatgttagttccctccctgatgttggaggagaaatctattattatcttgaatctgggccaaagacataataatatttgcataagtgatgaaagatgacaaaatggaaaaacatggacttgtagcaagacaagcctattagctttttcgaccttgaaacttctgatttgatttcctaatccataaaatgaggaagattaagatacttattttgcataattattgggcaaatctgaggtaatgtatgtaattaagtcacgtcctagtgatcacatcaagtacagagtaggcctcaatcaataacagctgtttgttatggtcctcactggggaaggaccatgactttccttcctcatgtgagaacctcctttatctttcaaattgtatcctcatgtgcataaaatattcttcagagtttgtagggaaatcgtttgattaatgttggggtcaagaagcaacaaggtgttgcggggacatcctctagagccttgagaatttggggtgtgaaattctaatttctgagatgctgatgtagctacagattctacatagagacccactcacctcattaattcaaggttcagggcactgaaagcgcatctacccatcatccttttctctttttcatacttttatttgaaaactattattctctctctcttttttttttttttttttgagacagggtctcactctgtcatccaggctggagtgcagtggcacagtcatagctcactgtagcctcaaactcctgacctcaacctcaagcaggtgttcctcccatctcagcctccctagtcactgggactaccggcacacaccactacacccggctaatttttaaattgtctgtagagatgaggttttgctatgttgcccaggcttgtctcaaactcctgggctcaagtaatcctcctgcctcagcctcccaaagtgctgggattacaggtgtgagccactgggcctggccctctttatttttctactgacaattaaccttctacttgaccagaggtctttttaaggattaaagagtggtaatttggctcccctaaaattcacagctgtgagtgtgctgtgagttgtgtgacagctgcattgcagttgcaattgtgtgctagtttctaacaaggggaagcaaacgctgacgtggccgagaaggaaggcccttactatgaggcttccgttaagtctcctccaggtcacattttcataacaccaagtgatatttttcagcttgaatgtctcctgatattataaggagtttgaaattttcctttattaattaacattttcattttgctcacattttggagagcactgattttccagaagtgctaattaccaagctcacagcagaaggttggctgcattttaaactatttcctcagatgctccctgctgaactcagagatgtcctcattcagccgagccagcctcccaggtgggtgggaggcccctggctggtgccactcacagactttgggcttcttctgaacccgcggagccctgaaacaccaataggcccacactcctgagggggttctggccacatctgcctttaggaaagatctgttcattggtgtaaaaccctgacgtgtgacatcagaaaaccagagcacctggccatgccccaaccctgtagctccaggcagacctccctatgatgtggcctgccatagtcatgtggctcgtgatgagtctagaaggcctggaagtttctgtctaagtctgggcaaaaacagagggactcacagcaccccttgtggtgtgagagtaatagatgcatgcatacatgtgtgaaggcttgtttgcagatgtctccatctgttatgtctgagcccattcaggctgctctaacaatatcgtagactggggtgcttagaaaaaacaaattgatttttcatcgtcctggaggctggaagtcaaggttaacttgctagctgattctgtgcctggtgagggcctgtgtcctggctcatagactgccttcttctgtgtcctcgcttggtggaagggacaagggacccctctgtgttgtcttttgtaagggcactaatctcattcgtgagcgttctcccctcatgacgtgatcatttcccaaagacctcacttcctaataccatcccattgggggtgggatttcaacattggaacttggggaggacacgaacattcaatgtgtaacaccataaagaagacatgggaggccaggctcagtggctcacaactgtaatcccagcactttgggaggccgaggtgggtggatcgcttgaggtcaggagttcaagaccagcctggccaacatggggaaaccccgtctccactaaaaatacaaaaattagccaggcatggtggcgggtgcctgtaatcccagctactgggaaggctgaggcaggagaatcgcttgaacccgggaggcagaggttgcagtgagctgagatcacgtcactgcactccagcctgggcaacaagagtgagactccatctcaaaaaaaaaaccagaaggcataggaatctggtatgtatgtactaatcttcaacattgacggtccccagcctttcaatccttgatgtaagtgatgaagatgagcttctgatctctcaaggcccggcggacccctttcctaaacctggggttaccattttcccatgcctgggggttttcccaggacattcatgctgataccaggacagtcccgggtaagcgggatggttgctcatgctgttgacaaggctctggggatcttggcgccaccaccttctcctcgtgccacacacacacatgcacacacaccacccatgccagacttctgaatctcatcttatgagtccattaattcactgttccccacctgctatatgtgcccaaagatttgagatttgcatagacaacattttgaaaagttttatcctctgttttgtcattaaaatagaccccgtgggtgggtcagcaagtgatattaggaagacgggggtgagatggtatcaaatgaagggaagactacagggctggcggcaaggacacagatttggggtagcagccagacttgggaatttggtgagggtgcatgacgcccaagactattgcagagcctgatgcctcggcccccgggtacctggaccacagtggcagggcgccagaaagggctgtgagggaactaggtcagcaaccaaaaactcacaggagtcaaacgaatactatgagccactatgtttgcccagagctgtgctagtgtgtgtatgagatttttaaaaagggaaaacgttactgttgcctgaaggagattaatatgtggataagacatacatacatgacagaaactaagaaagttattacaagattttaaccagagtcttaccaccctatttttaaggcaggagaattgtatgaaatgattgctatagttcagagaggtgaagtaatcctctaaatcacatagtgatttggtgttttgtgagtttggagaaggagaggtgaaggtggttctggaaggcttcctccaggagatggggcagactcgggctctgcagagcaggcaaggtcatcagagaagcggagcagcagagacctggaggcaggctgtgaggtggctggcgctgtgtggatcagggaggtgccgagggtaggagaatgctggcctggttctaagtcattggccctgcggcacgtggcctgtctggaaatgagttcctgcagacactctggacaggcaggagacctcaatgggcactggggcaacctgggccagctgtaggcttccttcctgatcaaacaagcggaccgtgctgagacacctccccgaaagccacaggtctcagccccttcatgggtgaccctgtgttatccacctgagaaagggcccaaaagaggcctctcagaggaggcaggccctgtggcagcacgggccttgaaatcggcccccggggcccctgtggcttcagtccagggactccatgccgggcgctgaaccacctccacaaaactcatgcgatcctcagagccccgcctcatcagccggaggacaggggtcacctgacagtgtgtctgaatgagcggaagcttccgttctgtgagagctctgggcttttgtgaactgacacggggcacagccacccgggcccctgggtgtggagtaacctaagaagtcgtgtacccctggggtgatgaggattgaggctaagatgggcagagggagaggaaaggttacacgggacccagtgacaggagtcgcagtgagttcagccctggtctgcccagagcagtccaagtttacccgggagtccaggggaagtcacaaatagagcttcctttcatgtgcaaatgtcccctcatttggatgataggttataggaccctcctaagtttggtgacttctgaggtctcaggctaagacatttctttgaccccactacagatgaagtacattgtttaagtgttggagggagtggcctagcccagggcccagagctggagcctgccagcctggtccccatccaggcccttccactcatgggctctgtcctgttgggcaaatcacctaggctgtctgtgcctcattttcctctaatatggatatcaacatagcgcccacctcatgggcttatgaggatgtgactcatactatgcgtgatgccgtgttagcctttgttaatgagaacctcctggtcagagctgtgctgtgggcagccaaaggccgattatggagaaccacccagagtggagttaggagccggcctcggggggccggtcacagagtggctcagctggtcagaaatcatgtctaagtctcacacaggcaggaaaatgcgacagtgagaaagggtcctgtcccagcccctgagagagtacgattctacaaagaccctgacacctgctcttgtgactgagttgcataaagtaggggttgaattcctgagtccactaaagacatgtacttccagaatggtaggagtgaaagaggggtgaacatagatggagaaccaagggttttcccaggtgctgtttgtaggtcacacaggggcacagtattgatgggaaagtcagcctcaggcatcatgtgcatcattcaaggtgtcccgtcatgttcctggcagagttggcttcatatccaacttgcctgactccacagcagcctccctttaaggaggcttggacaacccaggccgccatgaccggaaccccagaacctgcccacgagaagttgctcctgttctcctcctcccctgcgaggctcctctcaggccagggcttccaagtcccatgtaggcctccagagccaagacccctgcagcaccctgtgcactcaggcagaggaaagagcccaggatcctgcacagccccttggctctgctgtggcctctcatcgggccccttggcattccaggtggccctgccatcccacagacatcctccaggaagccaaggatgggaaggattctgaggtctgtttggcagaggtcacatggatacgttatgggagaggagtggtgttctggcaccccatggcttgaaggtttccattgttttctctgttgatataaagactggttttcagacagaggcaataagggaagaaacaataagtgagaaggtgaaagaggtcagtgttagacgtaaaaatgccacttcttctgcaaggttttcttgaactcccaggttcgaattcccaccaccttcagccatggcgtgcgcggctctgtctgtacactcagtgtacagtaaacatttgtctacaggtctttcccgtaacttgtgatatcccacacagcttaggatggtggcatatttattattttatcaccaattcccagtacaggtgctaggttcattttaggcatttggttgaactttatcatttatttattttcccattataaaaataatacagaatatagtaaaaaataggaaaaaaagcctttttaaaatagcatcaatagacccagtatctaaaattactattaatattttagtatgttttctaaatctatttccaagaatagatgtatttttttagttacaattattagttttacatcccaaccttttgatacaattagcattgtatacaattaaatacttattgttaacataattttcatagttacatagtatttcattgagtcgatctaccaaaatgcaattaaccattttccagctagaccagctggaccatgtataatattccctgttatcactgatgctgtgaagcacctttgggtctaagatgttccttgagtggaattactgagtcaaaaactaggaacacttttttatatacacttttgatgtatatttgcgaattgtcgtccgtatgcctcatcattcatcctgattccatgctcaccagcatcaggtgaatatgcaattcgttttaaagagaacttgctaaggctatgattttttaaaaagatctctgctaatataatttaattgcatagctatttaaatcagcatatatttaattatattctatagttaattaaattcacatatatttaatagtaaattgattttctgtaaagtaataccagtgatatctttcttgtgattttattcttgctccatttatcttttaatgtcttggtgtgtaaataaccaaaaagctccctgaaggggaaagacagcggaaatcggaaatcacctctgagtccttcacggtccagccaggagctagtctcaggcgtagcggagcccctgatgcccatgccagaggcagcgacttctgagctgggttctgtgattcccctgctcatcctctaggaggcactaatgagcagcagtgagctgaggaagacgaagagccagaggactccaaaacctggaagatctgagtaacctacagacgggataacgagcccctgtaggctgcagagaggttggctgctggtcacaccaccctggagaagagcacggttccaagatcagccacccagggaacctgggagggaagcagacactgtctgagaagggaggggattgatgacttcactgaaccctgaaactgatctcatctgctccaaatacctgggatgatccgggagacttagccaggaacatctgaatgatgtttcatgggtagcattttactcttgctagaagccggaggccactcgtattaggactgtatacaaaaaggcccagaaacttaacaagaaaaaaatagattttttcatcaccttagaaagatattgaaaattcattcacttctttgcagtcagagggtgacttctggcagctgacaagtctcggatctaactgcaatataaaaagatttgtggagtgagagagtgcctcccactgctttctaccagtcaataaatttgtcagtcctctgaaagctttcagagagaaaacgttcacaatatttgtgttttggttcagacctgctcctataaaggccccgtggcccagccttgttactttcagctgcaagaggcagcagctgagcccagtgcaggggctctgagtcacctggggaacttgccgcccccagacagccgggcccctgtgcagagtgtgtgactcagtatgtctggggtggggcctgagagtctgcatttctaacgaatccccaggtgctgctgagtggctgggcccagagtggccttggagaagccctggcatgattgcttgtgccatcaggctgcctagttctgccccttatgggcagggcgaccttgggtcagggctggcttctccaagcctgcatctcagttccataaagtcagaacagcaccttcctttcctaggtgttctgacgaggggagtcttcagagtgtgggctctggagtcggacagcctgggtccaaaccctggctcctcacctgaaaagggtgtcctcttgggccagtgggctccttcagcaccctaggtaacatagccctgaaatgaaaatcataatccataataatgcctatttcatagaattataatggggattaagtaaattaatattttaaagtcttcagtgtttggttaataacaagtactatgtgaatgtaaaataaaataaatatgtgcaacacatccatcaatgcatggcaccattacgagccctcaacaaagagtggttactatttttggattcattggtacatggttccattaatcaataaatatttagcgtcaagtttctacaaggttctggtgtaggcattgaaagaagcacaagatctggtttcccttgtcttaaagattataattttgtgggcagacaacataaaacagagttcagtaacaggagtttctggagagtgctaccagcacggttcacagagcagtgggccagtatcattttttgggagagatcctcaggcagtggagtgacaggagaaggtttcagaatgttcagactcaagttgggcctggagcattttaggctgaaaggactgagaagaatgatgcttcagggagtttgctgctgttgcacgtgattttcttgggctggttcagccttcttcaaaggccatgttccaaaatcagcttcagttctttaagtaaattctcaatgagatcgtttttgcatgagcatcaaaaactgttgacctagcgaagaaaatgtgcatctacttccccaggatagggcggtggcccctcgaaccccatcacacacacagacctcatctgtccaggtaaatgagattctcaatgagatcatttttgcatgagcatcaaaagctgttgacctagcgaagaaaatgtgcatctacttccccaggatagggcggtggcccctcgaaccccatcacacacacagacctcatctgtccaggtaaatgagatgcccagagaccttcccatcagacagaccacagtccagcccttgcccaagggctcagatatgacagcaaacacttaaccctccacccttgccatcaccatcactcatccccatcaccccccatctgcctggatttgtctccactcaccaaaatagcccagagatacggcaggctttttggaggatctggttgacccatttcctatgatcctccaggatcctcctggagttcccaggtgaaggtcaggccgcaagaattaacctgcactctagagtcgaggaaccagccagagctcttccagtcttcctgtcccgctttgcacgctcaccacagactgggctttccaggcctttctcctctgcctctcatcaacagcccccttgtgctgataaccacgcaggctgtggtccagtgctgtgcccaggtttggtcagctttgtttagatctaagcctataccttttttaaagtataacccaacgctacctagtttaatttgtccaaaatgccaagtgatttctccacgtgttttgattttgaaagctgaacatccttatccataggcattttaatttggagagttggagagtgtcatgagctttgtcatttgctagggtgagggtgatccaggctgagccgccaggctgagtgcactgtgaattagcgtggtgtgcggggagttactggagtagtccctgactgccatatcattgcttcactcaccagatcatgcatcttcccatcattgcttctgttgatttatcctcatttctatggctgccacctgtgaaaggttcataaatctccagactgcatcgggctctaccttcattgggccagaaaaaaattcaaacccacaaagttattccttggaaaatgtagaggtgagatctcctccagaaacaagcatgctgatagttgaatgtggcacatgagatgtcactcactatccatctgccatcaccttatacaaatgcaggcacgtctcatctcattgcacttcactgtattctgctttgcacatattgggttttttacaaattgaaggtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccacaaacaggccatttccctcacctcctcttgggcctccctattccttgacacacaatattgaattaggccaataatatcttataaaatggcctgtaagtgttcataaatggaagaattgcaggtctctcactttaaatcaaaagctagaaatgagtaagcttaatgaggaaggcatgtcaaaagcaccacgataggctgaaagccaggcctcttgtgccaaatagttagccaaattgtgaaggcaaaggaaaagtctttgaagaaaattaaaattgctgctccagtgaacatgtgaatgataggtaagggaaacagcctggttgctgatatggagaaaggtttcatgctctggataaaagatcaaaccagatacagtattccctgaagccaaagcctaatccagaacaagatcctaactctcttcaattctgtgaaggccaagggaggtaacgaggctatagaagaaaagttggaagctaacagagggtggttcatgaggcttaaggaaagaagtcgtctccataacataaaagtgcaaggtgaagcagcaagtgctgatggagaagctgcagtaagttattcagaagatccagctaagatcattgatgaagatggctacaccaaacaacagatttttagtgaagacaaaacagccttcttctggaagatgatgccatctaggactttcatagctagagaggaaaattcaatgcctggctttaaagcttcaaaggacaggctgactctcttcttaggggttgaagtagctggtgactttaagtcggagccagtgctcatttaccattctgaaaatcctagggcccttaagagtgatgttaagtctactccgcctatgctctgtaaatgcaataacaaggcctggattatagcacaactgtttataccattgtgtaatgaatattttaatcccactgttgagacctactgctcagaaagaaagatttcctttaagatattactgttcaatcccagtatgcctggtcacccaaggactctgaaggagatgcacaaggagataaatgttgtttctatgcctgcccacataacatccattttgcagcacatgaatcatggagtcatttagactttcaaatcttataatttaagaaatacatttcatggctggcatggcggctcatgcctgtaatcccagcactttgggaggccgaggcaggcagattacctggggtcaggagttcgagaccagcctggccaacatggcaaaaccccatctctactaaaaatacaaaaattagccaggcatgatggtgggtgcctgtaatcttagctactagggaggctgaggcaggagaatcacttgaacccaggaggcagagattgcattgagccaagatcatgccatggcactccagcctgagcaacagtgagacactctgtctcaaaaaaaaaaaaaaaaagaaaagaaatacatttcataggctgggcatggtggctcacgcctgtacttgcagcactttagaaggccaaagcgggcagatcatgaggtcaggaatcgacaccatcctggctaacaccgtgaaaccccgtctctactaaaaaatacaaaaaattagcagggcgtggtggtgggagcctgtagtcccacctactcagggggctgaggcaggagaatggcatgaacctgggaggcggagcttgcagtgagccaagatcgcgccactgcgctccagcctgggtgacagagcgagactctgtctcaaaaaaaaaaaaaagaaaaatacgtttcataaagctatagctgccatagatagtgattcctctgatggatctgggcaaagtacattgaaagccttctggaaaggatttatcatcccagatgccattaagaacattcatatgcattagaggaggccaaaatatcaacattaccaggagtttaaatgaagttgattctaaccctcataatctttgagagattcaagacttcagtggggaaagtcactgcagatgtgataaaaacagcaagataactagaattagaagtagagcctgaagatgtgactgagttgctacagtctcaggataaaacttgaatgggtgagaagttgcttctaggaacgagcaaagaaagtgtttcttgagatgaaatatactcctggtgaagatgctaagaatattgtggaaatgacaacagaggatttagaatattccataaacatagttgagaaagaagcagcagggtttgaaaggactgacttcaattttgaaggaaattctgatgtgggtaaaatgcaatcaaataggattgggtgctacaggaaagcttttgtgaaaggaagaatcaatcaatgtgcaaacttcattattgtcttattttaagaaattaccagttatcccaaccttcagcaaccagcccctgatcagtcagcagccatcaacatcaaggcaacaccacctgccagcaaaaagacgatgactcaccgaaggcttagatgattgttagcattttttagcaacaaaacatttttaataactcacatacatttttagacataatacttttgcacagttactaatctacagcagagtataaacataacttttatatgcagttggaaaccaaaagatttctgtgactccctttattgtgatattcactttattgtggtggttggtggtctgggactgaacctgccaaatctttgtggcatgcctgtatatggctttctgtttttatctttgagatagagtcttgctatattgtcgaggctgggtctcaaactcctcaagcaattattgtgcctcagcctccagagtagctgagattacaagcacacgccattgatgtgtatgtgtttaagcatggatgaaccagacaaggagctcctccagggcaaagaccatcattattcagaaacctggtacaaggaaaagctcagggagaggagagggggagaagggagggcatagaaaatattgtaactgtagccaaagaagtggatatatttgtcaggattttttagtgataaaagacaaaatgtcaagttaaactagactaaacaaaaaggggaatgtcttacttacctgggatgatcagaagtgggtttggcatccagggactcagacagcatcctggggcatgtctctgcctccatccttatctcctgctattttcctttcctgctttcccttttctgtagtctctcttcagctctacttctttctgcgtgttcatctcgctctcttccagtgcaaaacgtcttccatatggccaggaagacaaatcacccctgggaccctgaggtctgtatcattccagtgccaggacccagaggcaagaagcagtagactctgaagctccaggaaaggcatgagaatacctgacccacccagggtgtgtcagaggccatcactcagggcccatggctggggtggcagggatggaatcctgcagatttacatgcctgagtggtatgcccattgtgggggccagggctcccagacagcccctgagtcacaggcataggggagagatggcctcaaactaggcaaacaaaaagtggaggtcaccactacagcagttagccagaacatgtgaaagtaaaacataggcaaatactatcttaagtcattaatccagtgaatatgatcttctatttgttggtagaatagagcaactgtagctgagctagtgattacagcaacatctgatcaatgctttcaactcagacaaagtggccagtttcctgcgtagaagggttggaaggcctgtgaaggccactgttgttccccatctggcccatcctgcagatgtcccccctctactcggcccctatgcagcaatgagggcggtcatggaaaacaaaattctcaccttctcccttgtttggaatgtcctggaaccatgatgacaaccagcgcccttcagtgactcccattgttctcacacaaaagcatggagtcaggagtgtaacttctaggatcctgcgtcccctgccacttctccagcttatcctctcaccgcctgccttggcccagctgctgtggcctcctcccttcctcggaggattgtcctttcttgccttgcccagggcctcggtgaacgtggctccctctcctgcgatgctctcattccccttctttccctgggtagcctctgctcacccgtagatctcagctcagatatgattctcagggcagacctcacaaccacccagacaagaccctcagggtgccctgttggcactttttaaacttcctcccagcaattcccagactggagaatgtcaggatgcctggccaggccactcctagtcagcccctggaggctcagtgactccctgtgaggagggggagtttatgaaatgcacagccttgggcagggcctgatgctggttcctgtcactgttgtgcccacctctccatgtccctggactcattagaagggtgccatctcttcagtcagctaggaacttctggagctcctctgttacactaaatagcttcaagtggacactgaacacgtactatcaaatgcttaaaagcacaattttattttgagaactttttctcagctttggaaaaataatacctcagaattctccaggttaaaatgtgggttcaggaggtgagaaagatcccaagagatttctctgggtgggtgactctgaaaaggaaggttttcctttagcgtttgaaagctgcattgatgggaaggtctttagagtggtgttggggcttttcatcttgattttggttgatgttttgaaagaaggaatgatatgagtactttctggtaggaagagcaattttagattatctacaagcatttctctttcttggcactacactctgccctttggcattaaatcctgaagtaatttgctggagtggaaaatgatgtaatacattatactggtttttgaaggaaagggcagaggggaaaagtggtaaagtgagggaactacaagaatcctgtgattaaaatgcggtcctctgtggtaaggattggataggttgatgacacttattatgctaataatatgttacctttgaaagtgttttataacctccaggattttctcccataaattatctgctttcatcctccccacagcaccatgaggcaagcacggcaggtgtaattatctgtattttgtggataagaaaatcaaaatgcagagcagttaaatgattttttttgccatatcctagagctgcctaggcaagaaccaatgaaagaaccaagcattctggattttaggctgatgggttaatcatcagcctaaaatatgaaatactcactcagaataaacagttatagccattgcaaaaatgagatgagcccttgcatgccaactgctcagcacctcgccaggtccatcggacatgccccgagggtgtttgtggtgttgatgatgatgatgctgaactaaatgagaatcatcaggaatcttaaacctctcattgatcaacagctttgacatctcctctgtattagtctgttaccacgctgctaataaagagatacctgagactgggtaatttataaaggaaaaaaggtttgattgactcacagttcctcgtggctgaggagacctcacaatcatggcagaaggtaaaggagaaatgaaagcacgtcctacatagcagcagacaggagagaatgagacccgagcaaaaagggagaccccttataaaaccatcagatctcccaacatgtgggaattatgggaactacaattcaagatgagatttgggtagggacacagccaaaccatgtcatcctctatccatccgttacaagccagtataacaaaaggttgtgtatttgcccagctgagcagtgaaaagggaaaaggccaaaatatagggaatgtgagggcaaaatagagtcagtatttagtaactcacagattgaatgttgtgttcctgaaatagagcattgggtactctgagaatgactcctggcaattttaggactacttccatgggaaaaagcacataaccacgtgtatacatacatatgttattaaccttttagctcaaaggtaactgggctttccactaccatcagtttctgtatacaaggcttgaaggccaattatactttatttccagcagtctcttcatgtaatctctgcaagaaaagtctcttttgataggatttgccgactttttcttcagtgttcacctatgctcccgtcaggtgagcacactgcattcttagcagtgctgggtgtcattagtgttcagtctttcataatctgataaacaaaacattgtaataagatttctttttgttattttttagcaatttgtacagttctttgatcgatctgtttgtgtccttcatacacatatttatagctcagtgatcatgattcatgctttccacttgtcggaatttatcccagggaaatatcagagacacaggtgaaaatttttgtgccaagatgcacacaatagtattttattacgataaaaaaaccaaaagactgtatgtcaaataataagggattaattaaataaactgtcatatctcttcaagggcatgtctcaaagaatgtttaataacatggaaaagcatccaggtgtggtggctcatgcctgtaatcccagcactttaggaggcagagacagacggaatacctgaggtcaggagttcgagaccagcctggccaccatggtgaaaccctgtctctactaaaaatacaaaaatcagctgggcatggtggcacatgtctgtaatcccagctactcaggaggctgaggcaagagaattgcttgagcccaggagacagaggttgcagtgagccaagatcatgccactgcagtccagcctcaccgacagagcaagactctgtctcaaaaaataaataaaaataaaataacgttgaaaagcattcctaatataaattaaccattatattatatggccttagttttattaaaaaccagatttatacctctcctaccaacacacatacatcttgaaggaaatgaaatacaacaaagttgatttgtgtatgttttgtagagacaggatctcactctgtggtccaggcaggagttcactgcagtcttgacctgctggactcaagcaatcctcctgcttctgtgtctcaagtagctaggactacaggcgtgtgctatgacactcagctaattttttaatgttttgttgttgttgttgttgttgttgtcgttgctatttgtttttgtagagatggagtcttaccgtgttgcacaggctggtctcaaactcctggcctcaagtaatcctcccaccttggcctcccaaagtgctaggattacaggcaggagccaccatgctcagctcgaagtttattttaaggtggtattttgtatatgtgtgagtgtgatctgtaagacaacgacatttttcttttttttttttttcaaatattccacaaaaaacaaatacttgtagtcacagtttggtggcttttgctgtgctgttttccagcttgtaactggccagactgattctatgatctcaagccagcggttcacttttcaaaaaaacccaacactcctttacccagccccatctttgttgttggtatatctctctcgcttcttcttattactttgtagtaattttacttcagaaaagactcagaattcccaccatcatccagtttctgacatgaacccatggaaggcatactgttcaggaaggttggcctatgtcaggggcctgacacctgctttgaagcacccatcaggggccatgtgtggaccaagcatacattccggctctgcctgagtccacattcagcatcacctggactcagtaggatctggggcagcaacggtcagccagcagggtgacgtcacacatgtgcacctctcctgcagtattcaatgctgctgtccccccaaccacacaggagctgccttctcccccagcactgctgccagatgacagcttggtgcagggagcaggacatccacaagtgggtgtggaatcttccctgcccgatgcctctcaggagccaggggcatggcttcagggccccaccaggaatgtgcacgagggtcaccagactgggagaagtggcagctgtaactccctcccagtactcatggttctccttatctcaatgcaacttatcataaataatgctgtcatgaatagaggtaatattcaacccttatcaggtttccagggcaacaaaagcaggaagtcagctgatggtcaaattcgctgcaaagaggactcaccttaggttctgagtgccagagtgtttcttcaatctttcagacacagctggtaatcctaacttgctgttatatggcctattgatgaaaccactcgggaccacatgtggcatttgtagcacacccagaaattaaacccatgcagagaaacgagctcaccaggactccttaggttgtccttggagggcttcctcacctcacttgctagcagccactgcccaaggacctgctgtgttctctggtcagctttctgctttcagcagggtcttctaaaaggtacgtctacaaggttgcagatttggaggaagaattcctgtatcctggtgaagtgttttgtgtgtgtagagtgttccagtgacaggagttatttgcaggattggcacagtctccagtgaagactctcctgtgggcttcaggagcagtaacttgcgtatgatcattgctaaaccaatggggatagccagttccatggccagccaacctgttctgtgcttcgccctataaattatgttctatattacatacaacaggatctttcacttttatttactacagaaatgtcagtaaatggttcctgatgtaattagcttgatcaggaaatgtgataactcaagagaagccgtggaatagagagagaaatgcaattgccaaatagtcactactatgtggatatgtccttgacattaggaaagccgctataatgtgtcaattaaagaaacctaggcaatgtgataattgaagtttttaattgatatagagagagaatctatttcccccttaataataacatgttgggttcactatgaatgtttaatttcctttccatgataaatagttttccctagtctgggcatggtggcccacacatatgggaggccaaggcaggaggattgcttgaggccaggagtctgagaccagcctgggcaacagagcaagacccccatcttaatttaagaacaaataataaataaataaatagttctccttttcaacagaagtttggtaatataactaattaatttgctgaatatcttttactgatgtaaatatgaatgtaactattgaatttgacaaagtgaaaaatgaaagaaatctcttagagatcatccaacccaacctctaatgttatagtgaaggaaattgcattaaacagtgttgaataacctgctcacagctggacagctagtagtttcagactggaattcagggttccatttcaagtccaaggttctttcttttttatcatctcacccttagtagtattgctatcattttgtcaaatactgagctatgcaacatgtttcccttttggccttgattttccagaactaaaaaccaaatcgtgcctgattatagtaattattccatccctagttcctgatgtaattagccccctctttagctatttgtgtctcttttatcataaccattctgggaacatgcagattgtgcttttattgtaatttactttgaattggtttaagaaatattaagggtgtaaattgtcacttaatacacacacacacacacacacacacactcttcttctcagtaagttacctggaagttgtactaatcttttaatttctctttttaaattatcttagtgatgtaaatattcatgaaacttttggatttatttgacttttggaaaagtcaaataaagcctcaattagttaaaacccagccaactcacatgctaaaccttgggatagttttcctgtatacaacatacatggaaaagaatagcaataacacagataatatcaaggaaaacagtttctgggaatagatgtatatttgatctaatccatttttgtacatgcacaccaatagttttggacaatgaaaactgattatcttagtcaataataattccatattgtatacctcattctatctaataaatcaagaaagtataaagtctgaaaatatttccctaataaggactgaaattgaaaagatctcttctttagttagaaaattcaccaagaaagtgtatttaactgaaacttcccaatcctctagagaattccagtgtattagtccattctcatgctgctatgaagaaatacccaagactgggtaatttataaaggaaagaggtttaattgattcagttctgcatggctggggaggcctcaagaaacttacaatcatggcagaagacacctcttcacagggtggcagaagagagaatgaatgcccagcaaaggggaaagccccttagaaaaccatcagatctcatgagaaccagctcactatcagcataacaggataggggaaaacaccccatgattcaattatctctacctggtccgtctgaagacacatgggagttataggaactacagttcaggatgagatatgggtggggacacagccaaaccatatcattctgcctctggcccctcccaaatctcatgtcctcacaattcaaaacaaaatcatgcccttccaaaagtcccccaaagtcttcttccagcattaactcaaaagtccaagtccaaagtctcatctgagacaaggcaagtcccttttgcctatgagcctgtaaaatcaaaagcaagttagttacttcctagatacaatgggggtacaggcattgggtaaatatacccattccaaatggcagaaattggccaaaacaaagaggctgcaagccccatgcatgtccaaaatccaatagggcagtcattaaaccttaaagttccaaaaatgtgtttcacgtctaggtcatgctgatgcaacaagtgagcgcccatgggggcagctctgcccttgtggctttacagggtacagcctacctcccagctgctttcatgggctgacattgtctgtggcctttccaggtacctggggcaagctattggtggatctaccattctgggatctgaaggatggtggccctcttctcacagttccactatgcagtgccccactggggactctgtgtgggggctctgaccccacatttcccttctgcactgccctagtgaggttctccaggagggccccacctctgcagcaaacttctacctggacatcctggcatttccatacatcttctgaaatctaggtggaggttcccaaacctcaattcttgacttctatgcacctgcaggcccaacatcacatggaatttgccaagatttggggcttgcaccctctgaagcaatggcccaagctgtacgttggccccttttagcgatggctggagtggctgggacacagggcaccaagtcccaagtctgcacacagcagaggggccctgggtccaggccaggaaaactatttttccctcctaggtctccagacctgtgatgggaggggctgccatgaaggtctctgacatgccctggggacattttccctattgtcttggtgattaacattgggttccttgttacttatgcaaatttctgcagccaacttgaatttcttcccagaaagtgggattttcttttctatcgcatcatcagatggcaaattttctaaacttttattctctgcttcttcctgaacactttgttatttacaaatttcttcctctagatactttaaatcatttctctcaaatttgaagttccacagatctctggggcagaggcaaaatgccaccagtctttttgcatagcaagagtgatctttacttcagttcccaacaagttccttatcttcatctgagaccacctcagcctggacttcaatatcagcattttcatcaaagctattcgacaagtctctagtgagttccaaactttcccacatcttcctgtcttctgagccctctaatctgtaggaagttctaaactttcccacattttcctgtcttcttctgagcccttcaacccgttccaacctctgcctgttacccagttccaaagtagcttccacattttgggatatctttatagcagcacctcactctccgtagcaccaatttattgtattagtctgttctcacactgctatgaagaaatacctgagactgggtagtttataaaagaaggaggtttaattgactcacggttctgcatggctagggaggcctcaggaaacttacaatcatggtggaacctcttcgcagggcagcaggagagggaatgagtgcccagcaaagggaaaagccctttataaaaccatcaggtcttgtgagaactaactcactatcatgagaactggatgggggaaactgccccatgattcaattatctccacctggtccctcccaagacacatgagaattatgggagctacaattcaagatgagatttgggtggagacacagccaaaccatatcatccagttaattgaaccttcacagaatttactataaccttgagtgtataagccatatttatgctaaaatgttcatttttaaaaatgaaactaatgaaaatgtcatgtattttgtaaatacccagagggggcttgcccaaggtagactgagtgggcttacttgggaaataacaaagagatgagtctggcagaaagaaattgaggatgagaaataacttgggataggctagtgatggctttgaatcccaagcagaggccctcacacttttacctggtaggctcagaagaagaaggactaatatgataactattttattttattttatcttatcttattttattttattttattttttgagatggagtttcactcttgttgcccaggctggagtgccatggcacggtctcaactcactgcaacctctgcctcccaggttcaagtgaatctcctgccttagcctcccaagtaactgggattacaggcacctgccaccatacctggctaatttttgtattttttaagtagagatgggttttcacctggttggccaggctggtctcgaactcctaacatcagatgatccacctgcctaggcctcccaaagtgctgggattacaggcatgagccactgcacccagccaggataacattttataaaaaggaatatttgttgagctaatgtacattgaggcctactttaatttcaatatacttttcagacaaggaatcacacacttgtacaattttccgaccttatcattggaacacttgctaatatgatgcagatgaagtgggattgtgataggctattttaagtacttgaattatgagacaattttcgactgcagtagcccaaatggtaccctgcagccgtcaaatgtgaggaacttcagtgtgagtgctgacaccaaatggaacctcatccacccacctgatgaaaattgatgttcccctggctgtcaccctcagctgtacgctttgctcaagaagtactttgttttgagggactttatgttgtataaaatatggttttgcctgtcatccataggtgatgaacctgccatctctgtctcctgtctctctttaaacactaacttccagttgcctatggagcaactacctggaagtctcagaggcatctcacagtcaacctgcccaaactccactctgacttccttctccaaaccttctcttccttcttcatttcccatcttaattcttagtaacccgtacattctgtcacctaggtgtgaggatgagaaatcatatttatttccttctgttcccgccacacacccacaccctgtagattctgaatcctaatatttttcaaatccatcttcttttagatctcatttttgtagtttgtgctttcactatttcttaggcctccccacctccagacttctgcctcccatctcccctcagccgtcatggtgatatttctgaaatgaaaatctgattttctggctcttctatgactttgctttccaagtttacccatcacaaagaaaatgaagccccaacttccctggaacacaaggcttctcccacctggaacacaaggcttcccatagcctgacctgtcccccactcttgctgtgtcttttaccaccctgcatccctacccacttactattttacagctcttaccacctacttgtagtcccctaaatgcatcagatctgtgagcctttccacacatggatgctgacatctgaagagttctcccttcaactctctcccatgcacaccgaatgaattctccaggcccctcctctaaagcgttccttcttcacccccagctatagtttactgcccctttatattatatgctgctcctggatgtgggacagcaggtgcatgcctgatcaaatgtggtatctttaatgatcaacaaatgtcaggtaaacagatgcatgggttagttggttccagacatagaatttactcaaaaagagagcattttttttttctcctgaatggttttcaagatagctcaatatattatgccatttttaaaattttattttctttttagattacacataataattgtacttatttaatgtggtacagtgtgatttttgtttgtttgtttgttgttattgttgctgttttttgagacacagtcttgctctgttgcccaggctgcagtgcagttgtgggatctcagctcactgcaacctcagcctcccaggttcaagcgattctcctgcctcagcctcccaagtaactgggattacaggcgtgcaccacaacgcacagctaattttgtatttttagtagagacagagtttcttcatgttggtcaggctggtcttgaactcctgacctcgtgatctgcccacctcagcctcccaaagtgctgggattacaggtgtgagccaccacacccagataagtgtgatgtttcaatacatgtatacaatgtgtaattatcaaattacagtaattagcagattcatcagctcgaacatttatcatttatttgtggtaagaacacacaaaatcttctcttctagatattttgaatagacaatatattattgttaaccattattacccaactgtgtaatggaatactcggacttattccttctacctcattgtaacattgaccagtctctccccattacccacttgcacacaaacacacacacacacacacacgcacccttcccagcaccttcccagcaccgttctactctctacttctatgagagcaatgttttagatgccacatatgagtgagactatgtgacatttggctttttgtacctggcttatttcacttaacctagtgtcctctaggttcatccatgctgctgcaaatgacaggatttcattcttttctttggctaaatactatttccttgtatacatgcataccacattttctacattcattcatccatcgatggacacttgggttgattccatgtcttgcctgttgtgaatagtgctgcagtgaacatggaagtgcacgtatctcagcttactgatttcatttgctttggatgtctacccagtatacaaccatatgattgctggatcatatagtagctctatttttcattttttaaggaacctccatacttgtttccctaatggttatagtaatttacatttccaccaacagtgtataaaaggcccccccttatccatatcctcaccagcatttgttaatttttgtctttctgataacagccattctaacgggggtgagatggtatgtcattgttgttttcatttgcatttctctgatgattagtgatgttgaagattttctcctagacctgtttgccatctgtatgtcttcttttggaaaatgtctattcagttcttttgcccattttttaatcaaatgatttggtttttgctattgagttgtttgagttccttatgtattatggatactaacccctcgtcagatgcgtcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggttttagacttcctcctccttttttttttttttttttttttgagactgagttttgctcttgttgcccaggctggagtgcagtggcatgagctcagctcactgcaacctccacctcccagattcaagtgattctccagcctcagtgtcccaagtagctgggattacaggcacccaccaccatgcctggctaaattttgtgtttttagtagagacaggttttcactgtgttggccaggctggtctcaaacttctgacctcaggtgatccacccgcctcggcctcccaaagtgagtcttcctcttctttaagatctttatctctctgcctttgggtcacatctaggaaatgattcatccccccactgctcagaagcaccactcttcttgtgtctgaacatcttgggactttctaggttttaccccattgctctttcaaaaattccagatattctactttccatatgttttctttttggttgtgaatcagagagtggtagccttctcccatcgcttatgactccttctctcttgttcttcaaactcgagtacagaggctactgtggcggcgtgtttgggtgattgatgggcttcctacacttggatgttatctatgccgggcttgtcttggttacatcccagcctctccagagcaatgatgttctgctgggatctgggggctccaaagtgggctgtatgggctggggatgccagcaaatcttccatccttccatttgcttgaaattaaagatacacagaagtaatgtggccacgggggtggaaggaagggaggatggaactcaaagggaaaatgacatgtggaccctgctctcataaaatttgaaatctagtcagtggagaagaccagatgatcccacaggagaaatctggggtgtcaagtatggatacacagtgggaatgattcatgtgactcactctgctgaggaatttgcccactgccctgacacagacctcactctactggtgaggtctgcagaggctactgaatatttgtaaagagtcgagtctgcacagttggcttccagcaggcattggacagggccctccgtggaggccaggcacccggcatgcagttcccctgcctcccttggcctggagtcactgctcttctccgcaggtcactgcccccatcagctgtggtggtctagtgttcagcagaaatgggaaacggagtcttctgaggctgtgccgattgtcattgctctgaaaagagctcacttgtgcttgagtggacattgcttcagcatcaacgtgaaggcctctgtctgtgggtttcagggggtgccagggaccagactggagagcaggcctcatcctgcgcccacgtccaacctcccttatcctctcccccatgctcctgcatctgcttcccagaacctctcggcctgtaggatctgttctgttggtgaggagggagtacagcataaacacagaaggtctgtgacggagagagattgttgaggcttcctgctggaaggttgagagctgagcagaggcttacaagagggcaggatctggatagatgccaacgaaaacagagcatttgggtgaggagaagagtgaatcgatggactgaggagggaacacacctgtgctatgcccaggagaggaggcaccagcaggcagagcttccaggcagggcgccagggcagggcagcatggaggaagtggagacagtggccttgcctgtcctggaaaagcctgcgagtgtccccatcacttactagtgggggctggatagtcacacatgaggaccacaaagcagatgttatcattctcctgggccttatgtacatctcagtatgtttgggagacctgagcatttaccttgtaaaagttttctggaagaaggaaccaaggtttgatggcagagagtacatgccctgctccaggatggcagagagcacatgccccgctccagcatgtcagagagcacatgccccactccaggatggcagggccccccggctgcagcatggcaggggttccagtggacagtgggcttgggtgtttcaacagcatctcccactgcagggccccagtgccacagttgggttgaggccacagaatccattgcagatgcaggtactggctgagtgcccacagggcaaaggccatcctgaaaaaggggtgggcagccccttcaccagaacggaatgcaagtgctgagccagctgacagggtccttgactgatgggtctttcagtgagaagggtctcctgccagtgtgggcctgcagtcaccgggcagctgacgacaaaactcccagcaagaggtctttccccaataagcctcgagaagagggcagaatggggccagctgctgacgcagctgccatgtctgctggagacatgctgtgacaatgacagggaggcatccttccgtccccacctggttcttctgtatgggtctcatgagtgtgagcttctgacatcaggttccttctgagtgaggaagagaatgtgagaggtggcatcctgattaaagctgtttatggtctggtgcatttttggttaaaaatcacacttttcatttatttagcacattgctgtcaagttgcaacacgctgtaattatcagaccacaagttctggaacctgctgcgtaaggtccaatcctggctcctccttccgctaactgctgaccttgggcaaggcatttaactgcctcgtacaacctggtttcaatcccagccgcacccctgacccaccagctgctgggcaagttgcttaacagctctgtgctcctgtgtcttcatctacaaagcaggaatgatagtacctgccccatagggttatttttaaagattaagcgagttaatgctcataaagcactttcgaagtgtctgcccaacatatacaaaaatttacccgaaatacatcaaagacctaaatataagtgaaaactgtaaaaatcatagaagcgtaagggaaatgttcatgaccttggatttggcaatggatttttagctgtgacaccaaaagcataaaaaataaaagaaaaaataaaaagaagtagataagctagacctgatcataattaaaagcattaatccttaacattctagctcacatgacacctcctctgaagcctgttctaaccccttcagagagaatggattttttataagggagacagtaacagcaacagatgtgactgagcatttacttcattcaggccagccactgttttacgtactttgagttggttgactcacttgctcttcacatccatttaagattagattctattggccatgcacagtggctcacacctctaatcccaacacttgtgaagccaaggcaggaggatcacttgaggccaggagttcaagaccagcctaggcaacatagtgagaccccatctctaccaaaaaaaaaaaaaaaagatacagatagatagatatatagatagatgcctggccgtggtggtgtgtgcctgtggtcccagctacctgggaggctgaggcaggaggattgcttgagcccaggaggttgaggctgcagtgagctatgatcacaccactgcactccagcctgcacaacagagaaagaccctgccttccaaaaacaacaacaacaaaagatgaggttttattattatctctgctgacaaatggagaaactgaggcagataacagtccagcagctggcccaggccatgcagcacatcctctgtgctcccagcacgtgttgcagacaccatcgtgtagtctggagcacactgagctggttagatccagattcccactgtgaatgggaactccttagggccaatgacatccctaaccctgaatcatgggacctcaatgacttctgcaggactgaaagttacatcttgattctggagggatttgggtcgcagactagagatttaaactttattctgaagtaagcagaaagttatttcagatttttaaaaaatacatgagaaaaatcgtgtttcagtaaagacaaatctggtgtgcaacgtatgagataaatcaggggcggcagcaggaggcagggagttgagtgagggtggcccacggttgtgagtggctccaggtgggtggggtgaggccttggggatggtgcgtggactaatccagatagtgaaggccacacgtagggaggcttcaagtccctttaggaacaagaatctcaggaactcagaggagcctgagtgctctgccagccatgcacatggtggataaaaagtaaaaattcagtcactcacccaatatttgatctcagcatccaggatttctcagcctcttgggggttagcatcgcaaaaccacaggcagaacttgatgccttccatcttcttttcttcagatatcttaatctgaatatcaaaaggagaatgtgaggcacagtggcttatgcctgtaatcccagcactttgggaggctgaggtgggtggatcacttgggctcaggagtttgagaccagcctgggcatcatggcaaaaccccatctacaaaaaatacaaaaattagccaggagtggtggctggcatctgtagtcccagctacttgggaggctcagtgggaggattgcttaagcccaggaaacaggtttacagtgagctgagactgagccactgcactccagcctgggtgacagagcaagactcctttctctcaaaaaaaggaaaatgtgaaagatcttcaaagcaaaatacactcttctttatagcttgttctttcattttccttccattagaaataaaaccaaagcaaaaaaagaggatttaatatccatcatagcaaactttactaactgaaaataataattggctatggtctgatttgattcaaaaatccattgtaggcttacaacacatttatttttaaaaaaaaaaaaagctaaaacttagtaatacatcttacccttaggcaaactcataagaacagctgctgaaattaaattaggttgtatacttgtttctggaagttttccacctcatttctggctgaagtgaatccttgaagaaccaggagggctgagcagaaaacaaatatttgccactgctttcagatccatccctctgtgggaacaatctggagaaactgcctttttcatattttcagtaaaaaaaattccatattcatgccatttcctgtattatgcaaaataccttccctccatagtctcttaaatgacactgcaatatttttcctagaatttcctaaaagaaaacagctggtttgatccccactcttggtccgcatgcctgatttctgtagacactgggtatttgcagtctgggctgcatcagtttgtgaggtacccataaggatgtgggcagagagtttagagacagaaaacccagggcagaattgatccatgcaccagaaaatgcattgtgtaggacaatttatagcttaggagcttcaggagacatgaggtggttcctgggtcacaggttctcaaatttggctgcatattgtaatcacctgggatgtttctttaaaatgctgatgcctggattccattcctagagattctgactttgggttggtctggtggattgtgcattaggtttttcaaaagctccccaggccatgtaatatgtatcaaaatctgaggaccaccaacatagaccatctccccctcctccccagagagggggcgacttgcccaaggtcagaattataatatcttccagtgtaccccaactctgcagatggttctctatcacccagtggcccaagagatcagtttgagaacaactttgcctcatcccacaacttcaccccagacctcaggtcacttcccatggtcaatgggttcttctcatagtctcaatggctgatccttctccatctccatggttagtgctcctcagatgatagcaacaggctcctctcatttgaggcctggctcccttctcttcgccacaccatctgcctccatactcatcttcaggagacttgagtgtaaacatgttgcctcctactcacacctctgtcaggggcttcccattgcctttgggacaccttaatgtggcttccagaccctccaggagctggctcctggcctcctgagtatcccatcttgcccctcctgtatgattccgcttgtatgaggtccctggagttgtcagacccctagagacaggaagtagagtaggggtgccaggggctgggggagggatggggagttacaatagtatttaacggggacagagtttcagtctgggaagagggaaaggttctgcagatggatggtggtgatggttgcacaaaaatatgagcatacttaatgcactgaactggacacttaaaatggttaaaatggcaaattgtatgtaatgcatattttatcagaacagtaaatttttttcaatagctttctgagaaagaccttgcctgccctttgcctgagttaggcagctctgttttgtgtttccagaactccacaatcttcctatcagaccactgtcctgcttagagtctggcctttttacagattgtgactagaataaaggcgcattggagttctcgcctatttaccactgtgatcccccatgactgcagagtaggtgcccactgcataattgttaatgaatgttgttgaatgaataaaacccagaactacagtgtcccagcccgtcaatcttaattgctaggaaaaattggattgcaaaaataatccaatttgatattgtattagtccattcttacattgctctaaagaactacccaagactggatcatttataaagaaaagaggtttaattgacacactgttctgctggctgtacaggaagcatggctggagaggcctcagaaaacttttaatcattgtagaggggaagcaggcacatcttacatgggggagcaagagaaagagagtgaagggggagtgctatacacttttaaacagccagatctcatgagaattcactcactatcaagaagagcaaggggaaaatccacccccatgatccattcacctcccaccaggccccacctccaatattagggattacaatttgacatgagatttgggtggggtcacaaatccaaaccatatcattccactcctgtcccctcccagatctcatgtcctgctcccatttcaaaatacaatcatgccttcccaacaatctcccaaagtcttaactcattccagcattaacccaaaagtccaagtccaaagtcttatctgaggcaaggcaagttttttctgcctataagcctgtaaaatcaaaagcaagatagttccttccaaaatacaatggggacacaggcattgggtaaatactcccattccaaatgggagaaactggccaaaacaaagggctacaggccacatgcaagtctgaaacccagcagggcagtcattagatcttaaagctccaaaatgatctccattgactccatgactcatatccagtgcatgctgatacagcagtggtctccatgatcttgggccactctgccctgtagctctgcagggttcagcttcctcagctgctttcacagggtggcattgagtgcctggggcttttccagatgcatgctgcaagctgtcagtggatctaccattctagggtctggaagacagtggccctcttctcacagctccactaggcagtgccccagtggggtctctgtgtgaaggctccaaccccacatttcccctctgcactgccccagtagaggatctccatgagggcttcaccccacaacagacttctgcctggacttccaggcatttcatacatcctgaaatttaggtggatactcccaagcctcaactctcacactctgcacacccacaggcttaataccaagtggaagccaccaagacttggggcttgcaccctctgaagcaacagcctgagctgtaccttggcctcttttagccatggctggagctggtgtgggcgcaatgcagggcaccaaggctgcacagagaagtgggactctgagcccggcccatgaaaccattctttcctcctaggcctccaggcctgtgatgggaggggctgcctcaaagttctctgaaatgccttggaggcgttttccttattgtcttggtgattaatatttggttccttttacttatgcaaatttctgtagcaggcttgaattcctccctagaaagtgagtttttctcttctaccacatagtcggactgcaaattttccaaacttttatgctcagcttccctttttaaatataaattccagtttccaatcatctatttgctcatgcataacaaaagtgaccttggctgccattctcaataagttccttatctccatctgagaccatctcagcctggacttcattgtctatatcactatcagcattttggtcacaaccatccaacaattctctaggaagtttcaaactttccctcatctctctgtcttctgagtccttcaacctgttccaacctctgcctattaccaagttccagagtcacttccacattttcaggtatctttgtaagaatggccccttctcagtaccagttttctgtattcattcccacattgctctaaagaactacctgagacttggtaatttattttaaaaagaggtttaattgactcatgattctgcaggctacatagaaagcatggttggggaggcctcaggaaactttcaatcatggtggaaggtgaagggaagcaggcacaacttacatggctggaggaggaggaagagagcacagggggagggctacacacttttaaacagccaaatcttgtgagaactccctcactatcatgagaacagcaagggagaaatctagccccatgatccagtcacctcctaccaggctcagcctccaacattggagattacaatttgacatgagatttggacggggacacaaatccaaaccatatcagattttaagtagctagaagtatcagaccacaaattgtccagtcatggtaagtgataacattgggtgaagaatgtggaatttcagcctctgattaatccttacaggtatattctgttcgaggtgggtagacctccaagaattttgagactgcctttgttctgtctaataaatacaacaggaaaatgaaaacccggttgatgatttcagattttttaagaacagcctatttataaccacttccttgcttaatattatgcttttttctctttccaaattagatatttatttttgaaaacaatatctactactgtgcacatgtcgggaaacaggccatccgtgtggtctccactggcaaggaaggtgtgatttacaatggcctcagtgactggctgtatgaaggtaagatgtgcacagagagaaaaaaggaagatttgtggttgctgctgctgctacattggagttgggttctttttcatttttctttgactttaactgtaaattaaactccagtttcttgaggttctgcaaaatttaaaagattttgttagagcttttgggatcaggctgatcagcatcagagaacagcatcaggctgttgtcaggggcctgcagtgttgtgcactcacctgggacaggtgtgctggctttgggctttgcagagctctgcaattcatccctgaagggcaggaggctcgttaatgggagatttattatgtcaggaggtgacttctgggaacgctcagggactgcaaatgcatgtgtctctaccccactccaagacataagtgcctcgttttgccttgggaaggggacagttggaaaagaaagaatgagttgcatctttccaaataaatcatcagagtgacttgctgctgagagcgcctccaccttgctggacattttctaccactggtttgcctttggcaccagaagactcatgctgtatacattattaaataactagaagtcagagggggaagctctcttcttaaactttgataacctgtctccatgctcatgacccttcatcgtaacaataacaaccaggtattgattgctattagctgtcaggcactgctggaagcactttgttttctgttacttcattccaccctctgtcttagtttgttcaggctgctgtaacaagatataacaagattccacagactaggtagcttaaacaatgaatatgtatttctcacagctctgaagcctgggaagtccaagatcagggtgctggcagacccactgtctggtgagggctctcctcctcacttgtacatggctgtcttcttatgtcctcacctggcagagtagagagagctctggtctttttatctctttataagggcacaaatctttttatctttttatctctttataagggcatgaatcccattcataggggcaacaccctcataacctcatcaccttacaaaggctccacctcctaaccccatcaccttagggatttgggtttcaatatatgaatttggggggacacagacattcagttcatagtactgtcataacaaggttctattttatagatgaggcatggttaggttaaataattggcccaagtttacacaaggtaaggaatatttattggggaaaggcgttgtccaagctcagggtaattaccttttttgaattccacatgtggctacagtaaccgtatgctttccagcatggggctgatgaacaacccaagctcttctcagcctcctggcctgaaaccgtgtggtcacagcaataactcaccctgctaggctgggtcaagggagggtcagggagattctgggtgctttctcaagccagtatcactttctcctagtgctgtgcatgcctcattctgcattttagtggctttatgcatcataaattataaagcagatggatatgcaagcttagtgttacctcctaggataatttctctgaagccataaagttctatgacttgatttttaatttttgtaaatggaggtataatttgtacataataaaatgtacatcagaaggacagtttgatgagtttggcaaatgtatatactatatagccccagtcaagacatagaccatttccatcagtctagaatattcctacaagtccctttccaagggctttctccctaaatctgtcttccagagactgccacggtcctgggggctaagcagcccattctctaacagacatactggaacccaagcatccacatgaggctgtccttccctgtgtggtcaccatggaagccccatgtttattccaatgtggctgccggtgctcagagcatgctgaagagtccagtttccttctgagccccaggagaatcaaccctgagattttattgtcacatgagtccttggctacacctgaaaaagccactggaatgaaagaggggacacagtctgctgtagttatgcctgttctgtgcagaaacagccctagaaatggtgtgcccggagatgtccccagctccaccaaagaggtacaggcagcagcacaaagggaagctccggaggggctgcacctctgcctggggtgcaatccctgagcctctggggcttgcctgccccctggactcagtagactgttgacaatgaggactctaaagccccttgtgtgctgcccttttgtgagaaaaaggccttatacctaggagcaactggaaaactgggtcctgtttgctccctgatatctgagatcccactaacagctcttttgcttgggtgtgagatcagctcaatatctggatagggaagggaacccaggggctggagatcagaacatgagtggttcaaagtaaggctgtggagctgcagggacccagggaggagacctggcccagtcacgggacatgacaagggtcttccactccatcgacctcaacatgctcatgtgtacatgggaagaatgccccaaacactacacttcctgaggactgtgtgagacttggagtggaatacgtgcagcacatgacatggtcagcaagggacagttgctgctgttgtttcttatcacaataaaaataacaataattatgtatttattactattattgtaattatttgttagtagtatttttatcacaaaggaaaaaagatgtttaaaaaagaaaaaaatggcatagatatcaaggcaatgttacccaggtggtcattctgccacagggcagaaattgtctgacctgaaaattcaagagagatcagtgcaaataataatgaacccaaggtgtgtcccccgtccctaagagaaagggcccctagaattttggctgcaagagcctaggcattctctgggactaatctccctcaaaaatccataaccaggagatttaaaatatcttttttagtatcttcttaataaaataaaaagttcattgctttgccattcacattaagcttttgctttagcaaatccattgaaaggacttttttcttcaaggcatttacacgaaattgtgttgatgtgataacagagccctaaatattttaaatcaatcacagttgatgtggcagcttaatctacttagtgttgttccctggaaggtttatatgctgatgcttagatttctgaggctgggagcacaggagccctgaggattcttgcttccttttttaataatgggaaagtaaactttgatgatcgcttttgcctactctgtgacttaactgtttcaattccaaacacttcctttaaaaaagttagggggtggggggagattagaatgaaaatgccctaaagcatttgcagaggggctcatttgcttggagatgttagttctaagaagataagctgtgtacgtgggaaacagccactgcagtccatagcttgttggcagaaaaatgccttattgatttgttttgtttcccagaaaggatcttaaacatactaaacattgcaaaatattggagactgaggaagagaagaggtgggcagccatagaggcttctgggagtctccaacccttgacctaagctttaaacacacaaagtgggaaaagctccagtttactgaagcagtcgcccacatgccagaatgtgagctcaacactggctgtgaactcagcactggctgtgaactcatcactggctgtgaactcagtgtatctgtcttgctgattctctaaagagagtcctgtggctcatggtggccacaaactgattttgataagcaaaatgcatatcttcattttattcttctgggaaaatgtcataaaattacatcgaattttgattttaataaaaactaaagacagcttaatagagtcctacaactttttaaagtttattaaagtttgtttattcataaactaaacgtaagatgttactgaagatgaagattttgaggcctgtgagtgagtgttctgttaagaatgtgcactttgatgcagggctcagtaattttgcaaagttcctagtatgtaggcatatgggcaaagagttggaattctccaagttttgatgaaagttctttgttaccgccattacatggttgattgtgtttccagctgccactctttgtttataaattactctttgtttttcttttgtttgtttttttttttgagatggagtcttgctttgtcacccaggctggagtgtagtggcgcaatctcggctcactgcaagctccgcctcccagggtcacaccattctcctgcctcagcctcctgagtagctgggactaacaggcgcctgccaccatgcccggctaattttttttttttggtatttttagtagaggtggggtttcaccgtgttagccaggatggtctcagtcatcttcgttatcatcatatgcatgagctatagtgggacagcacagaatttttggccaataatttgctaataatgactttaagttattaaatatttcagctaaacaatgagtcatccatacttcttttaccaaagcagtcacatgcatatgcatatccaaaatacatataattattcagtgatatgccattatcatggaatgactcacagccctgtggaaagctggaacatgttagggtcattggaggacaacatctttccttatgtatataaaagatcttatcccctcaaagggcagtggaggtagagtgagggatgatgaactcgagaagatatttatagagctcagcctggagtcatcagcctgggatggcagggaaagtgagaaaagggcccgaagggtatttatttcatatctggtttggcatggatgaaattccagggctggattttccttaactagtcaagaacataaaagtacttgaaaaatgtgatcagatcaggagacccagtttggcacggaagcatttccccgtgcatgtcagcaggaatcatgttagatgagactctcgaagctgcccctggcactagttccccttgcgtggttctaggacccatgcagtcaggcagcccctgacaaggagtagctgctgggaagtctcctgccaacaatactcacttctgctccaccctgcccagtccaccgccctcgcctggactccatggcaccctccccattttctgcagccctgccctgactcctgaggcccccttctcccagtcacagcccttgccacagtccccacggagccaccgtcctggttccacctacctgggagcccccaagagagactgtcttcactgtcccacactaactgccaccttcactgggtggccagcatggaggaagtggggatgtggctagtctggccagaaaggacttccttccagaactgctgctgctggagaggggtttagtgcctcttgagttggaactcagaatgctctcattagcgatgtagtcaggcccactgtacaaggagcagagcctttcctaagctagggccctcagtcctgctggatgagcaccaaaccctggtggtgtgaccattaccctccatctgtgtgtcctgctcatgtctagggactgcaaggccagcgtgaggcaaggcctgctttgcacttctttatagtttctcaaagcatctttaaagagtcagcactcatgacctaatagttttctgttccaatgaagtgctctaagaggtaccagcaaaaggtcaggtgggccccaggcagataaatttgagttaatgaattttgggggtggggcaattccatgctttattgtcttgagtattcaaggaggtggagagtgtgtaggagtagtagtgcagtgtagtagatcacagtggattttcacactttcatggaagaaaacacattattaaaatgaaagccctcctggggatcgtggaatggttttcagggtctgttttccacagggggcacattcaccaaaagaaaagggaactctttgttcatccagattcccataaactctctaaatcccatgaaagcagaacaaacttaagtaacacttcacgtgaaacttgcatattggctttaatttacattcatgacacgttagatatgttgtacactttgtgtgccttgtgtcacgctgatacccagtgtgctgagtacctgcttcctgcgtgttgtgaacagaccagagccagttgtgaccatcgataactggtacagtcttcagtgaatagcggcagccttggacggttcgacgcagatgaagaaaatctagcacaccatctttttatctaagaaagcaatatgctggaaccattagacattaatgacacttatgctacttttctttagagacaggctctcactatgttgcccaggctggcctcaaacttgtgtgctcctggcttcgcctcctgagcagctgggactgcaggaacctgccactgagccccaaccttttatgctgtttttaaaactccctgacatacatttggagactgatatgtgaggtgcttacagaagccccctggagtgtagattcttgattgggttctgcaaatattaactgcctctgaagcacctggctagggcacttcaactgctagcaaactgctcccaggtagtagatcaaagtggatttttacacccgtcatacatcttagtgaccatactgatgttttttaaataagttatggagcaggcagtacaatgggaattggaatgatgttcaaatatgtacattactatgtaaaccatagatctgtagttatttggacctcttattgattacatctcttatttgcatgatgggaaatgtttggttagacaaggacatcactctcagtaaattggcagaaacttgtgattagcttgacaaagctcctttgtggaagagcagggcagagtctttgtagtgatgatgcctgtgtttaaacaaaagcttcaccacgtaaaagctgtatgaacttggatgaatatttgacctctttgtgtctctgctgccttgtctgcaaaacaaagataacagcagtatatgctccataaggtcacagaggaaattgaaataagctaatacacatagagctcttagaatagtgcctgccactggtaacgtctacgtattggtggtacaactactattgctttaccttgtaatttcccaaactcggtaaaataagaggcacctgctcaactatttcatttgcaatgtcaggaatcggaagcattaatgtgtaattaatgatacctatcagtgttgaaaactctgaagctctattcactcataaaatattatctgtagtatgttcacatagaaaatgcactatgagttcccagtcatcctagaaatgctattgataccatgttgaacacctcttcaagagccttctgtccacgtttagattctccaagctgaaatcacacccttagttgccactgatgcctgacagagagacagctgttttccttttatgagccccaaagttcttgtgacttggtaaaaattatgcctcatgatctcttacagaaattgagtacttaaaaaaattatattccacttcatctatgacttctaagggaggatatgaaagtaaaagtaatgatgaaaatatctaaaatgtaatcagtgtctggcgaagctatcagacctatgaggtactgtgcaatggagcattggctcaatcaaatagcaatcattctgagcaggagtctgaatgctttgggtatttcatgtaactaaaatgagtattttccttgtctagtcctagtctccaactctgtaaagtattaatgatcttgacttgaagaacatgttaattttaccttgtagagagacaaggaggaaaagccaagaagctgtttggtagaagttcagttggctctgaccagaaaatggctgagatggcctaagagttccattccttctgtgcttctctgaacctgtgagagatttctgggtttctagatttctgcaaggatcaacaggaaaacagtgttctaaggcaggaaataagaatgtcaggagcataacatagactgtgattgccacaggtaagccaggctggctgccaaggccctcttagccccctgggtccaactgcacctgttcctcacttgaccctgagtcccaccagaccctcccctgccatcgtctgctctcaacgtagcaatcatggcatcatggctgcctcagtgccaaactttaaatccaggtaggtcaccaggaaacaccagcacatcctaaccagcaccatctctctgtttctgcgatcatgggcagaccactatctttctgctgtaacaacacaaagtgtatgccctcacttgcctatgttcatctgagttttcttgaaagaaaaacacatggctattgattctctaatcacagaaggaggtagtgttggagctgaaatggacgttagcagacattgagtccagcagtcagtaaactgtttctgtaaatggctaatagagtctgggtaatagagtcagggttttgcaggacatatggtcttcattgccactgctcaagcctgttgtcatagcaaaacagcagccatacaccataagcatggctgtgttccaataaactttatttgtggacagcgaaatttgaatttcttgtaattctcacatgtcattaaatattcttcttttttaccagctattaaaaaacacaaaaccaattcttagctctcaggtcatacaaaagagacagcaagccagatttggcccaaaagccatagtaagccaatcccaatttgtccagtcatcacattcacagacgaggctactgacatcatgtctgaattcttccagctcttgtcgtctgtatcaagatcatttgtaatgacaaccaattatttcaaattttgcttctccaaataagtctagttacttgaagtcaagaactgtattttatattgtatgtttcccataacaccagtgactctctgagtacttaataaatgttcagaaaatacttttgaatgagttaattcacagagagaaactcacatattctaggaacctccacaaggaaatcatattgtttctccatgatcactcttattagaatttccatttccacaaaattccctcaacagaaaaacacctgattaacaaaaagcaacagtaattgttaacctcgttttaattatgagtttcacgttttatccccaaggataaaggaaaaaactggagtgacgttgggaaggacatggtcttcttaccgtgagcccaggggcacaggatcatagctcatcagactctagaccatctaaattcatgctaagtcatagttcacatactgaatgaatagagtaggaatagcagtatctaagtttcagtgagtctttcttccatgccaggccttacacaaataaacttcgagagcgctatgaagaaagctctaggattgttccttggtatcctcgggagactggttccaggaaccccactgcacccacccttcttcaatcagataccagagtctgaggatgctcaagttccttgtgtgaaatggcttagcatttgcctattacccgtgctcatcctccgggatactttaaatcatctctaaatcacttataaatacctaacaccatgcaaagcctatgtaaatagttgatatgctgtattttttatttgtaatattttttatggtcacactgttatttttttctttaatatttttgatctgcatttggtgggagggtctagagatgtggaatttttagacacagagggccaactctttccttatcctattgcacagctgtggaaactattaagtggcctttctgtggacaaacaaccagtagggagcctgcctgaagctgctaagcactttcctgctgcatatgagttgcattaatttcttgcctatgaaattaggcttgggtccatactcaagttctgggtgcagcatcctgtagatgtgtctgctcaatgccccaggcttgaaccatctgtgctgtaaaaggtgtgtctcatggcacagatttaagagcccaacagaccttgatttaagccctctgtgagccattcagctgcctggtgaccaaatcacaaaccttgtctgaccctcagtttcctggtctggatgataaaacttcaggcacctttctcaaagaattattgcaaagttaaacaagagcgcttctgtggaagcgcaggcatattacagtggaaccataagaaattgccaacaggttcattgtatattagcatgtgcatgtgagatgtccggtgaaggtcaactttcttctcccatcctgctggctatgctggatgagatctcagatatggtaaagtctcagatgtctgcgtgcccagcacagagaatttaccatggaaaaggcgggggtattttttgactggaaggtcagacctattcacctccaggtatagcatctccagggcccccccagcaaacaggagataaaagggatgactgctctcctggtctgtgggtttctcccaagagaaacttgacagagacttccttgctccaaatcttcctcttcgtggctccttgtttctggtactgattcccaccaccctcctaattgccatggtgaccagtcggtttgctatttaattaatgttgtatctgattacatctgtaccctgggagttctccagccaagagttgcaatttaaactcagaaataaataaaacgttcagctgtgaggatgggggaattatcctagtcaatcccggaatattcttccgacctttcttagatgaaaaattatctggtggaagttggagtgaggcagtagtacacaatgaagaaggaacaatattctgcttttggaatatttaaaaggaagcctcagacagcagctaggggtcctgcttagcggatagagctttggaaagaggaaatattagaaatttggttgagaattttctatgaagttcagtgctaagagcagagaccacaacttaggctttgcagccagcattcccttccataaacttcaaacgtaagcctgatcagaacaaggctagcaggaagatgtgctggtggggacaggctaggtcctgctgtgggtagcaaaaaacaaacaaaagcaaacagaacactgcctctaatttaaaacagcaaagtgtatttctcgtcggagatcactcaagcccactctagatcagggatggggaggaggtgaggctctttccctcacggtcactcaaggtcccaggctgctggggctgtcctcttaggcatcgcagccacactagtggaaaggggagtgttccggagggacacaagctggggaataaatgcttggcctgggaatgaccctggcacttctacgcatgactcattgtccagaacacctcatatggtcccaccagggttccaggaagtagcactgagccattgtccagaagagggggaggccagacatgtctgggaggcaggactgaagaccccacatctgggcagctttcttgccaacagtgggcctcaagtttggtgcccaaagcagaagaggaattgtctagagggatgttggggaatctctcagaatcaacaggaagatcagagttgggttgagaaagcaggcagccgtccagggcagctgaggggacgccaggggtccatctggttgggacactgctgtgggggaatgggagtatgggagaggcattgtctgcccggatcacaaatgacgttcttgaatgagctgcaaatagaaatgccatgtcccccatggaatcatcaatatggcaacttgggaagcgtattccaggaaaaagctagggtgtgtaacgttttattgttgcaaactctatcatttcacacttaaatgataatcgcaaggagagccatcagaaccattagtcatcatctcttcaatgcgaaggttcgtaattgtcacatgcaccttgcaataaggcaccttgcaataagctcccttccttcttggcatctccttggagcctgtgaagtgatgaatgcagttcccaatgcacagccctcaaactgcatgggagaaaccccagtgtcccagaggacagtgggggcggcttcagcgtggctgtgtggcactgaaacaggttaaccgcaaacctctagttctcagaaccaaagctgaatccacatttgaaaatccagtagaagctttgttaatattttaggaaggctattgagtattttaattcaacatgaagaggtgatctagctggtcttgtgaaaaatcagtaataaatctaaagggagaatgttctctaaaggtacaggaagaattctcattggtcttgagaaatgtccttacaattaatgacctactcctgagagatcgtgacaaatatcttaggatgttcagtgactatatttttctatctttcaaattatgcatttcattgtgagattaggacaaacacacttttacctttttttatagcgccctaatgaaacttatgtatttgaggttgagatatttgacacccttgggaactctaatttcttttttttttttttccgtcttcttaagtcacctaaggacattagaccatttgccctattattgagagttttactaaaatgcaagctgcaaatgccagaaggaagataggcaacaagacaatatgtacttaaaagagtttcatttgatactcagaagctggaactagacttagctcttttgctcactaaacctgtattctaacctttttgggcctcagtgtctttttcttgttctggaagcatcactagggtggaccagataatgctaaactcctttccgtctctaacccttttcatgtttaattatcagtgccataagcacacagcgttgatggtatgaagtctgtgtccatgccagataacttcacaaggaaatagttaacaattctcggttttacttagtaaacatacgggagcaatgctcctcagttgcaatggtgggggctgggcacgtgggtatctcggcctttttgtccccttcctctcccctttcgtcacccccacacacaggacatttgcgtactgggagaacctttattagatgattctgataaaccttctccttatccccacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagaggatgcgaggagtcagatttcaggtcagttgctcttccccagccttcaagcaatggcagaggctgtcctgggaaggtcatgctcttctgtctgggttatctgaagtgatcattgcaccgagtgggagactggacatgcagacctatcatctgcagccatacaagctcatgattctgggcaccctgagtcaagtcccagagcccaggcaacctggcagaacccaggaagggtgaagcctctgcatgctggccactcaggcctacgattagcccctccccagcacatccgtgcattcagcgcaaggccaagctccatccagtcgatggaaatgggcacctgagcctcagaaacacccaaagaagagagcacctttcagctcttcatggaagaaagcgagccagccagcaccttcttctttttgcaggaataaatatgtctggcacctggattattttatttaaaaggccagctgtgtggacaccatgcctataaagtattgggatttttaatgaatgttaaccaaggaagagcccagctaggatacttcctgtaggtgtcactttgtggaggtcttaggtgctatccaaccctaaggacaaggcagccaggccagctgaaggatttcagatcagctctttctctgctcaccaccctcattattatccacttcttttatgggtccactcagatgctcatgctcacagtcttacctcccttctctccatccagaaaggtgaaacctcacccaccgccatgtggctcccacatcccagtgtcctgcatctgtgtctccagaaacatggcagagatagaagaaatttacatgtagcaaaattcatctcttcaagaagatattccaacacctgacagtggcccacacagtcctcatttactagggaatcctatttcgagccccttctgggcgcccagattggatgagtcactatggattgcagtgccccacccaacggggtacctgaaaaagaggaagaaagggaggcagggagggaaggagatgaaggaggtccaagacagggacccttcccttgaggaactgatacacagtcagtccgatggaggccaagaccacctgcaggaagcagctccttccttccattattcgagtgggattcatgcatttattctgcaccgaagccctctaccaggtcctccaagggagacagagatgctttaagatctggacctgccttcacaaagtgtatatcctgcaagatggtattgaaccacatcctaattacatggcacaaatctttcacacatttagacacttttggcagaatggtatcttctgatttaaaactgcagaaacatgaaaattagaaaaccaaacaaccattaatgcattaactcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacattaaaagaagataaagccagaaataaaagggaaagaaacagttatatgattttggtgggaatttgcagaaatacaggctgaagctgaagtcttccatcaggtgaggttttttccattgatctcatctctcgggctcagctcttttatctccagcgcattttggatgtggcttctctttccacctgctgggcctttagatagagtacttccttttgtttcaaggtagcatttaactgagtctggaaaaaccatcattaagggaaaataaagctgaaagatgaattgaaaactatgtaaaagggccctttcaggctgccggagagattgcctttccagcctaatgagcctgtgctgcctctgattcagatggtgcaaggacaggagaaaagaatggagttttgtgcactgcgattttccaaagcacataatgcttagtcatttggggtgttaggaaagagagaaagtcggagcggagtgtgtggtgaagtgagagaaagaaagaaggctgaattttcgttaagctgctcaaatgcctgctttaacaaaagtctgccagggctagaggtgattagccatcagtgctgctgctgtttttgctgtcgtttttgctgttgctgaagtttaaaggtcctgtgccccttggtatatacgcaggggattggttccaggacccctgcattaccaaaattcaaacatactccagtcccagtcagccctgaggacccaggtatatgaaggggtatatacgcaggggattggttccaggacccctgagttaccaaaattcaaacatactccagtcccagtcagccctgaggacccaggtatatgaaaagtcagtcctccatatacagggatttcacatccctcaaatactgtactttccatatgtatttggttgaaaaaatctgcacataagtcgacccacgcagttcaaacctatattgttcaagggtctgctgtcccgtccttatgtgggatggtgacaagcggccctgtgtcccatggcgtgcagctgagcggccttggtgcagaggtggatttgcagccagttgtccacacatcctggatcctcccggtgcgtcctgtgtaatgggttaactggacctgcctaagcctgggcctcccacccctcaaaagcagcttctccaagctttcctacttaaatttctccagccacagagagaagcatttattgtctctcaccacacccgccccccagtatagaagaaaggaagactggggaattgatctctcagagcacttggagaagccacacgtcagcagccagtaaagctagaatgaaaatctgagcgatcaaggcaatggaatagaaagtcaaaacccaaacttcatctcttccccactaaaggaacgggaagggacactgccacctggcggccagccgaggcatgttcggggagccgatcctcctccctgggccccccacggtgttgatttgtgggaatttgcagatctctgatgataatgaggggattcgcagtgtgtgatatgcaaataacacagctctgattagtgaaggaggctgcgagccttgcaaggtaaaagctccatttgccttctggcttgatgttcgctgatttcttttttaaccccccatttaattctgctctcggcaccttggataaaatatttagtggcaggaaaaaggcaacagatgcaagcaggaataaataagattttctgtatttagaatgaggccacgtatttcggagcacagatctatcaggcatgttatttatgtcttttgcaatttcccgggacccagatttctcagggtgctttgatttttctcaaatatctacagcagtaggggtccagggagcccagggagcacagccaggcactcactcacagtcagaatccagggggctgtgttatttaggatgatccgaaacgcgaccttgctgcctgcattctgttttgatatgtatcttgcctcattaaaagatgacaatctgcaatactgatattactcaggcagatggatttcccaaatgctgggctatagcctgggctgccagactgcatgaggtttaacatggaaaattaactgcagtcttgttctctggtctgccaggtccagcagtgtagtggaaggagcaaaggagcaggaatcaggagactcaccaggatctgccctctcctgtcctgtgatcctgagaaaatggcttggtctcctcatcctggaggtctccatagtggagtgggctcaacatcacacctggagtcaagtcaaggctccgcacgtcccagtgacctagagccagttgtcaacatctctgagcctcaaaattctcctttataacaaataatgtaagcagatccacagtcactaggaagattacaatagaattgccagagtatctagcattcagtaaatatttattaactagatagaaaaaaaatgtaccaggcttagtaacacccggccttcccatctcattagaggctagaatgctcaatggacacagggtgtgtcttagtctgttttgtgttgccataaaggaatacctgaaactgggcaatttataaaaagaagagtttatttgcctcagggttctatagcctgtgcaagacacatgcaccagcacctgcttagcttctggtgaggcctcaggctgcttctactcatggcagaagatgaagtggagctggttgtacagagatcacatagtgagagagaaagcaacagggtgtttaggaggtgccaggctcttttataacagcccgccctcacaggagtgaaatcaagcgagaactcactcacccttgggggaggccattaaccttttcatgaaaaatccacccccatgacccacacacctcccactagaccccacctcccatgacccacacacctcccactagaccccacctccaacattggggatcaaatttcaacacgaagtttggaggggacaggaagccaggccatagcagggcatatagcattggcatcaaagctagggtgttgattggttatgaatattgttggtcctgcctcatttatcaaggaaagaagaaaaaagaagactgtagaaagactaagttcagggtatacatgagtcttcaagagaagccagacaacattccaggatttcagaaaggggacatggctgagctgggtcttctctttgtggggagacatgtcattgggcctctgagttccaaagacacaacctggaaaaagcacaaaaagactgtctacttagaagatttaggatttcccgcatagtccccagggcctcctctgatcctttgaccaagatatgaaagccctgccatataagaagaggggagctccatgctgaggttaggacacagcactgatatgatgccggccttccttggtctatttgacacctaatgaggtggggacttgttgacaaagtccttccatcgtgaggtctgcacccctcacccccagcttgattgtaccattctgttttggaaatccccaccagaagtaccagcaaatgcttcttaagcttctagaaatttctatctgggattattttgttcatagagcaattctggcagccagagttacttctgcatctttgctttggaccacaatcacccaaaaagcattaggagaaaagagatcacagcaatggttcactcaattttcaacttccctatgctgtttagattttggcaaaagagtattcactgtgactgctgcttttcactataaaaagaagctgagatttcctgccaactatttcacaaaaacaaacagaagattcattgagagaaccaaggaagcatctgatcctacaacacacgaccaaaatatactgtctgtatcttggaaatgaactccctaagaggatagaaaataagtcgttcaagctcttctctaactcaagtataagcaccctataactggaattatgtcttttacctcctgcttattcccagggctgaggggaccattcgtagctgataatatcagttacaatcatgcaggatcatccaggaataaaaacattggaggaaggcagcatgaaagggaaagaaaatcctggttttcagaaaataacatggagacctcatgagctcactctgagtaatcacccttcagcagtagcatctccctatccagtctgctccgtttaagggaagagttcatctcaccacagtgtttcattgaagagctggtttttaattggccctgtaccacttaatttattttcatttgcattccaatgctgtctgccttgtactgctttacttcaaagctggatctaaaaaacataggctcttagaaggttgcaaacctgcaattgtacagaggctctgagaagcgaaatgatttgcccagtgaaatggggtagtgtggaaactgagagagctctgaagtctaacacccctggcttcacaattctacctccaccatttactggttgtatgaactcaagcaaattgattcacctgtcagacctcagtttcctcctctgtaagatggaactagcagcatcgaccttgtggggtcattgtgcgaatcgccatactgtgttagtctagcattgctagtcacttactaggcactcgcgaagtgtagctgactcctagtgttgttgctcttagaaaacacccatatgttagaaaaaaaaaatagaacactttttctgcctctgaataagtgcctaagatcctctaccacttcttgctatgaccacccacccagagtaaggaagacagctgctcccccagcctcagcaatgcggagacggtgtccaattctccactgacaccctagttttttctgtacggtgcatgggaaaatgtataataaaaagcaaagtgcgtcacaaatgataggtagtcctcacgttattagtagtaatagttgctatattgagtgctgtgggtccaggcagattggtttatagtcactgagatatgttgatctaataataatgagaatgaatagataaaggggtacaagctgtcagctgacaataatgtctgaataacatcagtttggtttgcttacgtaatgggtcttacatgaagaggagacactcggaactcaacacctgaactcctcccgcttccggcaaggagagaggcagaaggcgcccacgtggtggacagcagcccatgtagaggggccacagaaaagggtgatgggcatcctctctgcacagggcagagctgcagggtgttgggagtcggcttgctcctctccacctcctcccttctgccatgttcccacctgtctcagtcagtctgcagtaacagctatagaatgtcttcatttggaacttggagaatttgcacaaagggaagcagactggacaaagagctcagatcgggggtctccgggtctgggcacagccgttacccttcccctcccatcctccgttctctcctgccgccacccacactgtgctcctggtgagctagagccagagcgaagtggaacccagagcactgtttgccaacacccgcggcactagacaacgccaagagaatggcttagtaataatgagataataacttaatgaaaaacccctgcgagccctgcggggcggggagggagacctggtgtgtggtgctggacgcttcctgagcacctccctgcacagcctgcctctggagtttctcgcgcatggcggtaagcagggccaggcctcactctttccccttcacagtggagggtgtgagcagggcttcgatgccttttgctcacggtgtccagcagtggatgcgctggttggaacggacgtgcctataaccatgactcccaccgaggccttgtcctgcaagcccagttcccatcaacagctcattctagggagggtggaggcccagtaccgcaggcttgctgcatttgggtatttccaggtggctcaagtcaaacttaagagcgcgacccattcggaaaatcaagtgaataaagcaggatggcatggaaagggatgggggctttactgagagagggtgagggaggataggacgggacaggagagagagggatggaggctttactgagagagggtgagggagcataggatgggaaagagagggatggaggctttactgagagagggtgagagagcataggaccggaaagagaaggatggcggctttactgagagagggtgagggagcataggacaggagggagagggatggcggctttactgagagagggtgagggagcataggacaggagggagagggatggaggctttactgagagagggtgagggagcataggacaggagggagagggatggcggctttactgagagagtgtgagggagcataggatgggagagagagggatggaggctttactgagagagggtgagagcataggacgagagagagagggatggaggctttactgagagagggtgagggagcataggacaggagggagagggatggcggctttactgagagagggtgagagagcataggacgggagagagagggatggaggctttactgagagagggtgagagagcataggacgggagagagagggatggaggctttactgagagatggtcagggagcataggacgggagagagagggatggaggctttactgtgagagtgtgaggaagcataggacgggaaagagagggatggggcattactgagagaggatgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacgggaaagagagggatggggcattactgagagagggtgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacggaaaataccagagtgcaatagagaaggtgcaaaggagagctgcttcccacacccttgctcctggcctgtgtgtgtccgtgatgctgggtcatggtcaaaaacacggatggccgctgacatgggtctttacagagaaaggctccatccaatctgaaaggcctgcagcaggcagaacctatccgtagatgaacaccctcgctctccagaagacaagaagcgggagtcgcagcctattgaagtgtagacatgatgtctacacagccaccctgtgtcctgcaagagcccaggctcagagcgtgtgcaccgtgagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggcagagctgaagggtggcgggggtcggcttcctcctctctgcctcttcccttccgccacgcttcctacccacaccagccagtctccagtaacagatatagaatgccttcatttggaacacggagagacaagcgtgccgtgtgggaaggagagaagccgctgctggagcaagcgtggtcccagaggagagcctgatttgagttaaagcgagagggcaggagaagcagttgggaatcgaggcagtgggccgaggatggcccaggttcaagaggcacagtgggaggctgcaggtgtaaggagaaggacggctcaggtgagggctgcacaggcgctgaggggatggggctctgggtggtgacatctccaaggcaagagagcacgtagatttcagagcaaaactatctgggtcagaatcccggatccaccctttatcactataaaatgttgggcaagtactcacagtgcctctgctctctcatgtataaaatgtgaggaaccatagcaccaaaatcatggaggtgttaggcagatggatgtgctgggaggaaacctgtttactagggggctgggttggagatggggagcttcttatgatgtctgctgtcagcagctttaaaggagatgtgggtgtctatcctggtggtctccctatcagcctgggatcaggtggtgagtggcttcacctactaagcccaaagatgtgttaggaaaacaggccgatatctatcgataaggaaaactggccggcacgatggctcatgcctgtaatcccagcactttgggagaccaaggcgggccgatcacctgaggtcaggagttcgagaccagcctggccaacatggcaaaaccctgtctctcctaaaaatacaaaaaaaaaaaaaaattagtcgggcgtggtggtgggtgtctgttgtccccactactctagaggctgaggtggaagaatcgcttgaacccaggaggtggaggttgcaatgagctgagatcgtgccactgcactccagcctgggtgacagagtgagactctgtctcaaaaaaaaaaaaaaaaaagaaaatgaaactcaaagggtcatgtcatctccgtcatctcctaagtgctgcaccactaaccaggcagataggacagacacatgtccagaacatcgacgcgggcccatgtgcttccctagagcagcgcccccgaggcagggacggataggacttccacagcatcatcgtcctctgagagggaagaagcaacgtgggagggctgcatggccggtggggggtccctctgggatgtgcatgatgctgggggaggggaaggaggagctggagacagggcaagtcctggtagcagtgtcaccctaaaaagggatcctgatccagatgccaagagagggttcttgggtcttgtgcaggaaggagttcaaggtgagtctcagagtacaatgagaagacagagtttattgaaagttgctcagttacagagcagggcgtccttggaaagcaaagggaggaatgcgccatctttgtttttctcatataggggccttgtctatgtaaagactgaactaagctgtgtctgcttgggtgggggagccgacagcatgacaaaatgtatattattctattgttttaaagaaaaggatccttaacatttcagtgtgtaagtacatcaaagcataactataattatctccaaagtgataatgttaccagtactggacatcaaggctttctgttgttggaggagtttttgtccttgcaggcatcaccaagttgcttccttagctgtaaacatcttaggaccatgggctgtgactggcaaggagcgggccttgctagtttcaagatagagttggttttaaaaagatgttgccctggctctcctgggctcttgcttccctgacagcaggagtctcttctgcattttgtatactgcagctatctagaatctgcacactggaagaacgtaagtgtacaggaaccaggaagcttggagaggctgctggcctcctggtcttcctgtaggtactaaggaggcctcacccttctgggatccagggtctctccctcaaggcttgggttagggacattaacatctaaggaacactatccaccgcaggaggctgtagctctgacgtgcccaagaggaaagccctgacctacagtggcggccgctctgttctaggatgtggatggcacagactggtcagagagagccagaaggttctgggggtgagctgcagctgttggcccaggggtaaatgttgggttctacccagtgccatgttaagaccaagggaaagacatggtggacgggtgtggctctagtgaacgggatttccaccttagattctgttccccttgagccatttattgagcacctgctgtgtgccatgccctgtgcggggctgtttgtcctcctgctggggttgtgtttcttgggggacatagctctggccgcagagggattaatcatgcctgaaggacctgggaggcctccaggaagtgtggccactggacacagtctaattcccttctcttccgagaccttcacgcttgcctcctgcggtcctgcccaggctacaaagttgacattgtctcctaaacagtttctttggtgctaaattgtcaggttgcaaaagctatgagggaataaacgggtggtgcatggagctggtgtcactcattgatcaacgtgctattatacgctggggtacaaagggtgcccggtgacccttccgaatctattatttactcgaaagcagtgaccacatccacacacccagggtgacacagggtgtgtgacgaggcccacagatacatgccgatttgcaggggcacctgcactgggtctggggagccatcatcctccacaggagacagcgaccacctgtggatttttgaaagaaaggagtggcatggatttccccgagcgccacctctcattcctcctctcccattcatggtcacagcctgtgtttgagagaaggctgtccagctggggccatctgggtgtggggcaggatgaagctcacgtgccagtgtggaatcgacaccctcattctctttagtatcatgcagtccccacagcgacttctgcttcaggctagttccgtaacccgggaaattttgaggatggaaaagggcagggacaggagcggtcaggagtggctcagccctgagcccagggttttgcccagccgccttccgtctaggctgtccctccatccgcatccaagaagcggcatgcggacatctgtgactgtggaggatgcccatgcccctgtggggacaggaatccctctcctctacacagaggccctgagctgcttcctggggtcaggacacacctgcacaagttgaaaggccggctcttgttctttgaacaatagaaccaggaataattaatcatcggatatagttgggcagagaaactgcttataatttacaattaattaaccttccccttaaaaaaaaaactggagacctaatttcctgtctgatccacattgtttttgatatccattatttttcaatgtgtttttgttgagattaggaaatatttgtgcagaatatctcagtccgattaaggtgacaattgctcaggattttcgttgaaactgtgtattataatgaggctttctgcagcgcatcataaaaggaaaaattctttccatcatttaatttaaaactaaagccagactatgtaaaaaatattacatgtaattttaaggctataactttgttttgtggcgaaaaaattctaactttcagatgaggacaaaataaggtcagcattttttaaaacccttggaaaatccaaactctggtaaatctcagctggtagttaagtcactgtctaattaggattctaatttcacaatctcaattatttttaactttctggtgaatattaacagaatgatcagttttggcaaaatactaggaagaaaaatgtaaactaaggaaattaaaaatgatgatagggttcacaatccatattacctaaaacactcaaccagtcactgtatagatgagtaataacaaagtcagtctcagtataattgtgaacattccttttgaaattgaacatgtgaagacacatgcacacgtatgtttattgcagcactatttacaatagcaaagactcggaaccaacccaaatgctcatcaatgatagactggatacaggaaatgtggcacatatacaccatggaatactatgcagccataaaaaagaatgagttcatgtcctttgcagggacatggatgaagctggaaaccatcatcctcagcaaacaaacacaggaacagaaaaccaaacactgcatattctcactcgtaagtgggagttgaacaatgagaacacatggacccagggaggggaacatcatacactagggcctgtctgtgggtgggcggaaagaagagggagagcattaggacaaatacctaatgcatgcagggcttaaaacctagatgacgggttgatagatgcagcaaaccaccacggcacatgtatacctatgtaacaaacctgcacgttctgcacatgtatcccagaacttaaagtaaaataaattaaaaaaaaaaaaaaaagaaactgaacacatgtcaggagctgaatttaaaacaatgttttggtcagtaccaggacacgaatgacaggctgcctgcctgtccgaccctgggccttatagacagtgtcacttgataggatgttttgagacccggacatccccagcagcccagcatgcacaggctcagagcccacaggtgcacactggggttgtcatgggagacaggtgaggagactggagacaggcaggtgcagaaatgtctctgtcagtatttcccatgggttatctctcacttactagctgtgtgagcttcggcacattatttaaactttttttcccttagttcccttaagggaaaaaataaagataataatagtgtctacctggagtgattgcgttgaggattaaatgagttaacccatctacgcagttagagccggcttggcgtgtgctgggtgctcaccgactgctgggtgtggccatcaccatcaccacccttctaagaggacttacccggaagctgccaagtcttactggaattcaataagaaaacttacttccaaaaataaaaataaaagccacacacacattttccctgtaaatcttgataggaagaaggaaaaggtcaggatgttgccgagcccttgggttggaagaggtcggagtggggcgcgtcccaggtcgggaatgttaggacaaggtggcctctgtcttcatcgtgtgtcttgggtcccccttcgtaatgatactgtcctcaccacgtctttttattatgaaaaggaagagtggcgaggacttgagtgggactgttgggttgttgtgttgcagaggaaatatgctttttgcagagggcttagaaaacgtgcagtgaaaaaaacaatgagccttcttggccccaaggcctgtggctgctggcaggacagcggtcatctgctccaaccccctagggaagagtgagccgtttgctctttttctcttctccaacttcccagaacaatgagggtgatgaatgaagaggtttcccatgatagtgaggtaactctgtcagtagaagccctgagatgtccagaggcctgggctcaccaggccccaggtcagaaggctcggcagcgccccacacttggctttcggatcatctcgtgctgggctcatcttcccttgcggcttcctctgctccctcagttgggcccctgcctatacgtctccaggcccccgaggctggcatgcagccccatggtcataatcaatgttttatgacacctgcagactacaggcaatagtagacgattttacggataatagttaatagagctctcacatcgacaacccaatgagggcagcctgcttctatccctgtttacagaggaggaaactgaggcacccaggggctgggtcacttgcccatggtcacagctggtagggggcagggccggatttcagcctcgaaagtctagctcctgaggccatgctgctgcctgccacccatcccacctccttaaggtgctgtgttcccaccacttcctaatcctcaatctcctctcccctccccatccaggaagcctgctaggatggtccttgtccatattctccttcctggcctccacctgatgatagcttgttgtgatacttgattcagctcgcgagatattcctagaacaacgagagaaaaatgaaggcgcattaggcccgccacaatcaaagctgtcgttcccttctccatccctcacggcccccgaggaacaggccagcccctttccacccgtcacatcccctgaagaacaggccagccccttctccatcctttatatctgctgaggaacaagccagccccttctccatccctcacggcccctgaggaacaggccagccccttcttcatctttcacggcccctgaggaacaggccagcctctttccatccctcacggcccctgaagaactggccagccctttctccatccctcaggtctcctgaggaacaggccagccccttctccatccctcacgtaccctgaggaacttgccagccccttctccatccctcacgttccctgaggaactgggcagccccttctccatccctcacatcccctgaggaactgggcagccccttctccatccctcacatcctctgaggaactggccagcctcttctcctttccaatgggtgtgcaggtccctccctgcgaggccctgcaagtgtctgcaaatgcaccagctgatgcccactgcccagtgggtgttcagtgcactgaaaagttccctctcctcccccactgcagccctcctgcctcacttggagacaatgcagaaccaagatgggatcaatagtcattgatttctcttggtcttgaatgatttttacacaagtcattttgcaataagagggccttcgtacggtgcctgtctgcactgagggcgtgggatgacagccatttttgctcagatttctgcttcctgatccacggtaagatgtttcctccctagctggggagatcctcatggctgaagacagtgtcctggcctcttatctatcctctggagagtctgcctcacagcactggcatagtcgtggtgagcgcaggcactaggatggaaaatctccggcacacgggaggggcacgttcaacaagagttcaggataatccctgttaccacaggggtgttcaggccttcacaggttggcagagggcccaagtgtcatctgctggtcacctcagctctgtgaggaagaaggggtgcagaccaggaagtggctcagggaggtcggaggccagcccaaggagggggtgcctgagtggccccaaccaagtgccgcgctctcccccccgccctctccccgccgccctctcccgccacgcacggcctcctggcagctctgccttttgggcacacgcaccttccgtcttcactgaatccactcccccttcaggtgggcaaacactgcctcttgcagacatgttcttgcctgtgccctgtcctgggaactgtagttggcagttactttgaagagcttaggaaacagcatggagttctgtcaggtggcagacattctagaatctctctaacaaggctgagtcggtgtgtcagtcagggccgggaaacaggccgtggagctgcctcagaaggcccgcaagttcatggccacacctggttctgtgtaggaccacatgccttgtatgtcccattacattgaaatcttttcagactgtgatgaaggaaatacagattttttttttttttttgagacagagtctcgctctgttgcccaggctggagtgcagtggctcaatctcgactcactgaaatcttcacctcccaggttcaagcgattctcctgcctcagcctcctgagtagctgggattacaggcatgcaccgccacgtccagctaatttttgtatttttagtagagacggggtttcaccatgttgaccaggctggtctcaaactcctgaccttaagtgatctgctctcctcagcctcccaaagtgctgagattacaggtgtgagccactgcacctggccaaaatacagattattttaaaaaagacattgaatgtttagaactgaattaaactgataactgcaggtttttgtttgtttgtttgtttgttttgttttgtttgtaagaagggatgcttatattcacagagtttgaaaaacaagtgacctaagccaacccctcattttacagtagaagaaaggcagcccagagaggtgggaccagagctggagcctgggtcccaccgcctgtttgcgtccttcccgtgagagcacgcagcctctataagcagcaggtgggacccaggcgtttgtctatggattttcctctcaaagttgctcttctctttactagggcagatcccaattttgaggggcctagagtctatgaaatttgggggatcctctttagaaaaaggacagaagattgtgaatggaagcaaaggcccatgaaggggagaagctctgagacccagcttctccagccccctggtgcgaattcacccctcgccaccaccccgcagggatgctcccattccacagcaatttcccgcagactctccagaagtgtgcactccggctcactgcttccccagtcttcacatgtttgcttgtcacttgattatcctccccgaagaggagccacttgtactttaaatgcctccttcacatcagcaggcaattaacagtagggaagggagaaggagggtgagcagtgaggcttctcaatcacacaactcaagagcacggggacgttctcccaggagcagcctgtctcttgtgcctaaagcacaaggggcagcggcaataggacggaaggggaccacccacgggctggactctcgaggccaggcagaggccactgtgcggtctttccttccgcttccctctccctgagccttatgcaaatccggctcttagcacagcctttagctcttgtctgaattccaggggaggcccaagatgggaccccctacttcaaaaataagcttgaattcaaacctccagcattgttccacagtgcgcaggccagaagacatccattctgttcctccaattccctgtaaggcccctctctgtgtccagccagatagcgtgtctccaatccatggggttgcagaaggggctcgctgcctgtgcactagatgccaatacggtgacaccaggattttcagaaaagaaaagctttatattaaaagtctattcccagctgggcgtggtggctcatggccttgggaggccaaggagggcggatcacgaggtcaggagttcaagaccatccaggccaatatggtgaaaccccatctctactaaaaatataaaaaattagctgggcatggtggtgcacacctgtagtcccagctactcgggaggccgaggcagaagaatcacttgaacccagcaggcagaggttgcagtgagcagaaatcatgccattgcactccagcctaggtgacagagcgagattctgtctcaaaacaaaaaaaagtctattcccaaggagacaggcatccagctcaactctgcctccctgtgctggcttcaaggcagtaattttatttttaaaggaaaaggattcagcaggcggattctgggattagcaggtgattggtggaaggaacggggaggtttggaaagtccttcagcacacacaattatttcttcacgattactcatgggctgtgtgtgcaaattcaggggggtggggtggaggaaattcagtccatgacatcagcaagctcattctgcacagaccccagttgaccaacttggttctgacagacttcagccagttctcttatctcggggcggagggagcgtcagtgtttcagcaggttgtttctattcttgtctgccattctgcgagctcaagaacttctgttagccattcgtttctttaactctttgaggcattgtttcattattaggatgcttgcttatttcttgtctcttgagcaactgagtgggtggatgacccagtcgattaacaaatgagtgagaaacgagaacatccttgccacactgggacctgtttgagcgtgaggcaggtgagcagaagacatcaggcccagaagttctggaagctccctcaggtgcccacaacacaaatgaagaggaaagagagaagacaaaacaaaaagaagggtaaaggagcctggcatactggctcagccttcctctttcaaaacttttgtttttttttttttgagacagtcttgctgtgtcgcccaggcttgagtgcaatggtgcaatctcgactcactgcaacctccgcttccctggttcaagcgattctcctgcctcagcctcccggatagctgggactacaggcgcctgccaccatgcccggctaatttttgtatttttagtagagacagggtttcaccatgttgaccaggctggtctcaaactcttgaccttaagtgatccacccaccttggcctcccgaagtgctgagattataggtgtgagccaccgcacccagctcaaaacttttttgaaactaaatttgagctcagcgatctaaaatacaatggcataaaactgcaagtctataaactgggcatagctctttcctcctctgctctgcaccaactggggtgaccagaagggactgaacagtctaggggcaggtcttgctcactcacgcgtccatggctgacgctggctgctagatgaggcctgctctgtgtcagccaggacaccaaatgtggcctctccatctgaccagggcttgctcaccacatagaaggtggtgttcagagtgagtgacccaagcaagagagagccaggggaaagccataccaccctgtgtgaggccgttcttgcattgcgataaagaaatccccgagactgggtaatttagaaagaaaagaggtttaattggctcccagttctgcagactgtgcaggaagcatagaggcatctgcttctggagaggcctcaggaagcttccagtcacggcagaaggccaatggggagcaggtgcatcacgtggtgggagcaggagtgagagggagtgagtaggggtgagggaggcaccacacttttttttttcaaggttttattttatttttattttttattatactttaagttctagggtttgttacataggtatacatgtgccatgttggtgtgctgcacccattaactcgtcatttacattaggtatatctcctaatgctgtcatccccttcccccaccccatgacaggccctggtgtgtgatgttccccaccctgtgtccaagtgtcctcattgttcaattcccacctatgagtgagaacatgcagtgtttggttttctgtccttgcgatagtttgctcagaatgatggtttccagcttcatccatgtcccaaacagtcagatctcatgagaagccgctcactatcatgaggacagcacggagtagatggtgctaaaccatttgtgagaaatccaaccccatgattcagtggctcccacctggccccgactctagtatcagaatgacaattcaacatgagattcagacagggacacacatctgaactataacacaccctttatgacctagtctcacaagccatcactttctgccacattctcttcattcaaaacactgccctggttcaaggagcaaagaatcacctcttctttggggagtctcacgccctggaagtagcactgaggctagttttggaaaatacagtgtgccacactcaccaaggcgtcagtctctgtgaagtaaattatactgagacatcagtgacttcatagagaaagggcatgaataacccctaaccacaaataatggcaagaagtatccatggaggcatcttgggaagaggcttctgatgttccatgcctactccaggcagctgtgtgccccacggccttccgcagtagttgaattcgcagactgagcatggcattggacccgatggccttgcttccactgagcctctgcacaacactggccttgggaaagaccacaaaatagtaaccggcagggctcagtagacccggaagcttagaacctgtagaaaagagaaggcttcctgtgatcctcctgcttcaagcaagggctccgccatctctcctgcagataaaaactcaggaacattttatgttctgcttttggagggagtttataactttacattctgtcttaaagaaaacacaagttttgaattctgggataccgagttcctaaaagaaaatccaggcaacaggaggctcccaatgtgtccaacctgcctccgatggtgcaatgaaacagcaagtactaagaaaatcaccaaagtgtggaagtggcaggggactgctttaacagcaagagaaggagaaatcttagtcgtgctagttccacatcgtggctgcctttgacttctggccatttagaaatggctctgctgccagctgggtgcggtggctcacgcctgtaatcccagcactttgggaggcccaggcgggtggatcacccgaggtcaggagtttgagaccagcctggccaacatggtgaaaccccgtctctactaaaaatacagaaattagctgggtgtggtggcgggtgcctgtaatcctagctactcagaaggctgaggcaggagaatcacttgaacctgggaggcagaggttgcagtgagccgagattgtgccactgcactccagcctggatgatagatcgagactccatctcaaaaaaaggaaggaaggaaggaaggagagagagagagagagagagaaagaaagaaagggaaagggagaaaagaaaggaaagaaagaaaagaaaaatggcttgctgccgagggaagagagagagatgaaataaatatgtctcctcaccctcttcctacccctgagctaggcacagttcgcttgtccatatgatgagatatagatgcgagggtttagctgtggattccacagcctccatcagcagcctgcgtgctcctaataaaaatgcatcctagcctcccaccttggcctttcctcacccagaaaaacaaggccagtgaggtcctaaagagcctattctgcaggagcgcatgtgagaagaactcttagagaaacagcagcaagttcaatttccccagagaaccctaaagcctcctatttcccttcagcctcacgtctgtgctccctaagctggctttggatttctctttagctggacttcattggcaggtgcggcaggagggtgtggggagccccctagatacaactgccaaggagactttaagtctgcctcactcccggcctccctttttgtactttctagaactcctcttggtgccctctctacccacacccctgtgccctttctgctgtgcactcaccttgcacagacctgtggatttggatgccccacctccatctgcaccacacctgagctctgtgggcgctcttcacctctatgccctgggcactgcatcttaggccttggatgtcatttggaagcagagtctctcttccttgttaaagcattgctgggatacagaggggagagctgtcctttcccgggcttgggtcctttgtagaagctaaaatggcacctgttgggcagctctgtcttcatcttgtgaatggaattgaccactctcgctcggtggatttgctagaggagcttcatctgatgttatactaaggacctcaagaattcaccttattcttgacctgttaggtccatgaaagtgttactgtaacctgcgtggccaatgagatctccactccagccagcaagaagtgggaaagagaggcggtggtcataccctttctccttaaaggcggaagacaggtgtcactcatcaccttttctcaacccagcagcaggaactcagcacacacccaacctcacatctggggagtctgggaaaggtctttatcctgggaggccgtgtgcccacctacaagccattggttcttttactaaaaagagaagggagtgtgggtgttggaggacaatgagcaggttctgccattccaccttccacaagaggcttctctaatttcctccaataagaaagaggcctctctgtattcccagaccccatagttctttctggtttctaccttgcccactttccccgagttgcaagttgcagttctccttctgtttactgtattacaaacttccaagctttgtctctactttactataccctagggaattgtgtgtactgagtactcagtctttgttcaataaggttaatttccctgaacctccaattcctcagttgtaaaggggcacttaatataagcttgtaggtgcatcacattctctccagagagagaactcactcctaagaaagcagcaccaaaccattcatgagagatccacccccataacccagacacctcccactagtccccacctcccaacacctccacattgggaattagatttcaacatgagctttagtggggacaaacaaaccacttccaaaccacagcacacatatgaatgagatcattcggcattcgtctttctgtttctggtttatttcacttagcacaagtcctccaggtttatctactatgttgcaaatgccaggatttcctctcttctagctagtcattgttaaccagaatgtgcaccaaactcacctgaagaggttttgcagaaaaggagcctgtatcctcctcactgcccccaccaaataccagttctcctgcctgaagtgcagcctcagcatctgtataagcagcacacacatgcgcacaacagtccaatggagtcccctgcaaacctacctaaacctcactaggcaaataggaaataatagtggtggtcacctcttcatctgtcaaacaacctggaaaatgtgaagattcctcttcattgttgcattggcctttattaccttgagcacaaagggatttttctcctactggatatgaccttaatgctgcttggcaggaatgaataacactccagataatggcactggcttcttcaaggtatagtgacaaaaaatgaaaaatacccagcccagatcctacctggggctgaagctctggatacaacttttgccatcttcaagagagaagcagccattgaacaccgactgtccccggatgtatctttcttttctgatgctaaaatagccccccagcaggacagggaaggtgaagaaaagatgtattctctagttttcccaagttaattatacttgctcagaaagccaagtgattcattttgttccaaggcaggcgtccatgcaattaatttcgttgatgaaataggttttcttctgcaaaactctgcttctaaactgcatttggtgcatggcatttaagccaactgcctcattaagctggaatcctgcagaaaaatgtttgcagaatagggacatttggaattaatgctaaaatgtcaaggtttcttctgcccagcacttttttaccccttagtttcttatacttcattatcacattaatgagcaactaacgtacaggaaaataaaaatggcaaggagcgatgtgttcaaggacacctagggaaaataaactaaagctgccctagttttgtacggctggcattttggcgtggcacaggttcttcgcatgtgccactgtctcgatgtggaatgacattcagaggaactaccctctgccatcacacacaccagatacctgtcatccctgaacccgatgacccaatggtcgctaagttcccttcttttattttattttatttttttgagacctagtctcactctgtcacccaggctggagtacggtggcaagatctcggctcaccgcaacctcccaggttcaagtaatgattctcctgcctcagcctcccgagtagctgggattacaggtgtgcgcccagctaatttttgtatttttagtacagacagggtttcaccgtgttgaccagaatggtctcgaactcctgacctcaagtgatccacccacctcagcctcccaaagtgctgagattaaaggcgtgtctctaagtttccttctaaccgttacatttggtaacctgtagtgatggttttgttctacctcccagttctctgaagagtgaattgagcttcatggaaacactctggcatttgctgataagatcgatggaaatagagtattctcagcccagccttgtggccagccttcacccacatttttttcagtctcttgtcccaacaagcatgacccactttggactgtgctggtcagaaccaagcagcagcatttcctttaggtcagagagcgagtctagaaatgagatacaaacaaccctgggtggaaatgaggggtgacccttgcccccccttgcctagtggcctcttgtggaacctacggggtaggaatgaaagtggcctgatgttgcacgtggccgatgatttatcatccctctggtctcagaaaagattgctttgggttcaaaggaaagaaagaaatgagttgtctcttcgggggttttgttgttattgttgtttgtttgtttctgtccaaagctgcttcatttttaaagctcttgttgcagccagccgtttttctgttttggattttcccgagtcggctgtgaattaatgtcccgtggaaaccactgcagggctcctctgctgatttctgtgggctctgcaccttctcgctctgccctgtgaattctgctcactcccagggactctactccagccccattggcccctttcttgtggccctgcagcgcagacgtgattgagcacaatcacccacaaattgcattgcaaatggtgcctattttttccagcagaccatctgctggagtcaattactcaccattccaagcgagcagcctgggcagatctggtgactctgcataaagtcacttctgagtcacctcatcccaaactcgcacctgaacgtccacctcctggctgccaaagcgactggaaaattacagaccctggaggtctggcttccttcctttgtcttctcctcactgacctccacaggcctctgagcttctattggcactgccaaagcttctgaggctgtgagacagacgcagaggggaaggggatgctagaggcggctgttgtgcccctagctttgcagatcgggactcaagaacacacagcaggactggggctcaagtccagtgcaccagggctcctgaattcatttttccctgagcactgctctccatactccgggatgcaccagagtacaggaggtcaaacccgccacagggtttgtatttcaggagactctactgagatgttcaggagtctgcagcagactcggcattgccttcggtggggggctgtctgctggggagtctgaccaaggcaagatgaggaagactcacgtgacaggggagcgaggctcaatgagctgcagcatccccatcagtgccatgccagatgccacagacatctgggcagggaggggcagggcatgcaggcacatcacaccctcagccccactgcccttagagcctggctcctgctcccaccccaggaggatcatgggcagcgtgcctgctgcaggcctctgggcttggctgtgaaatgccaccatggatgacactgacctggcgctaagccccccttcatgaaccctcctcccggccagctggtctcctcctggtgcctcccgcagaacctgggaggctgttgatgtgggctgcttcttccctgtctgggactgtgccctcctgtgggcagtcagcccttggcttccttccaatttacattgttctgttgcatttgatgccctcgttttgtttttgcaatgtgttttcaggcttcttaatcacctttctacactacaggtacatagagcagatttatggtacgcacctaataatagcgagttgaatgggactcatgaattatattaatcattattttagaagcaaatctagagggaattagtttacactatatatagacccagtacaagacagaaccccttgacctaagagctgttcacaatgaaatgggttctctgactggttacccttgggaagtgtattctcccaacgtgttgaaaaaaacgctgtagaaatttcccctctagaatagatatcacaccctacaaaactcatctgtcgttaaaacactaaccaggacactgatgggctaggaaggaataatgggtgtttctggttgaagcccaaaagaatcagtctttcatttcagtccttctgaagatggatccattttggttttctgccatgcatagtgagcttgtacccttcttgtaagaagccacacagagtgagcttgcaccctttgtgtgctgcaaggagcatgctgggcctttggactcattatctgaggagggagctctgtgtgtgcgtaaatccctggtctgcttttgggcgactcagcctctgccagagttcactttctcatttggttccgtctgcatgggacacgcttccatgtgaatttactttctccagtgctgtttttcaaatcatattaagtaataatcaacaatagtacaatcatagttcaactcaaaaggacgtgttgggctcatagtgctcaaatgtgtgcaaagaaaaaaaaagtgtttccagacgattagcatctgtttgattgagctttggttaatggggttttcctgtgctggacttagtcatcagcatcagacatttcttgagcccccatggaatggaagcatgtgcagaacacagtgaaggttcctcaaaggttgtagcagataaggggctctgcagggactcgtttctttcctggccacctcatgttcctgctggtgcagctccaatttccactcacttgttactattcacatttctctactctgttttcccttagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggtaggcaaagggacaccgcacagcaaattctttatattattcatgaacaccccaaccctgctcactcagtgtgcagacgtgatcatcagacatgtgtatgagcaaagcagttaacacaagaaagactaatcatgtctcattacattgcattacattcccgcctctgttgagctgagtcattggcaggtttacttcttttaggtaaccgaactaatgttcatcacctgactcagcttcactgaaccaaaacacacagggtacctcccctcaccactccccagtgatgaaggtgcacctgccctctctcacgcatcttatttctactttgagtttggcctctgggaaggcagaaagacttccatctgcccctggtcccctgggtctgggcaaggctgttttgttcatggtcactgctacgggctaaatgtttgtgtccttgccaaattcatacattaaaatcctaacccccaaggtgatggtattaggagggagatcactgggaggtgacaagacatggagggcagagccttcatgattgggattagtgcccttatgtatttgtctattttcatgctgctgattaagacatacccaagactcagcaattgagaaaagaaagatttattggacttacagttccacgtggctggggaggcctcacgatcatgtcagaaggtgaaaggcacgtcttacatggcggcagacaagaggagagagtttgtgccgggaaactcacctttttaaaaccatcagatcttgtgagacttattcactatcaggagaacagcatgggaaagacctgctcccatgattcaattacctcccaccaggtccctccctcatcttgggaattcaagatgagatttgggtggggacacagtcaaaccatatcaccttataaaagagaccccagagagacccctctctgattccaccatgtgaccatacagcaagaaagcgtcctctgtgaaccagaaattgggccctcgccagatactgaatcagccagcaccttgatcttggacttccagtccccagagctgtgagagatacattgctattgtttgtgagccagtcagtttatggtgttttgttacagcagcctagaggggccaagacagtcatgttctgacccaatgagccagtagaacagcaagtgtccagtggctgggagggaatattggggggaacagggatatccaaatctcactttattaccaaatcaaagcatcccagtgtgagtggagggcctgatactaaaacctccacagccactcagctggagagaagccagtgcccgagtatggacacagctcccatggacacatagagtctgccatgctggcttctggcttcactaggcttctccaagacccctgggcttggtggaggtgagcagtttcctgcctgcaccctgcctggtgactggaggctcacttcctgccatgagctgcctctgccagggggcatttaaacctcagcatcctagcccaccagagagctctgaaagctgatggtatgtgcctgctctgccataatcatccccacagaccagctggcttacagtttgcagcaagaggagtgataacttataaggcagatatatgaggccagtgaggttcccagagtcacagcctagagaaaggaaacacctggtgtcttagtcagttccagctgccacaatgaaataacacagacctaggcagcttaaacagcaggaatttctttctcacagttttggcagctggaagtccaagattagggttccggctgatttggttcctggtgagggctctcttcctggcttgcagacagccgccttctcgccatgtcttcacatgaaggggcaagagagggctctggtgtctcttcctctccttttgtggacatggatctcatcacaagggtgccaccctcatgaccttgtctaacctcaatcacctcccaaaggtcttacttccaaatagcatcacactgggggttagggctgcaccgtatgaattgaggaacttgttccatccatacacctggtaatacaggctcctttcaacagcctttgatcagcatggccaacatctaagagagccccagaaggaagaagaatgagacccttatggccacagccttcctttctgccttttccaattctgagagcatctggatgttaacatggcatggatttgccttcgacagaattatttcactcctttttcagctaaccttgattggtcttagtctgtagcatgtggaagggtccagcattttagttggaagcataattaaatagagaaaagtgtatgggactgatgctagttccttctaacccttctacatttcttaccagctgttcacagccaccccacccgccagaagagctggtggctgtctgaccttcatccaacccagagatgaatggttcccatggttatctttttgtgggagtttccccagtctaggagtgataacctggaatccagtagggtgcccttgattttacagtgaactctcagaaggtgctctgaagctgggattatgaaatcccagattactcaagatttggggtttcatattttaatagaaaaccaacattctggctgacagaattcagatgctccttgccccattcccacccactcctaaatcagaggcatgaataggcaagcctgcctgacatgccctgtcgtgggcctgatagcctctgtaaacctgaacatcttctgcagggtggaagtgagaacatcagacaacaccccgaagtccccctaaagaggaagccccacatctctccccagacccatacttgtcccccagagagtggggaacagggaagcagaatagtgccccagttcctttttgaaggacttaatctctccccatgctgagcatggccaccgctcctcaatgtccatcatttgctcacctccaactctccccttcctggcatccaatccatcttttctcccccactcctcttctcgtcttctcttttaagcaaggggctcagtactcacttgacattgccaaaccggggagttgggtggaatgggaagcggatgggattctagaaaagcaagaatcagcccacttagccctttgtccttttgaaaccctacacatgaaccatttgttctccacattaattctgctccttaatatggagctccagtgtcctggagtcccacctcggaatctcccaggaaaggctttgcagagctgaagttcactcttgtataaggctgcttgttcatgtctctgcccctttttaatccccaggctggaagtgagaaccccagcatttccctacacgttattggcttaaatggacccacccatgatctggagatgatgccgcctgatgatccacggatgaggtttgcttccttctattatgttaccaaaaaaaaaaaaaaactaagatgaatgttcaatgtgcatggtctcttctggatcagatttatcttacaacaagtttaaacatccaagaaaaaggtacctttcctaaagatttcctcactgctttatgattccattttctaggaaaagaataccattcaccaagtactattattttttaccttaggtcagatgcaggttatcctcctgagagctgggctcctctgggaggggcatggctgggccccaggcctgcctcagggggacaccagaggaaatgatgcggtcttcccaagacaatccatggagtctgaccttccataaatggtgctctgtatttagagcattttttagagcatggagcaatttgccagtggcaaattctattctaataaagccacatctcccagttggtaaggtcgcaaccctgtggaaggtattaacaatgttattgagttattattattagcatctgattgtggtcgcttttttctaaatcaaaacaactgatttaggatcgaatgtagtgatctgaatatcagtttagtattttccccaaattcaagcagcgtggggaatgattatacttccagagtccagctataacatcatcagccttctctctgttaaggatattgatgagagactcaaaaagaggaggggattttaggggtgccaggacccacccaagtatagattctgaaatttcatgaatggcactatttaaactaagaataactcattctgaggctcagcaaagacccaacccatattttgctatacctccagcctgggcctttattattccattcaaagctccatattactagtagcttctggcagcttctggaaagggcaggaatcgaggcctcaggtctagctcggggatggatgctccagcacctggtgactctggacctctctgaatgatgtgctggtctcctgcagtggctccagtgccacctttgccccacaccctgagctcctgcacagaagcccgaggcctctgcagaattctactgcgattccttcccctcatctttcttcagtgaaacttataatgttgtaagatccccaagtggatggatgaagcccagaagcccagtgctctaggaagcgtgaggcactgcctgcccctctcagccctgcatgggtcttctccccaacataggagggcctgtggctctagaggtttaatgaacctggcccccagcagctggtcccagggacaactggtcactggggtatcagcccaaggtgtgcgctggtttggagagttgaattgatttggctggtgatatttttgctgagatttaaaaaaaaaagttcagatgattgctttggcttttctcctaaagttccatatattttattgttttcctttcagcccccatccctgccaagcctcctggggcctggtccagcaaactcactgaattaatatggaaagtcacctggaaaatttcagccatctgtttgagttaattgaaaatctcgtttagtcaatttggtgatgctgtttccacaggcttgattagcttcaaggacaatgaaaaattagcgtcagccaggacttgaagcctggatgctgggcttcaggttttctggttgctctcatttcctaagctcaatgcaataatgcattttatatgcaatgtaaatttgtagcatgtaaatgtcacactttctcatactgcttctctatcacacatctttgagagtttttaaaagtccacacagatatatcagaaatcccaggctcaatgtagagcagatgtttagtatttgccagccatttgcctgagcactgggaatttggtggcaaatgaaccatggagttcacagtgtggaggggaacctggatcctgaagaagtcattactagcaagtaaatccctgcaggtgtgagaagggctgtggaaacgtgtggaagaggaggccacctggtctggagggtggcagtgtcacggctgaggtcagagtttctgcatgtccatgctactgacatttggggctcagcaattcagtgctgtagggggcagtcctgtgtgccgtagagcactaggcagcatccctggccttacacattagatgctgtcatatctgccttttccccctccagttgtgaccatcacaaatgtctccagcattgcccagtgtccccagattgaggactactggtttcaagtgaaggttctctagccaactgcctgggttcgagttctggctctgtggactctgtcaagttactcagcctccctgcttcagtttcctcatctgtaaaatggagataattttaataagaaacatgtttactctcgtggacagttgtgaaagttagatgagataaggcaaggatcatagggctggttcctccaatcgttccatcttgtggctatacataccccttgtatgtggacaactctcccctgtgtacctcaacctggcctgggtcaggactctaggttcaaaaagccaaccacccaaccagcatttctactgggagtggtcaccatataatttttaaatggtcaaattgtgattctcagacaaaatcaatcaacatgtgtccaagactttattaaactcattaattaataagggaaccagtgagctcttaaaaagaggccatagaaccatcgagaagctagttgtatagaggcaattgaacaaggacatcctagggtgagtctgccgggttactcagccatccgggagagacgcctaccccagcagggttgagaccgcccctgcaattggaaatcaagcccagcatgtccctggagaagggcccagtgatcccacctgcctctttaccaccttcagatccatttgctgacactgtctacacagcatctcaggccgaacccggtcaaagccaacctcccactctccttgtctacacctgctccctgcagtctccccatcatggtccagggcaactccaccttccaggatccccggcctcctttacgtccctctgtgctggggaccctccttggcaggtgcctggcatcagcctgcaaccccccgccgttccccactcctccctggcctggcccaccagcactgccccctcctgccccacccactgctgaccccacacagcagccagagtaaccctttaaatgacatcaggccacgtacccgctgctcccagacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacagaggctcccctctgcccagagagctcctccccacttaggtcctgatcaaatatatggttcccacagtgacttccctgataaccacatttcacatggcagccccaccccgcttccattttcttccttcaattcatcccagtggaatttttagatacttttttaaattgtttcattttcattttcccgcctgccacctagaacaggaagttgttgaggcagggacgttagttcctgtggggcgggccctggctccagttctgcagcagggctctggaaccttggctggatggatgtattgacttcaaatttagccggtaaaatcttatttgcatgggattcttgaagcttgagatatcttcagttgtgctggtacctttctaagaaccaaaacttacttgctatttagccatggatgacatcttgtcctctcaagcacaagatgctaaaggaactaactgaaactaagacacctcgtctgtggagggacacaaaaggaatgaaccctaagccatgcccctgagcacctaggaagggagacatgcagaggtttctggaagcctgcagtttatttcagcaggctagctcacgaaccaagaggaagggagaaagcagttcatgtatctgctatctaacctttatgccactcattttcaattattttttcctgtttgtttgcttgttaactagattgacttctccgatggttctcagatgcagggagagttaagtctgctctttcaaatctttgcattggcaagcacttactcatcatccatgtggcatgtgctgtgtgaggcccttgggtgattaagacgtgtggcctctcctaatgagagctcacattccaagaggcctggacagcttgtagccagagtctgcatggaagtgtggaaggagccacacctaggagcagaggtgccccttgtggggtgagtgggaagtgttcaggatggttttgcagatgtcagaaggatcccggggcaaaattggaggccctcttgggaaacggttctattaaagagaactaagagcggtgggcccagagtagagctcagccttccttgggctaatgcagggacccaggccttgttaagctgaacctgaccaggaaagaataaacactgtctatcctgtgggtggaaaaaaataaatgcaaatcgctgtgctgtggtttctatgctttcacacagaaacccagctgcactgataaaacaaatgcgcttgttttctgctggtttcctccggcctttcccgagcagttgagctgcgtgttgagttaagatgcggcagatagccagcacgatcattctgaagacatgttgccctgtgctgatatgtgctgttatttgcctccaaagatcctgtttggatgcagcgcagctgctcttctcctgattccctggcaagcagaggcggtaaagggctcccagaacccaagacacaaaaccaaccatgtccctgatgcacctgtgcgcagctgtgggggctcactcctccaccacccgcttccacggctcacgaaaggctcagaggcctctcactttcattttcttttgcttccatttatttgttttgatcccaagcaccaaggatttagatgctgtgcagctcctggcacagaagcatggtcggtccatgcaggcctctctcattttattgatttgctctttttcaactttagtccctactcccatgccctcgccacctcataggcacttatgtcgaatgcttagaggacctttgttcctctgtgtttttgtaaagcctgtattgttgcttgggtatgtgcgcgcttactttacatcaatggcattgtgatagagagccagataagctacaggatagaaacagatagagctccagacatagatgtctgtttctcctattttcctgtgagcaccatgtggagacctagcacacccatgtgtatttgaccaacccacggtttctaactgcacacagtgatgccagatgcccccagctcctgggcagcttacaacctcatggccttctctgcctccaggcttctccccaatatgcactgcccatgacacctccatgctgaccctgatgcgaaactcagccttctctctttccaatttatacaaaacatggtatgtgcacgagttttgggaaagctgagggtcatcagggccatgaaaacagcacagaacaatagagttctcatacctaatggcttgagcacccccccccaaaaaaaaccaccaccatcatcagtaccacctcttccccaaccttcaccacctatacaacctccaccaccaccacaccaccaccaccacaacctctacaacttccaacaccaccttcaccaccagctccaccaccatcaccaccaccacctctgtcacctccacaacctctacaacttccaacaccaccttcaccaccagctccaccaccatcaccaccaccacctctgtcacctccacaacctctacaacttccaaccttcaccacctgtacaacctccaccaccaccacctccacaacctttacaacttccaacactacaaccttcaccaccatcaccaccaccacctctgtcacctacacaacctctacaacttccaccaccagctctaccatcacctccgctaccaccatcacctccatcacctccacaacctccaccaccagcaccccaccatcacctccaccaccaccaccacaactacccccaccatcaccaccatcacctccatcacctccacaacctctaccaccaccaccacccccaccatcaccaccactatcaccgctatcaccaccacccccaccatcatctccactacctctaccacatccatcacccccacaacttctaccaccaccaggtccactgtcacctccaccacctccatcatctccacaacctctgctgccaccacccctatcaccacctccaccaccacccccactactatcaccaccacccccaccatcgcctccaccaccaccaccatcatcacttctacttccaccaccaccactgtcagctctcacttggtccctgttgctctccattcttaggtctcctctgcctccttccctatcataaacaagctctcctgcctcacatttacaatgtcaataacctgtcacatttacaatgacctgacttgcctatggttgcacttttaattagtagtagaaccaggacttgagcacgagtcttccgtcaccagagctattgctcagcattgtttaagagctgtcacgcctactgtatttccctttgtgcttgaactttcaggtggcacaaagctcatttggagggtttgctggcaaaatctctgttcttcctgctttcctccctcaggctgtggtccatctggatgttggggttgttcagacatcttcaggtgattcctaagtgtggccaaggcagagaagcccttctcagcagcagcattttacaaattatagctatgcccaacccccagttccaccccatccctgagtctgccatcttacctaaacatagtcctaacctctcttttgtctgggaagatatattattttatctgaatttgtgttccaattttttttggacgtggtctggatgtaaattacaatttcacaaatgtgctctgttcccctcacctgtagtcctatctctgttttcaccttgtgtgttaaagaaatcatctggctacctaaatactcaaatggattcatcttagggggcaccagttcaaggagattggctccagcagacagctttgtttacagccttgtgctttcagaatcagaccagggcagggtctttgttattcattagggtgagaagccattcccagtgactagggtaatggagaagctccagactagagaaatgccggatctttactgatgtgctgaaaaggaaattcacaaagttcctgttgatcatgggatcattaataaaaatgttcagtgctgtaggaggctggaaatctgagtcacagctgtcagaataataagtttctggtgaagaaagtacattttacattgtcatggcctgtgtttgaaagggcagctggattgttctgaagatgctgtaaatgcagggaatgattggttggttggcaggcttataatgagcaggagacatcagaaaaataaaatgggattctgcgtcgccatcctcatcaataaaacaccttagccatatcttccagctagcaaaacagtcttgacatctgaaattgtcagtaaaacactgaaacactggacaaggtttgccaaggcagagtcactgggctggtgagccagtgctggtaaactccaagggtgtaagtgacatccgcagtttcttcccgtggaccacaagtagcaaattcagtacatggatttcatggcatctgcaggaaaatgagacttggcaaaatttacctagcatcatgtttttaaatgtgttaacatgcattgaggcatgagcaaatattgaggaaacaggttgagtccatgggtgggtaggtgggtgatgaatagatggatgggtgatggttgggtgggtggagggatggattatgaatagataaatgcatgatggatgggtaaggggatagatagatgaataggtggatagatggataatgaatggatgggtggatgaatagatggatggttgatggatgagtgaatggatggatgatgggtggatggacggatagatggatgatgaatatatggatgggtggatggatggatgatggacagttggatgaattaatggatagagggatgatggatgaatgggtggatagatgaatggatggaaaaatggttgatggatatatggatgggtgagaggaatgaacagtagatggatggatggatggatggacagactgatggacaaatagatagatgggtgctgagtgtgtgaaaatgaatggctgggaaaaggacaacatggctttacccccaccactcctattcactgggtgtcttcatgttcacagcattaaattgttgaaaaaggatgccgcagtccctaaggcgcgttctctgtgaccccctctcacttcgttctccctcatcctgacagctggccctgcattatagccagcccttgagatggaagggacaggcagcatggtctattcctacatggaaagtgaaattatggaaacagacaccaaatagtaatttgtcttaagtcgtcacttttctgtgttgtagaaggcactctgccggcagatgtttttatgcaactgcatggctgcccgagagcatactcaaatgtggaactgtacactttagtagagcagcgcttggtatttagggtcgtttcagtttgctcagcggtgccctctattaaagcacatcatcttttaaaatgtcctctctcataacatttttgtacccctgctcaatccatgggataaacattgctaaaaaaataccagagttaactgtgggccctttatttcatgagataaaccagctttgttcccctcgccctttactgccacacaactgtcagaacatttgccaggatttgcaacacaaagaagtatcacagcacattaatccttgtgacggagacaatgctctattaatattttatggcaaacaaatggactaataaaaaattgatatgcttctcaccaggaagagtcactatattctgatttgaaggcacctttggcctaggactcatggaatgtaataacgtttcctcagccaggctgtgccattgcatgtgctcccccacgtaatccatggcagtccccaccctgtgctgaagttagtggcttgcccatctctgcaccgtccgcacctagaaccgtgtctcccacatgccaagccctgactagatgcgcttggatgcatcagtgcattggtaggcagatatagtgctttagaataaagagaaatttggtagcatttcttccagctatcttcgcttcctgttcatattttggtatcatgctctttttaaaatggaattttgattattaaaatatgaccatctattttctgtgattatcaaaatgcttcaatatctctcttcatcttggcagatagattattgcgtcttttagcactcagctccagccttatgttaaaaaatgattccacttcaaatcctattttctcctctcctttaactgctaccaaatttctctttattctgaagcactttacctgcctaccaatacatttacccattcaaagaatatttagtaagggcagatttggaaatggagatctatagttaaatagcgcttggagttattctcatgtggtcgcccactgccagacagaggatcgctcgtctccaatcagtagttctccactcgagctggcactggaatcacctagggccttgttaagccaggaagtgcttgtccccacccccagagtttcagattcagagggtctagggtgaggcttgggagtttgcatttctttttcttttttattattattattttttgagacagagcctcgctctgtcgcccaggttggagtgcagtggcatgatctcggctcactgcaacctccgcctcccgggttcaagcaattctcctgcctcagccccctgaatagctgggattataggcaactgccactaggcctggctaatttttgtatatttagtagagacggggttccaccatgctggccaggctggtctcgaactcccgacctcaggtgatccacccacctcggcctcccaaagtgctgggacatgcggttcctaacaccttcccaggggctgctggtacaggaaccacactgtcagaacctgacttgcctccttagagatgggggtagaggctgtttccaccacctgctttctcccctaattgcatggactttgcctgactttgccacaaaggcctcgcatccccatagctgtcctgctctctctgggtggcctgacctccctgggcgagggtgacaacactgcctgtgattgctgcgaaatcaggacagctcacacaggacgggcagggtcttctctcgtctctgcccgtgcttccttctaggcagcagtgccttctgagtacagtcatggtggtgccaatgatgtccctgtatgacacgagatgtgtcacccatgcagacaccaacaggtttacagggagcagcgcgggtcagtggcgtgtggcattattgcggctcgctgagcagtgggcagccattcccgcagcacaggattctgctctccctccacttccctttgtgaggcatggacgcctcccatcagtccaacctgttctcatgactgtgccttctgttgacgttgagtgttctggcattataacgttcctgtagagtctccctctgatcaatgcttccctttgtcccctcgagagacagtcttactcggggcatgggaatttgacaggcatctgcaggtcccacgccttgggacagaacacacatgagtagaagcacttccttctccttgctctttgtctcaaggagctccccgcctggccaacccaggactgtgaggaagaatggtaaggcctggaccttgtgagggaggaggcaggaaccagaagggctggaaaagggcacaggacaggctgacaaacatggctttcttggaggctatctcttcaagcctccaagaggagctttcttggagacagctcttctctgccctattttcatcattttctataggggcaaagacacctggggaactgcacaaggaaaggagagttttcggctccagcttgagccactgggactttcctgcttggagaaggttgctgcaaggggtcctgtgtgtttcattgcctgtgagcctcatgcccaacatggaacctcctgcatggcgtgaacagtgcacatccaagcttcgacagcagcctctggggagggaattgagctacaacttgcactgtgaacacgccattctcctgggacaagaggccctcataaggagagagacctaggacaagagtgagccagacctcggccccagctgtgcggacacttgcctgaggaaaaccttaccaagcccccacccttctgtaaaattcagaagtcacagaagcttatccaagcaaagcccgcagagagctcagcacaccagagcctttaacactcaagcacagttttctgagaaagaaacacttcactgttaaatcacagcaacgtacttgttccttcattttttttctaaaaggacaggaaaaaaatgtacactcagtgagctgatgtagattctagttacagggcagtctggtttttgcttggtgagaaagccagctcaagtattggtcactgttgagaatatacgtgagacccttacctgttccgagtttgtgaggtcagccaccaccatgcccgtcacaatcaggcaggggtgactctggagagctccatctaggctccctgaacaaaaagagcaagctctcaggtctgcagcagattctgtgtgtcctatcaccagctccctacctcagtccacagacccgtctaatctgaccttgccaccttcatgaagacttaatcattcccatccccttatcagatgaatgggtgggcattattaattaaatatcctactgcttctgtgccctttcctgccttcttttctttgaattaaacttatttcttgaggagcttgaaaaaaaatatcttattcttatgaacttggtctggttggaagcatctagagcggctgtgatcaggtgtgtggggaaggacatctccaccgtgtaccagtgagagctagccaataggttcagcctcattcagaggcactgaaatatttctccatgacaccgtgggtttatttattgttgttgttaagttttatttagttttaactttgcttttcttttttatcaaagtattgcatattagtgcttaaaaataaaataatatggaagagtctatagtgaaaaacaacagtctcttccctctccttctaacccatctcacccccagatggagatgacttttcactctttttacactttctcctgatatataccatcctatatggtaaatcactaagcaaaatgcacatttcactgtttttaaatgaattttagtcttatttattgtctttttatgatagacaagaattcggaacacttaccttcctacctattctaccccctccatttatatgtggattttattctctatgtcagttacctttttacatttaaatactattacaagtttgttcatgttacattaactacagagaggagctcttaacttcccaatttgtaaactgagattagtcccccgccctttcctacaagtccctttcctgtccctaccacacagcaacttctgcatctttgtttttacttttacatcattgaggttgatggcatttacactctgtcctgtaatcataactaaaccttccttacttttccattggttgattctaaaagattaaaatcaataaatagcatttactttctcataactaagtgattatctttcatgatagagctaaggagtgccctgtgattgcaattctttttgtttcactttttgttttcctggagttttaaattgtttttgttttttacctgaaatatttaattttattacatcctctctctccttttttcaaatcctctcagctattctgttgcattgcccttttccccaagtctgtctctctgagtgccctccatagccctggtattgtctggactactttttccaacctctacactaaggccatcctgggacctccccacagtgctccctcatgttggggcaactgtttcctagatctcatagatcacgtgatttactccctcttttgtctggagtgcattctcttaatgatttactaagaaaggagtgcaggaagtaaattttctgaattcttgaatagctaaaaatgtctcttttttcacacatttgaaattttagctgtatgtagaattgtagtgtttttattaactctttattcgtcaaagctagagggtatagctccattgtttccagcattttgagatgctaaagataaacctcatgttggtctgtgatatggtttggctatgtccccacccaaatctcatcttgaattgtagtttccataatccccaagtgtcgtgggagggactttgtgggaggtaattgaatcatgggggcagttactcccatgctgttctcttgatagtgaatgagtgctcatttgatctgatggttttataaggggctttttcccctttgctgggcacttctccttgccaccatatgaagaaggatgggtttgctttcccttccaccatgattgtaagtttcctgaggcctctgcagccctgcagaactgtgagtcaattaaatttctttcctttataaattacccagtctcaggcagttctttacagcagtgtgagaatagacttctgataattgttcctctgcaaatcaccttttttctttccaaaagctttttgaattttgaaataatatatctatgtgtgtgttttcttttcacttatcaccgtttcatccatatactttcaatcgttcctcctgtttgaactgcatttctgagtctcatacgatgctttacctggagctctgagtccccatgattctctctgaggtttcagctctgcaagtgtccaggttgctgtgccctccagcctgactcatccctcatgacccttctatctactttctgtcttccagaaacatgaaatctctcagccctcccctgttgtctttattattgtacatatattttatttctttattatcattgcaattaggtttctggagggaaaacaaactaatgtgataaatctactaacttaagttggagacttccagtgttttcttaataaccatcttcttgtttaaaaagtaacctatgcagtatggaaaataataatcccttgtcattgcacatcacactacccgtaggtaactactgtgagaaatttgataaattatcctttgagatttcttttctggaaatgtatatttgttcttcatttatttgggtttttttaaaaaaatgattaagccattttcccaacaccatcgattgtggaagtcttcctttccctactgatttggaatgacatctttattaaatgtaaaattatcatacaaaccagtgtgcattaaaggtgcctgtccactactgatggttgcctcagtcagatgtcaggtggttccagaaatacgcttattattagcaactttaaaaaataaatcccctgtccctatgcttcctttttaaaaccacctatctatttcttcttatatgcgaacttcagaattattttatttgactctctactgaaaagaaattcattggtttgctattaaaattaaattcatttctttaaccaatattaagtatttaccatgtgtgaagccctatgtaaggtgctaaaaaatgtacaaatgaataaggtgggtatggtctctgccattatgaaggttaaatataataaattcagttctttccaaactgatcaccattttgaaaactttaccatgtcttttctcttattccagaaacataggtgtttctattccttttttctaaataatatccttccatttcatcatgtgtaatgctgctatgttttgtttttagccttctttttgcaatttactaaatgcttatgatcctacaaactatttgcccagtatttctttatattatttttatcacttaatttgaatttatcatcaaattgatagtagtttagaactagctatggatgaactgattttagagattacttttttttacatgttgagtttttaattttgagccattaattttgagttgccttcataagtcagtgtagaatatattcaagtaaaagataaggccgggcacagtggctcacccctgtaatcccagcactttgggaggctgaggctggcggatcagttgaagtcaggagtttgaggccaacttggccaacaaggcgaaaccccctctctactaaaaatacaaaaataagccgggcgtggtggcgcacacctgtaatctcagctattcgggagactgaggcaggacaatcgcttgaacccaggaagtggaggttgcagtgagctgagatcgtgccactgcactctagcctgggtgacagagtgagactctgcctcaaaaaaaaaaaaaaagtagaagatacactttaatacaaaaatatattggttgttaaaaaaacacattgaaatattaaacattaagtattagcaatagacagaaaggaggagaagcttcagatcagcctaaattttgatcctttgtcaaaacttatttccttattactagattattgtggaatttcggttttcccataactcaaaggttctagcacaacatatttagatgtttcattattttccctggaatgtgggaaatcccttttagtcttcacattcgggtcttttttcctacacagaagtttcgtcctctttgtctttggttatcgtgtctgtagccactctggtttctctgtagaagcactgctcttcccagccggtaggaaggctcatcttcttctttacacctccatgtcaccttcctctgccttgtgggagaacctcccacattttcctcaattttcctgacccaaatttttctaattttagttttagtttccttgcagccccctcatctccctttttgatcttatcttggacttttagaattctgttctctttatttttagtgtgacttccctttcctttattctgcaccatttgaccctcacagttccgcacctcaggaaggagaatgcctcccacacctgatacctggccacagacaaagggtgagagtcacctttgactctgtgttctgactttttaggtgctactgagctcttctccggtgtaaatctggaagacagtctaacccatgtgcatctggcatggatcgtctgggctgagttgacatttttttttctaccttcttaagaatttttctttgacattctatgtaaattagtacacatggaaaattacaatcttccttaacacccatttagcaaaggtttgactttccaaatctgtggctggtgtgagcccagcatttctgagggaagaatagtacagtggggaagagaaaaaccttttccttctgcgttctcatggctggggctgccctgttccctacagggaagaaactgggcaagaccttgtctggtttcaccagtgccatctgtgttgcagttagagattttcaacattcatttctaatggcattgtgacttttcatcatttctgtgtgtctctttagacatgataacacaaagttagtaaaggtctccctctgccggccaggcaccactgcttgctggagacctctgtctggagagtccacactcgatgtggtgtatggtgtgctgtttgtgagcaagtaaatgttttattttcccttccagcagcaaaagtgtgactacaaaccttatagagcaaaagaatgtccctttgtccaaagcgtcgctgcctcgcaaggtgcctaccttgtccccagaaagctgctagaacgccttcaagattgccctgttggtggtgatgcttcaccctcgtacaccgacttgatttttagaaaataactaaaatgtatttggggccaggcacagtggttcatgcttgtcatcccagcactttgggaggccaaggcaggtggatcacttgaggccaggagttcaagaccagcctgggtaacatggtgaaaccccgtctctactaaaaatacaaaaattagccgggcatggtagcaggcacctgtaatcccagctatttggtaggcggaggcatgagaatcacttgaacccaggaggcggaggttgcagtgagctgagatcacaccactgcactccagcctgggcaacagagcgagactccgtctaaaaaacataaaaaatcaagtgtatttggcaccaggtatagtcactgatgcaactcatggacttaggaaatgttgactagagatgagatgttgctatgcgggtcatgaggcaacatcaagctctcagggcaagtcggcacaaggggcccaaaagctttatgataaatggcaacaggattagaagaggcaaagaactgcccaaaatgtgagaatcacggcttccttacatagaggtggagcccttatggatgcatgtatgtaaaaagaaatcttattatataatctttataaattccattaatagtgtttattgttttgggtttttaaaaatatttcacactgtatttcatcaccataacatctctaagggtgccaccaggctttaaaaattcatattacacaaatgaagaaactgagggttgaagcaccgtatagaattaattgtagaaccaaggctttctcaggcctctgaggtgagccacattctgcccctcaacccagggatgagccacgaggcagagtgggtccacatttaactgtcctaatttttagtacaattatatttttcctcagtgcaacagcctcatattacaaactaagagaagggaggaaaggagggagggagggagggagaggaaaggaaggagggagggaggggaggggagggagggagggaaaaaagagatgatctagcactcactttatgtaactggtcattttacttggggctctgtattagtcagttctcacactgctaataaacacatacttgaggctgggcacggtggtccatgcctgtagtcccagcactttgggaggccgaggctggcagattacttgaggtcaggaacttgagaccagcctggccaacatggtgaaaccccatctctactaaaaacacaaaaattagccaggcatggtggcagacatctgtaatcccaactacttgggaggctgaggcatgagaatcgcttgaacctgggaggtacaggttgcagtgagccaagatattgtgccactgcactccagcctggggaatagagtgagactctgtctcaaaaaaataaaaataaaaataaataaataaaataaagacctacctgagactgggtaatttagaaagagagaggtttcatagactcagttctacatggctggggaggcctcacaatcatggtggaagacgaaagaagggcaaaggggtgtcttacctggtggcaggcaagagagcgtgtgcagggagactgccatttataaaaccatcagatctcgtgagaacttattccctaccatgggaacagcatgggggaaaccacccgcatgattcaattgtctacacctggccccgcccttgacatgtggggattattacaattcaaggtgagatttgccggggggacatggccaaaccatatcaggctctgagtaaagaaacagtgtggtggctacttctagaaaataacaaaccacaccagagtaacacatccttgcctccttctaaagccatgaagcaggcttgtccctgtgtgtccacgttttgtggccaagagctttaagcaggaacagtactgtgactccgcgggccatgtcactgctgttgatgctgcacaccccagccccctggttccatccagtggcactcagcctagtgacatttccagcacgatttgttctggaggcatcaagagaaagtttgcatccatctcattttcatttataacatttcacttccaaattaagaaatagaaaaactaagaatagtgtgtagtcatatttggcctagatgaagattatttgtacaaaagaacactataaaaagcagaaagaagcataggatgaatgaatgtttccaacaattgagaacaaaagcagcattcttcctaattagcatgaaggacatagagggaaaaaatagtcattccgggagaccttacattttctttcttgattgcatgcagacgaaatgtgtttgctgagagagtaagtgcagggtaccctgtggcttcgccactgcccccattgtggacatggaatcttgcaaccacaggccccatgtggctctcacacacgtcccatggtagggaataagttctcatgagatctgatggttttataaatggcagtttccctgcacacgcttcagcgtcctccagtgtggactcaaagaccagttacaacatcattaaaaaataaaagtgttctatgtaaagcaagggctaggcagagacgttgaattatatttaaggacaaaagtgacatatatttttttcttatgattgtaaataatgaccaaatcccatcattataaatgcctgtccctgcctttgggccatgaaacagcaaagcaggacctttgtagaatgttgctggcaggatgtgccacctgtcagtgccagggccaggatggagagcaggggggagggcatggtccctgtggacatgcaagccaggttctggggcaggccaggctctaggacgggccagtatggggagcagatggtgggaagaaaagcaaccatgtttcagacatcacagaaatggagcaggttgaaaggcacgagagctggattacagctgagcgcccctcctgtgttcacgggttatgtacctcctcaccaccccagtcctcaggaactccccatgaccacagtgggcagctgcagacctcccctcctggccatgcgccagcagccgcctgtcttaggccctcacctgcttgccgctgttccttctgtttgccacatggtcctgatttaggtcaagttattaagaaccttgattaacaagttttaattgtgggaaatgggggagatgtggcactggaatctcctggttaactgaggctccagccaaggcatctggctatagtcgtttctgttaaaataattattaagtgtagtgaggtcgctctctggctcgccaggaattgtctagtgaatgtactgctgtctttagtgataaaagatcttgtaagaccacaaagtaatcattctgaacagtagatctcattatagatagagaaggggtgaatgattgaacgcgcattagctggcttctagaacattctgggattcacctggggatggtctttttggggcattaattttctcaacactttcttcttcctcttaaatgtaaaattgtatttttttaatctggtttttggagggctctgggtgactggatgaattcccagaagccccggtacccctcgggctaagtagagagccgcacagagcctgtggtagtttcaggtttgggcagaatcaggcgcatgacccttaagatatcaaaccaagttcgcctgaagcccagagccatgaaccaatttccctaattagctagagagtgtccctgggtattttatctttaaggaggaggaattagagaatggagccttcaacagcccaggctgggatgcttctcaccctgtgtcgctctctggggcctcccgccagcccttttccggttctttctctgtcccgcctccccggacccctcgctgcccggtcaggtggttagttgtgcgtttgcctggtactgcggtgtgaaagtcaaggcatcagctggagagacgagacctcaaaacccacggagcagcccccacacccctcacccccagggcagccacacgcagtgacatgcaactcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgcagaacgtgtccatcctcaccctctgcgacgccaccacgggggtctgcacgaaggtacgcggggctgtgggggtggaggggagacgggtgaagaaccgatggtcagacgcgcccgaggtggcgccagagtcgtctcagccctcgggcctgggacttggggaccggccgcccagctgctgcggggagcccgcggcgcagagtcccggctccggcgtggctgccacctcgtggctggtgcaggcgctgccgcagacccgaccgaacccatccgtgaattgccagaggcgccccgtgcctggcacctggacgccgtccgcagttcactgagtgttgcttccctttatccgcgctcaccgctgtgacctaagtgagcgtcctcctcgttgcagctgatgctcagagaggaggggccctgcctttccccagaccccgccgacagcctcccccagcgggctccaggcgtgcgtccctccccacgtcctggtgaggccagccatgtttctaggagtctcaggccgactcagtgtgtagtgagagaaggtaaacgtaggggaaagaaaattaaaatgctcaaagagtgagcaaaggaaaaatgaagtgtaagagaggttgcccgggtggagcaggcaggcggcccacggcctcaccctcgccccatgggatgggcccccagaagcaggtcaccttgtggcgggttttgtagacatcaaataatatcgattaatacattcaggcaggcctttcagaaactcctttttgatcttaagtttctgtctcctggctgaggggggccaaggcttgcaggcatatttacttgagaggctcctaacacgacagctgtgcctgagatcctaagcacagtgattgtttctaaggtggtcagtcttgcctgaccttttatctaacctggggcggattccaggctattctgatgagcttgcttgaggggaaggaaggaacgtgaggacacaaagcaggcagctaaaaatggcttgtaatctccaacttctccatgcccctgagccttgagtgtcagtggcaaacactgcttcctgctataacccatgacagaggcctgctccaggggcccggaggtccagtctgcaccagcaccaggcccacagcgcctccaggtgacacatgtgtgctgcacagcttgagtttggtgtctggagttttgtttttcttttgtttgcacctttccatagaccactgtgagacccacttttcctctatgctttagcccctttgaaagggtttctggtccaccaggagtgttactcagtattccagaatgggatctggacacaatgtccaatgttctgactcagtgtaggctgaggttcactattagatggacacatgcccgggcagtgatgaccgccccctggtacacgtgccatcttcccccagagggttcttttccaccacgggtttgtccttgttgctagggatagtggcattttctaattcgaggacgcttgtgtttggctccgagccacgcacgagacaaagaggagagctcgggattgcctcctcccagagctgccgtggcagctgtgcaatgcttgtgcagcggccatgtaggtgaagccaaattgtttcctgcactgtcggtcacagacacaatacatgcaaaaaaaaaaaagaaaagaaaagaaaaaccctcttgtctaatgctctcatttcatttcagaaacacgaggatgaaagtgaggcctggctccacagacaggtaactactgcatgtccgggtccccactgtcacctccacctgatccaccccagggctggccctcagagcttcgacaacagcagaatggcttctcagagtaaatcacacagggctccccaggcagaaacagacggcgtgccggctccactcacggtgcctcccgttctccagggttgcccagagagctccaggagaatccaagttccagggagggtcgtgtgaaaatcacggctcttcagagcgtggaatgtttggtgagacctcagcttgcagttagatgccagcaccttgctgaattgaaaatgaacagtccatcaaaggtggcttaacataatctactatagtaaaagggtggaaaagtggtggatatccctgtttgttgccaggggtggttttgttggtgtctcatttggagtcacctcctctgtgattccgtaagacccgtcctcagggacataactgcaaaccatccctggagagtcttcatccctaactcagataaaggaacacacattaaaacagactctaggaacttgagaccaaaagagatcaggagaagcccaggtaaatcattctgagacaattttttctaaattaaacttgcacaaaaagtatcagtattttctttcttcaagcctttttgtctcattccacactctgacactaagaagaacaggtgaaaaagctttggaagcttcctgtctccttatccttcctaaggggatgaaaattgtcttaaagactctggaaaaagtcaagccagacttcagtctcatgaattatggtagagacacaggtatgcttcttcatcgatatggtggatcctatttatggaaaataactgaagctggacaaaactatcgccatggctctccaagaacattccagcactatagatgctgggctgctgcttctgcctgtggagtcaggaatataattatctcagaagtcagagcctcatcaacagacgggctgctccgaaatgtatcctgtttctgctctgtgtcaatcttattcacaagaggaatggttccacatggccactttcattttacatgtcccaatttgggtgccaagtccaagccaagaagatatcgggaagagggaagacttagggaaccctcaaacattagcatgctggaaagttcttgaatgccacctggaccaaacatataagcatataagcatacatatcaaaaatagtattgtgatgttcatctcacattagacaaattgtcagagagattacaataaaaggaacattttgtaaactccgttatctatatatcatgtgttcaaccaatatttatggatcttaccaggcaccatgctaggctgtggatttcaaaaaatgagtcggctactatcactgagcacacattgtggtgtgtgtcagaattttattccttcttatggctgaataatattccagaatatgtatgtagtatatatcctggaatattatacatatgtatgtgtgtgtgttatatgtatatatacatatatatacaatataatacatatactggaatattattcagccgtaagaagaactgaaatagtattccagtatattccagtttgtttgtctgttgatggacatttgggttctgtctaccttttggctgttgtgaaaagcacatctaataacagatacaaaaggctaccttattgtacaattccatctatataaaatatccagaataaataaactcatagacacagaaagctgatcagtggtgtcccaaggccgggggagtatggagaggaacagcttaatgaacaggggtttattttggggtggtggaaatgttttggaactagatagaggtggctgcacgtcattgtgaatggactaaatgccactcaattgttcacttttattagtacgttttcttttgtgttatgggaattttacctcaacgattttttaaaaaattaataagctagagcatgagctcttaaagatggtacatcctagacagggagatgagatgttcacgttacatccattgtgcaggctacgagggtgatcctcagacattcagaagcattgctgaagtattcgggtgttggtgggagtgggagccagaaaaagcgtggtggacatggagcaggaggccctatgccaggcccactttgtgtttgaacaggaggaggtgagggacgtgattctttgttgggggcagggaggctatgggaaagcaaggtggacatgcacactctgcttccctgtccccctcaagaggcattctcacagggggagctggcttcccagctggccacctgcagttctgccctctggatggacggcagagtgcatggtccctggaggcccatggggggccgtggttctgtcctccagcgctcacttcattagctctacagagtagctacagagccgaggtcgtcagcaggactttcctgtattagcgattgtgtgtctcatcgcccatatgagaacagctactaaagtgtggggtaagacagcctgaatgggattccagaaaccagatccttccaagcagaatccagtcaacacttaaaaggtggcatgaattaaaataattcttactgttttcaaatgtaaagtttaaagcatttactaagcacacagctaaatttttaaaatagctgcttaaacgtatgcaatgctgccatgagttggaaacataaggttctgtgacaggtgtgttttcctgggatggagcgtccctgggtcaggtcagcccatcagctgcagttgtgattgtgacactgggttggggcatcccgcccatggcagcagttgggaggccaggatgtctctgaagaccctacaggttgtgagtctgcacctgtgaagattgcagctccatggtctgcaggaagatttaatttcaaacagtttcttatgacattgtttttttcgtaaaggaattcatggaccctatttttcaaaaacaatctgtagtgtttctgcatccctcgagttactgtgatatcctggagaacaacttagtaactttttaagactgaacctgccacctgctgccagcgaagccattggctgctgcttcagacagagcctaagggggttttcctgggagggctgcaggcatgagtgagggagacacatggaggccacatgccctctacccatccatctccaatgggtcacagaagcttgccccagctggcccaggagaaactggcatctggaaggtcctgcagacctcagggagacccggcctgcttaggtccaccgatcttccaaggacccggtgcaagaacagaggtgagttgtagcgagcctgctaattttgtgtcatctgagctgttcatctgagccgttcatcctcctctcttctcttcccaactccttcctggaatcctcagtacggtcacccgcagagattccccatgagccaaacagaagaggaaaatgcatgtgtggagacccaccaagttccctctcctctaggaatattccagagaagcaggcaatcccccctgccacatacacaccctgtcactgctgcgctgaccctgcagagtcagtcctgatgcagacccatgaggatcctctgccagaaccatctgcatttgccatagaaccccagagcctattgttttggttgaaggatcggttccatggatccatttctgactgtctttattcttttatcggaattttggttttgtgatttcaaaatttgggctggaaggggggttggacaaaattattatatctgaaccatgggaaaaaaacactggcaaaaatgctacaaataactcacaaagaagctctcatgagtcaaaagggctccttcttcacagatctgctgagtggagttgaggaaaccaggcattgtgtgtgataaattctgttatccagagagactagaaacgcttcccccaaaatcaaatgagagacagaaccaggataaaatccaggtcccctggtcaacaatcattgcactttgtcactaaaaatacatttaccacatgagaaaccgggtctcagagagactcagaggcttcacctgtgttccgaggaatgtttccctgacaaggtagagatgacatcacaacggtggaggccttcttattataaaaacaatgcttctggccagaattaattatttattacatttatttagagtatctttgtctgccaaacgtgcaaacatttcccccagaaaactgaaggaatatagcgctacccgccgcacagttggcaaatagaagtgcattttaaaagccaaattaaccgctggtttttccatttcctctgcttttaaataccatgcttccaactctaaataggaaaataaatgtttgcagattaaaggttccattttattgcaaatattcatgaagattaaatgtcattttaatcacatgttagtttatttctctgggcatatcatatctgcatgggttcactcactgtagggaaatgagttttgcttgtgccagctggggtttatttaccattagttctcatccccgcattcgtgtgaagctccttgagtcagaaaatacatctcgcaaccaactaattggtgttcacggatggaaactttcaaacttgggcttcagagaggccaaggtaccgcggtagcaaaatcctttttcgcccatcaaagcaacagccaccctgtgggctggtggaaggctgaggccgctggctgttcactgtccggggaccaggcagagatggtggcgacacctgccctaaatccagcctggaacccttcccccagggaaaactgggcatgctgattctgtttccagggaaaagagacagtagatccaagcaagtgttgtcatccagtgtggcccgaggtggagcgtgtccctgggactgctgtcccctcccacctgtgttttagaacccgtggcatttgtccttgtgtttattttctttttttcttgccttcttgatgggctattcagtgtgagatcaattgtattcaataagaagaaaagacaggattgaaagaatagattttgcttttaggcaaaatctggtttgggattgttgagaattatgtttttttctgatatataataaatgccactggagaaatctcacaatacactctggtttcaatgggcaataattcaaggaggaagcacctccttttgagttttgagagcagagttcctgttctcactggtgagcttggcgtgcacatggggctgggctttgtctcggtgctgtgtagactgagggatgcctttttatttgccactgccggggctgtagcctcttaattcctccatcttcttcttttagaaaacgtaacagttgactcatgattcccgaggaaagtgacggcctcatcaagcacttattatttcaactgttcctctccttagaaatcacatagaaaatgtatctcggggtgtattttatcctggttcaacctcttcagaataaatgatgttttagttgtggtttcatccgtggcctttgtccacagaatgaagaacctgtgttctccaaggatggccgaaagtttttcttcatcagagccatcccccagggaggacgagggaaattctatcacatcacggtgtcctcgtcccaggtaagtcctgctagtttccggagctgaactagaaactggcctgctagaggccgtggggtgacagcctctagggctgggcacacttgcgttttcgaggaccccaaggaatctgaaggtggttcccgaaggcagggcagggcatggcgctggtgagtgcagaggttcccatcaggcctggtggaaccttgctctatctggtcacgtgcgagaatgtgaatgacgcttctgccaaggtcagcagagaccctggggtcccctgttcagtgtaaggccaaggatgttggaggactgtctgtgccgggggccctttccttctccctctgctgagggtctccttaacatactccccgctgaggcatggctccatgcactcaacatccctcaggggtccagcctcccatgctgccctacctccacccggagttggatgcaggtattattttattatgtgaccgctaccagccatcactcactggttctggggtctggcgagttcggaatggagcatccctgagtagggaatctcagagattaatatacgtgaatctaggatcaaaagtagacatctcggggtcaccatctcctgaagaggtcacctcagggagcctcacgcctgcaggacggggctgccatggtgttgactttgggggactctgccctgaggaagaagggaagcatgatcttggatctcctcagttttggaggcagtctaaagttatttgggatcagggtaaatgaatgaaatttgattagagaaaatgttaatcacaaatattctatggctatgacatagaaggctcatatttatgatgaggcctcaaaggcaatttcaaaagaaaatccaagaacatccgcactaagagcagctctgatggaatcagggtgggggctgcgggacccctgggatggaatcggggtgggggctgcgggactcctgggatggaaatggcgtctcttggaggttcaggtgcaattttttctcagtgcacttcatgacacgattgatagaatgtctgcaagctgttgcctttgctttttcctgcggtcttcattctaccatccaaattcttttgtttattattttacatcacttatatcaagattttaaaatgctggccaggtgcggtggctcacgcctgtaatcccagcactttgggaggccaaggcaggtggattacctgagatcaggagttcaagaccagtggccaacatggcgaaacaaaaattagctgggcatggtggcacctgcctgtagtcccagctacttgggagactgaagtaggagaattgcttgaacccgggaggcggaggctgcagtaagctgagatcgtgccactgcactccagcctgggtgacagagtgagacactgtctcaaaaaaaaaaaaaaaaaagatttataaatgcttcagtgttttcatttggctcccagtcttgtatttatccaagttgccatcatttgcccggagccctatcaaacattccagcaggaagcaggtctcctgcactgcccatgaggcaccacctcctgcaggttcccaggaacccctcggggggcccccagggccttccctttcaaaacctgcttcaaactccccagcctctcctacacgctgtctgcgcccccaggccctgctgccccccaacccccatgttcgagtctgcagcccacagagtgtgtgccttgggccctccacctagtttaatctccacctgctctgcgcccacctcccagggcatctgccttccagaacagctgcccatttcaaatccccactgaaacatcgctcccgcctagatggccctgtctctctcttctgttaccattggtcgttaccattgtctgttaccattcttcttagctcaaggggaacatagggaaagacaatgcgtgcaaaacttgtagtgtggcaatacaggtccaaactgtccttgtcagtggcagcagggagcgccctttctccctccgtttattcttctctctttttccctccacctcccggcatttgtctctttcctccctcactggtcccccttcagtaatggctccattaattagatttacaaatgaaaaaggcctataaagcattgattctcctcctgagatgcttccatcatggttggaggccaggtccaagtgattcgcgtcaccaaagaggacagggcactgttcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagatgtgagtgagaaccaggggcctgccccatcttactggccaatggggcacatttgttattttttgtcaattacacttatggagtacaggagcacaggaggcctcctctttcctcctcaggcagcatcactgactcctagtttcttcatgaaaatgtatagtagattcccgtcccaacagtccgacttccagagctgcggcgtcctgaggacgcaattaggcttgcagccagcccatgaagggaagcacgctagcggcagtagtaggggtagtactgatgttgattgagtttttactagtccaggctctaagccaagtgctttacagacattatctcattgaatacaacagttccatgaggtgagtttactgctttccccattttaaaaataagtaaatgaaaacaaaaataagtaatttgctccaggttattcagttggtagcgggtagatttggctcagatgaggggagcccagttcggaggactttaccaccatacaatttcacctccctgctcctggggtaaaagccaaggtttctgcattgggaggtcttaggtgaaaatgagtcaacaactatttattgggccaggctatatgtctgaacttgtcttaaatgtgctcagctccttgcccttcagaaggtgagtgatcttgtaaaagatttccacatccacattcaggtgtgtgtcacccccaaccacagtaccctctggccacgaagcagaggccagtgcagggggcacccggagccagtggaatctgcactggtgtccctcagcccttaggtgtctggccaccccctgctctggtcacaggtgtagctggacctgaacaggggagctactccctgcaggccatgggcggcagtccctgaggagtgtccatagaggtagtgccaggaatgtgaagtgcagacgtgccttggagcaaactaaccctgtgcaccttggtgatctttgcagctacttcctgagcacggaggacctgcctcggagacgacaactctacaggtaactcctgctccccctgcacacagggctctcccccttaggagggcatccaggctttgcagaattgcaccttttcagcagttcggaaagggcggcagcaaagacagaccccaccacagaggagtagctgtagagtctggagagaagtaatgaaacttgcagaggccaccaaaggggtagttttgagacttttgaagctttatttttctgctgttgttgacttgggttttccctgtcacccacttgcctctttggctaacggatggactttaacccgtctttccttttcacttctattcaatgtcacctcggaggaattctgccccccctgccccaccacagattttttgtagggagcagagtgtgatttggaaacaaacccgtgggtcagcacgaggaggccggccctgctgtccggcattgtagctcactggctttggggaactctgccctgaggaagacagggagcatgatctcgaagctcctcagtttggaagcagtctaaagttatttgggatcagggtaggtaaatgaaatttgattagaaaaaaaaggttaatcacaaatattctatagctataaagtagaaggctaatatttatgatgaggccctaaaggcaatttcccttctcaacagcccaactgtgcgactttggacaagtttccaaatctcaaagagggcagggaccctgtgttctgaaccctggagggggactggttttttttctagggcgtgtccctcttctacatttagtcctgtcatctgcccagtcactgttctcactaaaggaggctttgggttgtgaagtgagattagccctgggcactttctaccagggccacagaggtgaggagggggtgtctgctgcctcccccgtgcctctgcatgggatggctgcagccagttacacctaaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcccagccatcggccgctatgcggacaggatgaggtcagcatgagggagccagtccgtgtagatgttccatcgtcaccatgtgtctactaggaaaattgaaatacacatgtcaccaattaataaacatgagaggctgcctgtggcccctgtcctctaaattacagaatgagaaggttgtcttctctctcccgtgaaatatctttgctcctggaacaacagacttcatattgaaacctatggttagaggggaccctcctgcggcaaaatgttcagataagaacttcttccaggtagatccggtatcttaggatctttccattttagggagcacattttaggccttcttgacttgaaatgacacttgaccacagtggtcccaggtaacatcttcaagccagttcccacttgtgtagctccgttgagtgggaagcgcgagctctcgaggtttcactctgtcaggggatgtggcttttggaagctgccagagttcaattccactggtgctgctggagcccctgcctgctcacatgccagcgtttggaacccagataatttgaagatatgtcactctgtctactgttctcagattgctagccatccactcagagggacaggacacgtgcagatagagtgctagatcatataacactgacagctccatgctcctcacaccaggccacctgcagagcctggagaaggcagcataggtgactgccttccagccctcccacaagcaaggatgctgaaagctcttgagagtgggagggacccaccagcaaaggaaggtggaaatggagctgggtggtctcaggggctccagcagggagacagagggagaggcccggggggtctgtagcagggctccgcagatcaccctcatggggagagcccaccagcttgcggcacccagcgtggagggcagctcctctccgcccacattcacacctgcgtcctttgctcttccagtgccaacacggtgggcaacttcaacaggcagtgcctctcctgtgacctggttgagaactgcacctacttcagcgcttccttcagccatagcatggacttcttcctgctcaagtgcgaaggtcagctcctgccaccccgtcagggcaaagagccctggcaggcacatttgcagggagggggtgggcacacttgcagggagggggcagcggctgtggtgggagcacagcgtattccagaacaggtgaggatcccgcctacctgataacattgcttatggtgcaagatgactggacccccacagagcctggtgcagtggggctactttacgtttcatacaggtgtacagcttatcagagtgttctgtgcacactgtgccagtaatctctcagtttgtctcccattgtccacaaaaaataatagtcccatgagctaggaagggcaaatatcctacacagtgatgagccaaagccatcaatccatcaataaagataggaaaacaatttcaaagattaacttttcaatcatatttaaggatgattgaatatcaccaggcacggtggctcacgcttgtaatcccagcgctttgggaggccaaggtgggcagattcacctgaggtcaggagttcgagacctgcctggctaacatggcgaaatcccgtctctactaaaaatacaaaaattagccgggcctggtggtgaatgcctgtaatctcagctactagggaggctgaggcagaagaattgcttgaacccaggaggtggaggttgcagtgagctgagatcgcaccactacactccagcctgggcaacagagtgagactccatctcaaatgactagataagaaaaaaaggattgaggttatgttaaagaagtctcagaaaaatatttccctatgtcccaattcattgataatttatcccaaactgcaagagtttgatcacaccaaccagcatacacaaaagagtaggccatgttgcatatgggatacaaaggatatttttgctgcttgtctgtatcttggaaagatatgatatgaacccatggaaaggtaagtcatcctaaatatggtcgtaacaaaatatgatctcctgcgatgacctcaaagaatgaaaatatgccacaggcagagactaagatcaggagcaatttgctcctctgtcagagtttcaatcccctaagccataggtggagaatgaataacttttatcagagcaatgtctttgctagcctttgctagctactagagagctcatgacttcatgacttcgttctctttttatcagtgtcatctaaaatcttgaaaatccgcagaacagggacactcagcctcttgctcaacacaagctcagcccctgacattcttctaagacagcaaggagaccacggagggatgaggggggtgcgactgaaatataacattagtgccccagtccccgcaacgttaatggtaccaaattcctctttcctgtgtgtcccaagaaggaggccaccaagtatctgaaatcatagagtgctgtaggggaaagaacctaagatctaactgacccacttcatgtatcagatggcaaaccctaagccagaagttgagtggattccctgactcccaatgagccagtgacacagagagggccagcatcaaggtctcccagttcctagcccagtgacatctgtctcctagggcgggatcttcttgaaataagaacttgggaaattacagggattgacggggcatagggattgggaaaatgtggcaagcagacccactaggagccagagagtcttttgaggagctacataatcagaatccacaatcctgtctcagaagcaggaggcagcttcagcacacaggaggtcatgatcaaacacagaagtgaaaaattgaagtagatttcaagaagagtgccccaagcaacaaaggttgaatgagaaaggtgacagagcctccatcgtggagatcctgagtcagggacagaggtcatttgccagaggggcttggtctggcctaggcaggaggcagagcctttgggatctgaggtctgcactggtcaagacagcaactttatggatttgtatttcccaaattcttactataaccagcaagaagggtctggcttctcaccgttcatggaaagaagtcaaaataataatgagttgtgatatgaaggagtgatatttctttattacctatgccaccaaggggaagagcagaaagcaattccactcttcaatttgtggagcaaatacagggtttctttttttaaaaaaaaaaaagaagaagaagggtttggaatggggaagagcttggggggttaggaggtgccaaggagtgtgactggctgtggtggcccctctttaattattgtcccatttgatgaaggagctggcaccattgtggatcccaccaggttatcagttaatcacagtcagccttgtagtcactcttcagccatgagcgggtttcatccttgaagtaatcttttgttaaagaaagaattctggaggtatctgggtcctatcaggagctgactcctggaggttttaaggaaatacatgaccagataagaaagcatggtgtgtgctccacaagcatccgggttaataaatgtgcataaggcatgagagcatagaatgggaaaagaaagggagtggaggcgacagcacattctgaggctgtgtttcaagatgaaaggtaacacatacgcagcttgtctcaaagttgtatcttgagacagggagcagacagaagaggagaggagaaagaaaaaaagtttaaatcgtggtttgaggctgagctgctcggtcatattcctaacacatactaacatctgctccacatggtgaccctcccagaatccagaatccaacagcttatttgttgttgttgttgttgtttgagatggagtcttgctctgccgcccaggctggagtgcactagtgccatctcagctcactgcaacctctgcctcccggtttcaagcgattctcctgcctcagcctcccaagtagctgggattacatggatacataatttttgtatttttagtaaagacagggttttgccatgttggccaggctggtctcacactcctggtctcaaatgttccacctgccttggcctcccaaagtgctgggattacagacaaaagccacctcacctggcccttacttaacaaacactttcgctgcttccctttggaggtcacagctccctgctaagttcaagctcaagttcagtctggatgcctcattctgacaactggaagccttttatggttcagtttccataagctgcagccctgggttgaaatccaaaaggctctcccaggagatccatggccatggatttaggcagggaagttccagttcccacatggtggatgtaaacatggagcccgtggtagatagaaacacagcctggtgttgggaggctgcttggacagagtgttaaagtttagagagcactatagggtggctcctgtgcggatttctagtctgccactggccttctgtcccaagggagattcgtatttctttttatgtttatgtatttgcaaggcttgtgttgtggtctgcaaatagttattgtgaagagatgactccatagttgatacctgggaggaaaacagaagcaaagaacaagtacagcaacacaaggtcagacacacgactgacccagcccccaggtacagccacactgggtcacacacacatgactgacccggaccccaggtacagccacactgggtcacacacacgactgacccagtccccaagtacagccacactgggtcacacacacacaactaacctggcccattgggcacctccacaatctcaccttcagaaaggatgggatgctcctcctgccaatgcctggatccctataataatcaaacagattcctagaatttgaagataggaatagatctcagagcatctaatccagtctccaccctgcctttcttttgttgattcagaaactgaactcttagtcattatgaaattatcacgctagggtttcctgaatcatttaagatctatttaaatatttagcctgttgcctcatcttaaggtagacataaactagccctcttctctacaaaattgctctttaaagtgtttacataataagctattttctggctaaagtaacttttgaatgcccaaattaaactctccccatggaggtaaccaaaatcccacttataaaaagagattttctgaaaaggtttaaatttacaaagacaacaaagtacatggggagacaggagcagccaactgtttgaacctggaagcagttaccagtgataactgacctggcagaccctgaagctgagcctcgtcctgccatggggaaagctgagcaggcattggcgatgattgcctaagggatgagaagatcaattgctatgaaatcttaaaggagaaagtgattatacccatttggattgcttggggcattttgctggaggagaagactcaaggaaggtgtcaatgatgaggtggcatttaaaacaaatgagtaggtaggatttggaatgggaaaaagcagtccaagtggaaggtacaccctgagaaaaagcacaagaaatgttgtaagattatgcaatggaatcttttgcagcatgtgaatcaggatcaagtgaatacaagcaacctgatttaataaacaaagataatttaaaataattttatttttctccacgtttctcagtagatattaaaatggacccagatgtgtagtctagagcaacgtttagtcaatgctcatgtcctgtcctgtttccttcacaccccaagttattctgagagattcttggaaacctgtgacaaaaataacgtctccactcctagcattagagactcttgttttcttctccttccctcctcctgcagcattttgttatataaattaacttagtcttctagttgcaaccagaaccaaaaaaatcctccttttttaggttgaggataaatgtactggcaatgagaggcttctctatggtaaaatctgtaaacatgcccacattcaaagctgttcatcccgtcacacagggagggaagtgtaagtagttcaggttgtctgggcataggaagggatgatcatcaaaggatttaacaactaggacaaggtggataccaaccagccaaaagacatgtccctgagagcagatataggctatcaaaccacattaggacataagggctgggtataaaatcatgaaattataactgtttcatatagacttcaacattcttcctgcctttctgtgggccttccattaggacagtttttggtaagtttagctgatattgacctatcctgtaacttatattcagtattataacttatattcagcaatataactttattgtcttagtccatttgggctgctatagtgaagttctatagactgtgtggcttataaacaacagaaaattatttctcacagttctggaagctggaaatccaagaccagggtaccagcatggttgattctggtaagggccctcttctgggtcacagatgaccagtttctccttgtatcctcatgtggtgggaaagagggtgacagagctctctggggcctcattataagtgcactaatgccattcccaagggttccactcttgggacctaatcacctctcaaaggccccacctcttaataccatcacgttggaggttaggacttaatgtataaatgtgggggggacataaacactcagtccattgtaatcatagctgattgtagctcatcagttgtttgcaaacagtatttctatttcgttagtcctttggcatactgatcttctcctaatgttcagtttttcttccacagtgtattttgtccaacatcattatagagttccatctagcagtatcaatgtgtgctttctctaatttttcattaacatttcttcagcggcttctcaatatttgacatttgtatgcttatatgtttatgttttatgtttataattcttaattccttaaaattttttattgtacatacaaacctaaaaattatttttaggttaataataattactattaacttaaataataattattttaggttaattcctcaattttttttttttgagacagagtctcgctctgttgcccaggctagagtacagtggcatgatcttggctcattgcaagctctgcctcctggtttcacgccattctcctgcctcagcctcctgagtagctgggactacaggtgcccgccacaatgcccagctaatttttttttgtatttttattagagacgggttttcactgtgttagccaggatggtctcaatctcctgaccttgtgatctgcccacctcggcctcccaaagtgctgggattacaggcatgagccaccgtgcctggccaattccttaatttttgattgtacatacaaacccataaattatttttctactttgcacagttacattaaaaatatattcgaatacaatatataaatagaggttcagaaatgcttatagccactatatccactcactacctcactggatcccatctctgagtgtcaatatttatatctaaaggacatgggtttcagatgacccctggatacttgtgcgagggatcagctgtaagccaaactcagtggaacattgtggaaactcacctatctatgtaatacagagagtttctgtccacctctctattgtctggaagtgaagccagctatattctaaatattgtattatgatgtaaccttttatgatgattttccagaatataccaagcagcttttggcatacatacttaattggtcttctcaatgaccctgtgaaatgggtagtaaaagaaataatcttctatttgttaagttctttacaatttgaaaagcacatttcttttttttttttttttttttgagatggagttttgttcttgtcacccaggctggagtgcaatgacacaatctgggctcactgcaacctccgcctcccaggttcaagcaattctcctgcctcagcctcttgagtagctgggattacaagcgccaaccaccacacccagctaatttttgtatttttagtagagacggggttttgcaatgttggttaggtgggtcttgagctcttgacctcaggtgatccacctgcctcggcctcccaaagtactgggattacaggctttgagccacggtgcctggcctgaaaagtacatttctaattacattataacagttgatgactatgttcccatttctgattccttgaaatttatattctagcgtaaatatatctacttagaattccctaaactcaatatcatttttcacatttccatgcttttgtctttgactacctgataaacccctatacattctccaagactttcagggcagggttgattttcatccccttacaggagggatgaatgagaagtcagagaacatgaaagtggctgtgtattcacccgcagaccaacgcctgtgacaggaactcagtcttcagctgtcttagatgactggggatgcccaggacaggggaaggctgggtggtctcaccttctagtcctggataaacccaattccatctttaaagaaaaaaagcactcacctcctggactcatcttctaggacagctaacaaattaccgcaatctggatggtttaaaccaacagaaatttagtctctcacagttctggaggccggaaatccaaaatcaagctgttagccagtgtggtttctcttggaggctgtgagggagaatctgttccacgtttctctcgagcttctggtggttgccagcagtccttggcattttttgacttaccaatgtattgctttcatctttgccttcatcttcatgtggtcttccccctctgtctctgcatccaaatttcccacttcttatgtggatgccaatcattggatgaggacccacctaatccagcgtagcttcatcttaacttgactacacctgcaaagacctcgtttccaaataaggtcacattcacaggaaccgagggtcaggacttcagtgtaacttttggggggacaccattaattaaacccacaacacttcccttctaaggactgcattgccttcttatataagaaagaaagagtgctcagcttgttcttctcaggaacacaaaattaagggcagccacactagactgtgccagagacagttcttaatggtttcactgcattctggaagcagcaagggggtcactgaaggaagtaatgtgatactaccatatctttggatagcaactctagcatattagaggaagaagagcagttccagtatagattctctctaggaatacttcttccctgtcataatgcaaaattcacagtcaagtggcatacagccataacaagttctgtagggttttctcctacccatctaaattcaaccgccagagccactgaacaacagaatcgaagtgcccaatttacataatttgtgtttcacagtcctcgcctctgttgagagaactggatttttctcttcaaaatgaatctcaagagtatgatttattttccttcaagtttttgaaaacgactcaatcaatcctgtttctaagaaatgtccaaatgccaccaggaaagtgagttccgtgtatgaattggccatttggtgcttcctactgaaacattttttgtatgtttaaaaatagctaaataaacttccttctcctgaagccgaggatggaattattgcagtcacttgctgctctgagtgggaacgggacagtctgtgttcatgaatcccttacagctctgggctctcacccccgcccctttcagtgttgagccatgattagggagctactttccagactttaagaagtttggtcttagacttagcagattggtttatcaagacaggcttctccttctccaagttgagtggaaccaaagtattattacctgagcctaaaatacagtgactcaaatctgataactattcttcttactattaaatattccccaagatcttctgtcatcaccatcattgccatcattatcaaaatcacaggagattgaaatggcagtaagggaggtctatggagtatggaaccgtagagctgggttcaaacctggactctgccacctacagcttcgcgaccttgggcatcttggttaaccttgcttaatcctccacaccctcatcctgaaaatcggaggaataacagtatggcagtccccccttatccacagttctagtttttgaggtttcagttacctagagtcaactatgctctgaaaatattataaacaataagatattttgagagagagagacaccacattcataataacttttattacagtatattgttataatagtttgatttcattattagttattgttctcttactatgcctaatttataaatgaaactttataattaggtatgtaggcacagaaaaaacattatatatatggggttcaatactatcattggtttcagacatccactggggtctgggaacatgtccctggtggatatggggcaccactgtacctgtcctgtgaggctgttttgaagattaacctagatagtgcatgtagagtacttaccatggcatctgatacatagtgagtgtttaataataagtgttaactatcataattgttttcatcattgtcatcaccttagtaatcaattgagtttcttacacatccacttgctacccactcagtatccaaaagttggggccaaggctgggggtggctgacgtgcatgaagtcaatgaagcagcatcccttcccacatgttagtgggcactccagcacctcagcaggcttaggttggaacccctggatcttgcacttacactagcaaattccagaagcggccatggatgccagagccacaaaacattaaatcaactgtcaggcatggcaatgagtacctggtggcttccagagtgcatgtgtccaccgtggtcctcacagttggttcctggcagaagttaagaagtaaatttccagctttcttagcacctgcccgttccttctgctgtgacctttcccctccatgccttcaggtgcccggagctcccagatgcccctcctacatcctctcgctgcaaaacataattaaccaggggaaatgtccacgaaggtgccattaaggtgtcctgcaaatatgtatactaaggtgcttgttattcttccccaggttttagtcagagcagtgagtaaggcagggatgaaaaacaggaatcagccaaccagctccacttgttgggaaggcactggctgcagtgctatggatgagaagggttctgaggccaagtgcaggttcagcaggaaagaacatcatgagtgattaacggatgatgtcatgaaagtcgtaagcgattgatggatgacgtcacaaaagtcatgatgtcattaacatcatgagtgatttatgatgtcatgaacattatgagtgattgatatatgatgtcatgaacatcatgagtgagtgattaatatgagcaacttcaagagtaattgatgaatgatgtcatgagggtcatgagtgatgatataatgaaacatgagtgagtgactaatgtcaggcacatcatgagtgatcgatgttacgaatatcatgagtgatcgattgatgatgtcatgaacatcatgagtgaatgattaatgtcataaatgtcacaagtaactgatgtcatgaatgtcctgagtgattaatgacatgagcatcatgagtgattgatgccatggatgtcatgagtgattgaagggtgatgtcatgaatgtcctcagtgattgatggatgatgtcatgaatgtcctgagtgattaatgacatgagcatcatgagtgattgatgggtgatgtcatgaatgtcctgagtgattgatggatgatgtcatgaatgtcctgattgattagtgatgtgtgtcacccacagtcatgggggagcaggtggcagccacatgccatgcatctatgatgtttggtgtaatcccctgaaatgaatgaacacctccacatggtgagacttcagattccatattatccaagatgacatacatttggaagtttgagatttatcctaaaactcaccttgtactgcagaatgaggtgaaggggcttatttttttaagggcctagactcctgaagcattatggccagccaaaatagaagtgacagcatgtcacttcagagaagagaaaagggcatgcatgaagagacgcagattgagactcggttacctgaagggatggaaatggctgtcatggaaactctcctgagggaggctgttgcccagggtttctaactgaagggcacctcttctgtcatacatcttttgaatgagggagaagaaatctccagatccttccagagtggctcaggggtgatactgattcacaccccttcagagtgctggatcaacagtgtaagcaggcatgccctttgcatgatcccaacataggaattaaatattctactgctggtcaaattatttgctaataactcatgcctaaccgtaaatgagtagtcccagagctagaaaaataatacatagtttgcgtcttcattgataaaactgtcttattagcctcaaacatgtagggtgctattgactcccaacagcaaatttgaaaacaaatggtttggttctacaaactagttaatcctctagacatctcttatatcaaaatttccaagaaatttacctcagctgccctttttaattttgaatttatccaagtgaatgtttagaaccggtttgaagctccttggagcattgctggtgtgtttgtaagaacatctgttcagtctctcaaacatttggagccattccctttgaggctgcatgaaccaagaacaaggaaagggattctcaaggcaggttatattgttaatgtaagtgacatgaatactctggaacatgtcacactcttcagtaaatgctaccagacaccacgcaaaccactcatattcctcctcagtaacaaccaaacaaacatcttccatggaaaagaagcttctcactttgccactcaacacctttcccattcctgggcagtggcaggtatgctgaacctggtacgagtgtgcctttctacatcagaggccatgtcctgcagtctttcatctgaaatgtccattaaaaataaataatgggctgggcatggtgactcacgcctgtaatgccagcattttggaaggccgaggcagacaaatcacctgaggtcaggaattcaagaccagcctggccaatatggtgaaaccctgtctctactaaaaatacaaaaattagctggacgtgatggcacgtgcctttaattccagctactcaggaggctgagacaggagaatcacttgaacccgggaagcagaggttgcagtgagctgagatcatgccattgccctccagcgtgggcaacaagagtgaaactctgtctcaataaataaataaattaattaattaattaattcaactcaataaataatgactctagaatgtgtccattccttttatccttgttgccccagctctgggtaataaaagccattttgttactggtcagttttcctgtgagatttcccactagccagttcaccttgcttctgcctgaatatgaccagatggtatttcctaaagaatatctctcttcaaaatggcttccagagcacatacatttctcttttttctaagtaaaatgatagaagaaataaaacaaaaacaaaaacaaaaacaatgccactgggccactaggaaggggccccaatggactaaaatgttgaagaatttttgtaaagtaaacataaatggttcactgttaaagtgaaagccagacacaagggaatgtaacataattggcaaaagacatgattataaaatgaagaccaaaaagaagtttgtttttttagaattctgaattgtggagcacctgtcagagtagatgctgccgcctcccatttttgcccctaagacaaaaggagacttggccagggagacttccagagtggacggtggggctggaaggggagctgtgccgcaggtggccacaaagccaaggccccaagcactgcaagaggccccctcatcccttcatcactgccctgtctccacctggcatcagaatccgcattcacggagggagtggctctatggctgctgaagccatgtgtccacagcctgggccccacctggacgagagtatagccaacagggcaccactgcagcacacgggacacgcgaaagggaggcctcagaccgagcgcctgggaaggaaatccctggagaagcattttaaagatcttgtccatctgctgcagccagaccgactgtaaatatcctccgagagattccagaaggcgtcacctttaccacacagagcggtaaagagtgggctgctgtgaaaatgaaggaagctgactgctcaagacttacaatatttacaaaacaaatttttgtaattcagaagaagaactgaataggtaaagtagtcaaataccccagttgcccccaaaagcctggatcacgctgacgtaaatgaatacggcttcttaattatttctagtgcttcttcccttcacttcctgaagtgttcttgtttggtcaaaattatgaacagaacaacaccagaaagtgccctagaaaatacaaccaaaaggcttcccagaggacccaagaactggacaaagatgaacattcaaacacttttgagagctatgaaaaatagatccaacgaatgtaatctcttggtagaggctttagaaggagagattggggagaaggaagggggaagaaataaatcaagatatgatggaaaaaaactttccccatgcttttgagtcgttagggaaaagaaacctaatgagtgtaattctaagaattttggagaagatctaacgatacatacctcctaataaaacttgacaattcaagtttagaaattatataagattacaggcagggctcagtggctcatacctgttaactgaaccaactaattaaatatagactggccccatgaaacgtgttcttcatgtttactgaaagcatattcttaaggccggtgttggggatgcccttctggctactgtacttcaagatgttctctgcagagggtcatttggaataaattttcctctggtctcaacaccaggaatggttgagcttctcataacctatctaatgggctgtgaattgtgtttccctaaactgtgttggctgctagagagcttagcatgaaatgtgtggcatatgtgggtaggtctttatagcacacatttttaatctttttcctgatgtcttttcttttttctttttacattgttctgatagcctcacttactcattttaagcttattttatttttatctgtgcattcatatcatccttatctgccttcagtcctttttgccactagatccaacatggatagacagataatagatgagagggaaatgactgaccgattgattggcaggtaggaaaattaaagtactcttagcctagcattcaaggctgcatacaatctggccacatcctacttatccagcctcgtaatgacactactcctctatcagagctttcaaacacttttagaggcacaatcagttttcaaatgaaatgttaagtgaatatatatatatatattttttttctgtatatatatatatatatacacatatatatatatatacacatatatatatacacacacatatatatatacacacacacatatatatatacagaaaaaacatggtgttttgttagtattaaaatgtttcctcaagtcaaagtatagcatttgcttttcagttcaatcaaaggaaacagtaagaccattttggtgactacaaaatgtaaactactaattaagagatacaggtccaagttacagcctcttgttaatcaccgtcatcctccaggaaattcacagtaagcctttgcagacccacagcggtgcttccggttaaaagccagtgtggaatacatgtctcaagcttccctgatgttatttctgtacctgtcaaactagcaacttatttaaatatctgatacaacctccgagattcaacctcataaactttctctggtcacatcctcgctccctccttccctggggctctgagggcattttttgcctttacgccgttgcatcttgtccatccctttacaaatgctgagctcccagaggcaagactgtttcactgatatctgtgcagcagccttatagtagactgtcttcatccatcctggcagctgtaacaaaataccataaactgggcagtgtctaaacagcagaaatttatttctcacagttccagagggtgggaagcccaaggccaaggcaactcggtgtctggtgagggcgtgctatctcgctgcgtcctcacatggtggaaggggcaagggagctctcttgggccttttttattaaaaccctaatcctattcagaggcctccaccctcgtgatttaatcataccctaaggcccgaccccctaacactgtcaccttgtgggtaaggatttcaacagaggaatctaggagggacacaaacattcaaaccatagcccagactatgtgtagctgacgctgtgccagattgcgatattcactttgtgggttcaggggacaagaagacccagtgaaagcttgtagggaccttagggaccaaagccagtgacagtgtcagccccccgcccccaacgacttcatccacacctctgctcacagatgcctccctggcaccctctcaaaggccccaccctaattgctctctagccctcatcctgctcctccatcctatttcctgctcttcatcctgttttctctcttgcacgtttcactcctgccattgatttttctgtgtatgttttcagatgcccatcttctccactggcgtgtagttcagtgagtataggaactttgtttgacccaccactttgatcctgacatctagtgcaagagctgtggcatagtgtcctccataaattagcatttttaaatggatgaataaaagctgcactaccatactatactttggggccaatgcagacctaggttagggtcataatcttactctagaacttcctggaaaataagttaatacacatgccatttttaggttacaatgaaagctgcttctcatattgtgagtagccaaaatattctttaagacattattttttttgccctcgtttataaaagcctgctcacaagacctggaactgtgaacactgatttaattttttaaacagaaatgttgtaaacaatgaaagagaatcaaaaacaattaaaataatgcaatatgcagtttgacccaggagtttgatgctgtggtgaactatgatggcaccactgtactccagcctgggtgacagagcaagatcctaactgtaaaataataataaccataatgcaatatgcaattttacaccctatacttaatgcacagtaaatgggtctgaatgaattttcaaagtgaatacatagaccttattggcaactttatatgtgtcttctctattacttcagagggaagtactggtgcctgcggataaagttttagggagacagatttcaacttaacataaagaaaaagtcactaaagtcctaaccatcattgtatggatctcatcgtgtgtaatatatggacatacggtgaaggtggacatgccaaactctcgtcccaggagttctccaggcagaaactagaggaccagtgataggcacatttgtgtaggatccctttttggattattttggactcgatggactaaggtccttgccagtttaagagtctgtgattgttcttctctgatactgactcaatagagcaacttcagggcccattgcagcacccaggcagatccggcaccttctccaaagatccttctctctgctccatgcagtggtgctgatggtaataataaaaaaccgaatgcatggagagatactgaagtgcatcctgaataatcatcaaaattcattgcatgtatgaagtcaaaatttctatttgcaaactttgttgaattacccattttgaaaagttgatctttgtcagtccctcaagacaaagtcaattccattcttctccttagtggctattggtgaaaagtctgtttcttagttgtagatcaggaaacagtgctgcttgactagaggattcctcgccttacacaaagactgctgacacattttggtcaacagtaaaatacctattcatctcttccacccatatttcaaaagtagataacttattccttaaggaatgtttttgttgttgttgttgttgttttgtttgtttgtttgtttgtttgttttgagacagagtttcacttttgttgcctaggctggagtgcagtggcgagacctcggctcactgcaacctctgcctcccgggttcaagcgattctcctgcctcagcctcccaagtagctgggattacaggcatgtgccaccacacccagctaattttgtatttttagtagagacagggtttcaccgtgttggccaggctggtctcaaactcctgacctcaggtgatccacctgcctcagcctcccagagtgctgggattacaggtgggagccaccgtgcccatccaggaatgttatcttaatgcttagtaaaatgaattagaagaggtgggaagtatctactagctcctaacaaaagtttttactttagctatgaagacataaaaagaatcagtcccaaacttaattattgatgctaatgaggaggaaaaagatgagagaaaatcagctgcttccctggctgtgcatttctgcttcagcaattccttgttgtttaagagaaaggtggcaaacgcaggtgcccactgcagccagaaaggaatggaaatgagtgaacccctctttgtgtcatataacggaggccactggagagaacccccggtctctgacaggaaccgttgtgactcagctctggtcagtcattgccattcagaaattgttagattgccagttcttccagtatttcagcagaagtactaaatccatatttccatataaaaatatgatttttaaatgttgacaacccattacaatttgaaaaatatttcttttggcgaaatgaaacacctgcaggccacatctggtccgcaggtgaccagtgagtggtgttcacttgaatcaatataccagatggccaaagaggacttcttcctgtttctcagccttgcttacaagctactcacttggtcattaagaaatcaccaaagcttatgtagccagagggagccataacagaagtggatgtgcttaagtgtcaaggatccaacctggacactcagaaatccacaatactttttaaactgctctgtatgtaagactattttaaatctacctgtactgaattctgagctatgcaacagagttgagtaagacagcgttcatagtaatacatttctcccacttcagcacgcataaattgtcttccaagaaaagggatatttgtcacttattctaccagctgtcagtcagtcttcccttgatgttctgggaagctctttggcacctcagtgccttcgtcaccgacgtgagcatctgtccatgtgaggaaaagagaatgctgccacgacaggggttgtggtgactgttgaatctgcttttgctgcctcagtgttgaggaagccagggcccaggacttgcgcatggctagttaagagtggggtcaggactgcttcccgtgccccaactgccacactgctgtttctccaatgtcattcttctcattcatattctggttaattcagtagctggtcactgaggctttctgtgcttggcacacagcacgtggagaaggaacaggaaacaaacctgcaacattccctaagggaaaggtagaaaacaaagatcagggtcacacatttattctcacaaggcctgttggtttcatgagcaccagttttatagcttctcaaaccagggctagctcacatctaggtgagaaggtagcagatggtggttccagccactcatcccaccacacagaaacttatatcctagtgagtaactgcagaggaatcagtccagaagggaattacttcaccctacgtttcacaaacgcaaacccatgatcattacaagaatgggagctgcaactaatcataaggattgtgagcagttccaatcctgcacattccgagtttggcacagtgtatgagtttaataaatatttgaagccttcaaataggaacaaagagttttatggacacaaaatatgtcttaagtaactgttgagaaaagaaatgttggcttagctttagataaagtctctgtcttcctataccactctttatcttctagacattaaattgggtgtatattcttggtcaatatcccatattaaaaatgtactccctgaaaatattagcatgggtgacattttcctttgtaatcctgattccttggccagtttccttgttatcttcccaactgtctcctagctgaattgttcagtggttattattttacggactcatggagattcacaaggaggaagatgtccatttctccaccaacacccaaaggcttcttgagaacctcccagtgatgaaaatcgagagggtttctatgtgctagagctacaaatcaaacatggaacaacaaccttctcctcggcactgttgtccaacagcaacgacaaagcctaaatagggcagagaagggagagattcgaaaaatgaattagaaaaatctccttacaaagtgctttcttcaggaaatgtgggaccaaagaggcctgcagctttttctcttaatggagataaagtaggatcatccatgtgcttaaaatagtcacatgcagagaaaaatgagcagagacgtctggctaaatgttacatctgctttcactttcattaattttcttgcccagaagaaggtattagttaatgttagacagctgtcgaatgatacaccactttaaacacatttttaaagccactatttcatagtttgtagctgtaagtccatcagagtgagacaacatgaacatgaatatggagaacctagaaacacaacatagcatctatcatagtagacatcatctcctagcacatagtttaagctacgttgacaagaagtgtctgaagtttttattacttgcttctacttagaatggtaatataaactatttttaaatcagatgttacgggcatatgagatacataatctacactgaaatccaccccctcccagacacacacacacacacacacacacacttgaagacacccactggattttgaacatctcaatcagctcttccccattctcatcctctttcttatctgtttcttttccctcttcctcctccccttttcctcccttccccttcccttcccttctttattcttctgaccaattcagtctcaaagcctttagctgggtgaagacaggtgggcatctgcacagagaagtagccccgcatgggctgcctgagctcaagccaggaggtggaggcatctgcccgcctgggagcacctgggctgtggagtcagccctgggcaggaagagagggcgtctgcgcagaggggcagcctgtcgtgggaaatcagagcctaagagtaagggatgcgtctcttggaaaggatggcccactgggggtgtttaagcccaagcagagtgaggagggggtgtctcccagaaaggacggctggcaggggggtggtgtcgcagcccaagcagagtgaggagggggtgtctcccagaaaggacggctggcggggggggggtggtgtcggagcccaagtggagtgaggagggggtgtctcccagaaaggatgtcctgtgggggggtgtcagatcccaagcggagtgaggagaaggtgtctgcaaggagaggtagcagcgatggtgatgaaaatgtcttagactcaggagctagatcaagtaagaacagtaaagaagatgaaaacccagtttctccctgttggggatggaagtcacacatatggggaggtggaaactggaggcacacctgcgtggtgctggactggaactggggggagtggagtgagtccctgtctttctaaacgcagcgctgaactttcagctgaatcttcctgggactatttgcagaactcgaatggggtgtgaagattagcctgtaggagtgcgcctgtgtgaatttcctgaatgtaacggtaatgctgtggttctggaggagaacgccttattcgtgggagatacacagccccaagagcatttggggaagatggggcatcagctcagggattccttctcaaatgcttcagggggcaaagtcctttgccctgtacttgcagctttccttaagtttgaagttgctgtaaaatcttttttttttaattagataaaattttacaaaaatgaataaactgtgtgcctggcaaaggaattgagcgtgaaggtcactagcttcaggttggaaagtgctcttccctgtcaccaagcgtgcagccaccggcaaatgacaaagtcttgttctcaaaaacttaaaaagttttctaaagaaatagctgctaaagaaaatgagaagccagatagaaaaggcattgcctagtttattcttctccatttgagacattttcatcttctctaatatattccagcgggctacattaaacacctaagcagatagaatgtgtacatgttctagtaatcggtatatttatttcatgaaggtcattatgctagagtatgatcattatagttcaggcacaaaatctaaccatgtttcccctgggctctgacccatgcagatgtcagtatgcctccacaaggaccatcttccaggtaaacaggttacacttagctcagctttaagatggccataaatcttaaaatcgtggcatactgacttttgtttcagagtcaactctcagtagcctacacacctcagaatttgttttttagtttttcagccctactttcaattatttacagtgccctgaacatcaaatacagtctcggtctcgtacctttgtaagtcatgctatcatcaataatgcagataattgtattttgaaatgcctaattataattcacatttatatttatattattcaaacacccaatgcatttgccacatgctagacaataagaaaaacagaccaagaggctgagcgcagtggctcatgcctgtaatcccaacactctgggaggccgaggcaggtggatcgcttgagctcaagagtttgagaccagcctgggcaacatggcaaaaccatgtctctacaaaaaatacaaaaattagctggccatggtgtcatgcacccatagtcccagctgcttgagaggctgaggcagaaggattgcttgaacctgggaggtcgaggctgcagtgagctgtgattgtgccactgcaagccagcctaggcaacacagtgagaccctataagaaagaaaaaggaaaggagagaagagggggagaggaggagaggaggagaggaggagaggggaggggaatggtggggaggggagggaggagggagggaagaaggacagaaggagggaaggaaggaaggaaggaaaatggagagagggaggaagggaaaaagagaagaaaaacagaccaagatattagcaggaaagggactgaatttccaagcaaattgggagtcagtgcaagagtaatatcggctcaatggccaacaacaattagatggttttcagcagatgggggctagctggcatcatacgcaagagcatcagtctcagccagatgggaactttgaggttcctgtgattagcttggtaattctaagaggaactgcagaccacttgccataggtaagatgcttcctccatcctgctcaaagccctcccacccttcaccaccaccaaacaccatctctgctcctcatgtggaatctagggccctccacaattgaaagtcagccttccagaagtgcctcctgtgatgctggtgcacagacccctgggccctttctgtttgctgttcaagtctcgagactgcctgtgccctcccgcagctgtgctcttgccgctgccgttctcaccacccgatagctccttcccagactttcaggccgtcaaaatcctcaccttcctttaaaattctctggttcacatcagctttgtaagtatatcctgagcaagtattaagtgatcttgatgatttttttgagtcttccagctatgcctttgaacacgttttcctgtctctatctttttcatcttgaaaatccacattcgctgctgccttttttctgatcacctgttcggtccttacctcctttccatctggcttcctctgtctatcgattgctctcacaaggtctctgctcagccactaattgccacaagttccaggaagaggcagagccggggccaggccaggaggcagaagccactcgggggactggggggccatgccgggggcagtttggtccaacaaagaagcgcttgaaggaaaataatggaaaatcagttctgaaaggtagattgagataagtagagctgtataaacgttgtgacatagataattgtgaataatattccactgtctagccctagaacaatttgactgtccagtggaaaaaccttaccagcaaggtggtttcttgaagaaaaggaagtttgccacacagaaagctccaactggttctaagcaaagggtagcacctgcaccaagtatcagggcatgaacctgcctcctgggttgtcccggccttaatcgtacttcattttgatcagatggcttgcagggttgctgctcacagcctatttctactatctatacgtccacatttgaaagccacctccaagcacacaccgtgcacgccctgtggagaggaagcatttgcatttctacccctcagataactgctgctgcccagttcatgtttcaagtatgagttccttcattctatcaccaggcttaagatccctttggtagatgaactggatgtttacatccattattgctggacagccacagaaccgattctcgcagcatggctgtagttgtgaaccttctccaggattctctaccacggactctgttcttgcctctcaccgtccacgcccaggtgaccgtgtcatccccacggtgagtgggtgccctccttcaccctcagaagccaccctgccccaacgtcagccctgccttagaaaaaggaccacagacctctccatctggaaagacaaagagaccacacaggatgaatccacaccaatccacgaccagtcgtccactgtggagagctctccaggccacctgccaccaagggctttcaatagcagtcaggagccagatgcatgaggctcggagtggctttgatgagatcttcaatcaccggttgaccacacaggccacagtgctgtggtagagaccctccctactccaggggccactgatgtagggttacctagaatttaggcagagctgggtagaaatttaaaaaggggaaaaaaaactctttattgcaaaagttttagaaagggaggctgctgaaaggatgttgattcttcttaagaaaactttctgcacatcatctttgcatttttgtgctaatttctactgcaatttattttctcatcccagcaagtagcaatttcaggtgacgtgacagtttatgaatgttacaaacattatttctttttaaaaaaaatctcttgaaatcagacttggcaatccagatacattttcccattcagtatgagtgggagcattttattagccataatcaagttttccttttcatgacaagaaagcttacagagacctgggaaccactcatataccacggggtttctttgcaattcatgtaactgaggaatcaaacccacatctgcgcctcctctggccttacttattgtcagaaagttcctctcttgtcctgtcagttagagcaccagtaggaactgagctgtgtatagtcagctgctagcttgagattctgacaaatctttacaaaaatacataggcttctatggccctctccttcatcacaagttaaacccacatgaaataatgtattatgagactttgcaaagaagaatgcaattcatcttactgagaaagcaaaaccctgccaggttgatttctttctcagtagcttcgtgacaatttcaaggaagccactgtaccagcacttcatttccctaaaacaggttatgactcttctttccctcatgcgttcggctcagttcctgagtggctgccgtatgccaggcaacgaactgggtgcttgagatcgatgcttttgaggggcttgtgttggagggagagagaggtactcaggaggactgtccttcactgtgacaatgctgggacagagacatgctctggggcctggaggacccaaggaattccacatccatgtgccagggactttgttggaaccaacgataagtatgcatttgcatgaagaggcatcgtgctagacctggggagtgacagacacacatgaagtctctacccaacaaccgatcatggggtcataccattgggagcctggaagctgctggaagcccaggagctcaccatctcccttcccagtagcaaagccaccacccattttacagatgagaatattaagacactcgttacgtctcacgcgagggcacacagctgatcaggagctgagcccacacaagagccagagttcctcccacatccgcacaccccagggcctgtgaacagcgctctgccctctcctgtgcacagggaaacaccaacatttttgctgacacagtcccagaaatctcctccacagacctaagtgtgttgaaccctagtgacgtcctagacacaagagggcactgcagtactgcacatttgtgcttctcctcgcaggaccgtgatgggttctgcaagtgactggtaacttcccagggaatggtgttgcctccaacatgtaaaccacacaccacatcgccactgccacaactgacaatgtcaagactaccctgtggggacacagagaatcgagccctccagttcgagaagtctttctttgggacccaatatttggcagatgccaggcagaatgctgagtttgtggagatgaggacagaggccctgccctcaagtagcctgaagtctaggaaaatgaatcccattgggaaaccagtcaagggacccaagcttggggaagggactagcacgtgctgagacctctgctaagtggaggcatctcactcacgccatgcaagcagcctgggctccgatgcacacaggagcagtgcagaagagtgagggtcccggggtcccagtgccctgccagcatattgtcgtagagacaggcacacacagccagcaggaggacagtcaaaggcagaggatgggatggcaaggtgtttaagaaagaccataagggctgtaggaagccaagaaaaggagtgtttggtaactggtaaaaatggggtgtggggaggaaaaggcagacaacccctcatcgagaaggagcaagaagtgacttctgtgtgccttggctgcctcatctacaaatttgggatagtagtaccagccttgtacggctgacgaagtgtaaattatttattatctgaaacactcagagcaggacctgttgctggtagacggtggtgatgctggaggggatgctgacattgatgctgatgtcatccgtcattgtagctccgactctgactccgtatctcagaggtggggggctctggtcatttgcaccaatttcctgtcatatggggagaattcacctcttgtttccgatgcctggcaacataaattcacatagccaccagttaatagcagctgatgagtttccattctgtgcaaaaaattacactaaaatgaccaaagattctcatagacaaaggaaatttaaggacaaaggaaaattatgtggacaaaggagttttattttctttctgggtacaagagttggtggtggccttagcagaactggatatggaaggcctgggctaggcctggatggtcccggggctgcacggatgtagctcatcttcacgcagacaagaataaggacgcctgtcctctgagtactcactgcccagtgaggtcatcagcaccgtttccaaacagaaacaagatgaagaaacaactcaatgatgagttgtgccttgccagggtgggcggacactcagcctcccctagctcataagctagcatctgtctctgtctccctagaaatcccagctgccactgaggaatatttacactattaacaacagctcccagccgggtgcagtggctcactcctgtaatcccagcactttgggaggccgaggcaggcggatccccttaagtcaggagttcaagaccagcctagccaacatggtgaaacctcgtctctactaaatacaaaaaaaaaaaaaaattagccagttgtggtggtgcgtgcctgtaatcccagctactcaggaggctgaggcaggggaatcacttgaacccaggaggcggaggttgcagtgagctgagaccatgccattgcactccagcctgggtgacaaaagcaaaactccatctcaaagaaaaacaaaaacaaaaacaaaaacaaaaaaaaccagctcccatttatttcgctctaataatggccaagaactgcaaagagcatctatgtcacttaccttttagaaacgacactattgttcacatttcacatgtgagaagagggagactcggagactagggttgcacggtggtgagcagaagcgctaaagcgtaaagtgcaagaccttcactagaccctgcctcttccgctgctgtgggatcgtgatgttcacggcaaagaagtaaagttgaatgtattcattgcagaaatgattatcatttgtgggccagcgactggaagagccccttttctcttgatgtgatttggggccagttgtctacggtctgagaaagactctaggagacactgccgcagggcacccctgccctgcaaaggtttgttgtgatagtgactgcttctgtgccgtatttcgctggcttgggggtgtctgaaaatacagtctaagtatgatatgtaagggaaagggagaatgagaatgacttagacgtatagggtcagtgtgcaccaaatggagctcttctgacatcaccttagagcagtggaccctaagacctacctctagctcccttttgtgacttatttccccacaaaatgtgttaaagtcctaatgcccaggaaataggatcattgtagatgtaactaattaaagtgaggccatactggagtaggatggaccccggatctgatacgaggggtggccttccaagaagaggagaagagacagacacgggaggcagacgctgctgtgcgacgtcagaggcagggaaaggaaggacaagccgcggactgatggcccccaccagaagctgaaagagctgccgccctgcccccaccttcatctcggacttctggcctccagacctgtgagacaatctatttctgttgttttaagctgcccggtctgtgggaccttgttaggacagccttaggaaactgatccagtccccaggtacctactcctccaaatccttcttcaaccacctacaatcctctctgacttaaggccagctgacaaggagcttgctttaaatcactaccttggagcagtggaccccaaagtgttttggtggctggattttgttagagacacacattctcaggccccaatcacaaacccatggagtcagaaacacagggctggtgcccacccgtgtccactttaacaagccatccgggtgattcagatgcagttcagaggctgagagcccagagtgtacaaaatgcccattctttgcttccaagacacacttttcctattttcattttctgaaatcagaatgcctcttaggcaatctctgtaaaatcttatgattaataaatcagtggttcatcttacagctgggggtgtctcagaatcaatgaaaaggaaggaatacaacctccacctgatatgcctgtgagtgctgctttgtttaagaaagcggcttctgatggtggaaaggattcctgtgattttaaagcggtttgtgtcccagcagtgggccctgtaatgagcacctcaggcacactatgaccttcaggaatgttcctccgaggctcccaaaccttccgctcatttctgatgcaccaaagctggcctgaggcctaatctctgggtcccacttctgtttaattaccgcgagccttgtttctgctgcctgcctgcccgccgcctgccgcccggctttcagaagcatctctggttctggaggcttcacttcgaagatgcagccccttgcatggaggggaggcccctggctgggggaaatatgcatttggtcgacgtgttttcttctctctcttctgccagtattttcttctgaagcacacagcactgcctcacccatgcccaacccacctggggagctgagcctccagataaaaatagtgtgcagtttggaggctggtgtttttgagatcgaacagctgttctgtcgcactttcacaacacggttattaaagcaggagagaagtaattaaaattgtcacttgtgcggctgttcgaattatatttccacttcctctccacagagcattcattatgtgttacaaaaatatttcattgtggtgttttacatcattaattttgtttaaattattcttaattgctcactgacatgacaaaaaatgaggaggaaattgggaggaagagattttattttaacaacaaaaaaactggaaagggtgaattttatttattttgattttgatttcacctcttttcgagatgagtttcgctcttgtcacccaggctggagtgcaatggcgtgacctaagctcactgaaacgtccacctccccagttcaagtgatcctcctgcctcagcctcccaagtagctgggattacaggtgcctgccaccacgcccagctaatttttgtatttttagtagagacagggtttcatcatgttggccaggctggtctcgaactcctgacctcaggcgatctgccagcctcggcctcccaaagtgctgggattacaggagtgagccactgcacccagcctgaattttagtaatgagtcctgggctggtgtgggcatgtctgtggccaacatgcacgtacacatgcactcacacatgtgtgcttattcacacacctgcatgcacacacacacatgcatgcaggcacattcacacatgcatgcacacacatgcacacaaacacatgcatacacagatgcatgcatgcataacgcacattcacacatgcacacacatgcacacacacacgcatgcataaggcacattcacacatgcacacacatgcacacgcatgcaggcacattcacatgcatgcacacatgcacacaaacacatgcacacacatgcataacatgcacacatgcacacatgcatgcatacaggcacattcacacatgcacgcacacatgcatacatgcatgttcacacgtgtatgcatacagacacattcacgtgcatgcacgcacacacacgtgggatgtgcatttgggatgggctggaattgagcgcccaggagccacagttcatcccactgctgagccagctctgggggtgggggcaggtagagtgtgggtaccagcatgggagtatttttctgtccctgggccagtgacagaatttgtggcaatttctggtgggcgaggcgctcttccttgttactttttcctcagttggtcttgtatagtgtggccctttatcttctgaaagaatgagactttgtgttccgctttcaacttaaacctgacaaaatctctgtatttctttcacttccacagctggtatggagggaaaactaaaccacgtttactctattagtatgagtatcattgctcatttctttcctttccccagtattggtgaggttttctagaacaatgattagccaagacccaacatctgtgttcatttcttttttctcacttccttttctatcatttccatttcaaagcaaagaaaataagactcttatattcacattcccccaagcgatcttacatttttttaaaaattgttcatttagtttaaaaactgagtaggcagcgtctccacttgcagggcactccagggacccagcagccacgttaggatgcttctcgggtcctgaggtttggttggtggcactccgtgttcacgaggacaggaatacaaggagaaaacagtaagcataatgacagcagtaaaataattcttaaataattcatggaactaagagcttccagctagacgatgtcaggaatgtttttagattcacagaatgttagagcagaaagaagttccaagatccgctaatccaaatgttttcaaacttgttttaagccacagagccccttcttcaaaaggaaacttactgggaagcccaatatggaaatagcggcttctcaagagactctggggactcgctttgaagatctctgatcgggttccattgccacattttgcagattaaagaaatgtggggccaaaaaggttaagtaataagaaaagtctgcttgcaggaaataaaaacaaattgcaccaagagccaccgtggaatagcacagaacgtgtacgtggcttatgtaagtaggtatttgcaggggcttctgtgcaagatgcccaggaccgcagcgggatgccttcgggagcagagatgggatggaaaagccgggcagactctggaaggcagccagggtgctggcccctaaggacgcacgtgcaagaccggataacgggaggctttgtgtgtgcacctggagaacagaggtgcctccttataagtgacctccctggactttaaacatctcacaaaatgtggagccagttctcaggacaacagcacatctggttggccggtgggtccctcgaggaaaagaggatggaagactggcgcgcaggaatgccagtggctcatacctaagaacaagtgttaagaacagaccagttttcatcgtgaacagggtttcagtaaaagaatactcctgttgttggggcttcttatctttcttgaagggtcttccactaaccctcaccaaccaaccatctcaccatatgcccattcgtccacagagccccaggcaacagagtgaatggatgttaatagctccttgattaaatagtaataagaacaagaaatacagataagaatgcaaataataacaatactagacacacctactgaagggttaggagggcatggcacattctaagcatttgatgtgtgttactatgtgatgctcagaacagctctttaagatgagtggtggtatcattcccatttcacatatgaagaaactacagagcagctgattcaagtaacttgcccaagtctactgagctagctagtggtgcagccaacactgaacactcaggtttacttttactttgtgataaagacatagactcacacagggagcaaacggagcccagtggagcccagtagaggactgagtctgtggccaaagtgcctggcttccagtgctggcgttaccacttacagttctgtgcctgtttattcctctgtgaaatggggacgtagcgcctcttgcctggggctacgttaaggaatgaatgagtttgtgcatgtaatgcactgggacactgtggacatgatcagcggggcgggattgttaaccgttgttgttgccattactgttattacggtggtgccacagaggagggaggaggcagagagccatcacagagaagatgctggggctgaatcttgaacactatgtagaggtttagcaggaagactgggagggaagagcgggtgctcaggcaaagaacagcacagcccccacgcaggaacgaggagtccagaatgctgggccacagtgtgtgataggtcaggtctacagaggtcttgtatttcacgtcaagagtttaaacctaagcctctggacagtggaaataactggaggtcccagtcagaggagtgccacatcacaactctttgtaaaccctcgggcaggagagtgggggacagcgctgaggacattagcatggagatgggaggtatttagcaggcacagtgagaggaactaatgaggaatcaagggtggaggttaagagaggccagagcgtggaacgacttccattcaaaaaacggggtttgcttgcgctacatcctcgagtccaaaaagaaaagcaggtgattttgtatcacaggtagcgcccaccaagtgtctgaagctttatgggtcagcccacctggtcatccccattgcttgcaggtagtgacatctcccaccttacagatagctgagaatggaagtcgctaccctcaggacacacacccagcaggtggccatggcgaggtgccacccacattcctccattctgctgtcacacggtggaccaaccatcaggggctaaagaggaggatgggcagcaacctcagcctgcatgcagactgaggaatccacaggaagcggaagcctttccagtctcctcctcactacagtgacctgtcccgtgtccaggtctgatcagatgtgaaagcaaagatggactcccatgtactccatgctcactctgttgatgaaaaggagcctgagtttcccaacacaccataatttgtacacgcaagcgttgtctcgggaagctgagcatttattcccatgatgagcatgtgctcggaagtttttagatttcctcttgtaaaactgtttttacgttccagactcatacggaatatacaactttttacttcttagtatgcttaactgctggcagcgttacctaaacatgaattttatcataccttcattaccaaacttcatttcaatgatcttgtgcactttttcaaaagcaaagctaacctctaacacaggtagctggcgatttagaggctattctagagaatgcgccgccaactctgaactgactctgccaagtgttcaccttcccagggaatgtgcaccacccgcgagttatccacccattcatcctatcggcgactgtcaattggcgacttgctgttaacgagtcaatgtacgttttcctaggtgggatgcaaagttgtacaaaatagattcctatgttccaagtacagttgaagagataagacataactagatcactagaaatcaaatcagaacttaattgctcggatcgaaagtcattgcagaactttgagttacaacatggcagactgtgctcagtgctatgacaatctgagggcgagggtcataccaggagctgcgagaagtatgctgagaaggccgggaagtggggccagacactccatccacagtctagctgtgggctcagtcggggcgaacgaaacagccagtgggcgctgtacctttcccctgcaggcttttgcccacccctccaagcaggctttgcccctctgcaggctttgcccccctgtagcctttgcccccctgtagcctttgcccccctgcaggcttgcctcagcgcacaaaactgaaatactaagttccttctttcatacttggaattctgtgaatcatgtaaaacacctgaaaacgtcactccaaggggcataaaactgatgctgtgagttcaatgcagataattcctaacccctaaggcttttacaaatcaactacccaaaggtacgagctgaattttgggaatgtactgagaaccttctcttttcttcttttttttatgattgggaaggtttcccttattcaaaatgcctatcatgagccctgagtgtcactagtaatttctagagcaagaggttccctgtgactataaaaagtcaacgtgccattgcctccccatcttttgtgagcgtgtaaaacaacccatccatttccacggcccccctcgagccgcgctcctcggactgctgtatgggaaataggatcactttcaagttccctggacacataaaattggattgaagcaaaactaaatgctgtggggcacggagtggagggggtggggacagcctcaatcccaggtttgatgtcagcgataacaaggtttccaaatcaaacggcaacaaaacctgtcggcagtgttgactaggaaatgctgtcctcggaacaaatattttaattatccgcagtagttctggtagcttggctagctccctgtttattagtatgataatatcacctcaatgtataaactttatgcatcaggcatgcataatgcatgaacgggcaaataaagagatctggagcctgttcgcagcgggccatgccaattatctcgctcggccagagcctgcctctgctcacagctgttctttgaaaccattcaccaatgcttaagagatatcagtggtgccagccaggctgtttgaatctccattgtttacatactaggagtttagctgctggttggaaattatctgtcacataaacatcctctgaggatacagacgagaggaagggagacaagccctgtctttatgaattttttttatttattctgatgacttttttcttttacagttttgtgtcctttttaattacttcgttttcctctggaattgtcacatttctccctccagttgagcaggtgaaaactaatgctctaaaatgcctggggctgcaaaccagagacacagaaataaatattttctgttcacaagtctgttgtgtaattcaaagcttttcttttggtaatctgattttttttttatttttgtccctctggtcacaggatctttacagggcaaaaacgaccttatatgtgggttgtgaattcacttgcttccatttgtttattttcccttccaggaacaatataaattttgaaagtcagatattgaacttgagccaaaatagtgtgtgtcaccaaccaaagtttttaaagggccaaatgttgtttttattgcggttatctcttcgtaagcaaaggctgagcagataccatcagttttctgctatcagcaggcgtgccattgtatatttcagtttgaacatcagggctgttgttgcatgctccaaggctgcaccagccacgaggcaggcttatttatcaaggacttaggaaatatgaggaccaggcagagagaatcctagtgaacacgtttttgctgatgcatatgttcacgtgaatttgggaacacgcacataagagtgtgtcattagacaaatgcatagagaatcagatatctaatatttgacctgaaccaggaaggaactcacaatgaaatatgattgtatgctttcatttaaaagcgtatcctaaatacaaaaattagccaggcgtggtggcgcatgcctggagtcccagctacttggaaggttgaggtgggaggatcacttgagcccgggaagtagaggttgcagtgagcccagatagtgccaatgtactccagcctgggcaacagagcgagaccttgtcttaaataaataaatatataaataacagcatatcctatgttccaagactagacctaaacataaagataccagagatattggctgggaaaaaaacagaaaagcaatcccgtgttctcagcctcttttctttcttctttcctttccctcagacttagaccagaacctctttgtcggtacaggcagacaccatctgcttccatcctttcccatgaccatggcaaatgttgacattgcaaaggcagattctgaccacggaattctcatctctggaggaaggtatccccatcacagagagttgtgacgaggttgagagaatgtctctaagagccgagtgcagtaccaggcagatagtaggaaaaaaatgttggctgctgttgtttttgctgaagctgctgttgctcttactaaaagtagaccttagcaagcctgtatcctgcagttgagatccagataaggaaagctgcttacctggaatcacaaaatagctggtcccctgaccccttctttacttacaggagtccccgcatagacctctgaaccatggaccgcgtctggtggttgtactggccacatggcatcaaagcgtattttcatgcaagtctgtcttccgtactggactctgagctccctaagagtaaatgctttgtctatttctgtctgtttccccagcagctagcaccatgccttgcacatggtggcatctcaatacctatttgttgaattacatgcaaagtaaaaaagaaactatgaatatgaattgtcagaagaatagcagctaagtggagtcctaaggtttagccacaagaatctgtgccaaggcaatacagatggattgtcttacaggcatcagagacaaaagggcaaaagcttcctattgtatgaaacaaatcatttaataagttttactgaccagacttgcataagatcatttggaagaagaggaaaacaagtaaaaaaccaatgtggtaaaaacccctcataggtgtccttggtaaaagtattctctgttgtttcagataggtttaaagtgttcctcttgaatggtaccagcttccccaaaattctgtgtatgttcttcgtgtgttcggcatgtcccctcttctctagaaatcttaggtaaatgctaacatgggtctagtctggccaaagtagcacaaattttgagtatctgattcctaattaggattctgcttctgtttccttattaggagaaaatgtattttgatttagagaaattgtattttgatttagatgttttcctgaattatttgccagttttcaggggccatcacagaaaccttgaggcctgtggtggtcctacagttcacatagacagtagtgggcatgcatcccctgggccagagaaaccggatgcgaaggcggcctgcagagccgacctcagaccaccagagggtctgatctcagggcagagactcagttagactgcctgggattaggaatcaacagatacaaaattatacagaggagctgtttttcaacttttgtttagtggcctccttaaatgtaattttattcacgttctttgtattccactagtgtaaagaagtattctatattaaaatatcagtgaagatggcctggttgtcatatggcttcacaaacagaatataattccgatcttagacatggagactgctacccttggaacttagtgaaaagggcaggggattccctatgtacgaacagagagaccacagcctgaattagaaaaaccaggactccaagaatggtcttgagagacctttccttagcctgatttaaatttgccaccttgatatgtcatagccaattataagcttgggaggtcattcattcattaaccattaatctgttcgtcaaacatttttatacaacgctgagtccaaggttcagaacaggtggaggggatgagacatggcttcgtggcccaaggatttcagaatgtgtttgtctttctgtctgtgtgagatggggttggaacacggtcagagcagctatggctttaaaattgcaactcagtgtgacacttgctattattggtacttatggcactttcttcaatcacaaattagaaagcacacgggagaaatacctgcagcaacgtggtaagaaacaattagcttctaaataacataaaaaacagcaatgccattaaagtggacgaaggatgagagagggcagtttgtagtcaggaaaacctatgagaaatgcaaatgtcaagggggaagggaggagggatagcattaggagatatatgtaacgtaaatggcgagttgatgggtgcagcacaccaacatggcacatgtatacatatggaacaaacctgcacattgtgcacatgtaccctagaacttaaagtataataataaaaaagaaagatgtccagctttactcaaaatttctaaaaattcaaacatttacccattagagtggttttaaaaacttttttaagatacaacctagatctccatacactatcagttggagagcaactagacaatatttactaaaatgtgaactgtttcgactttcagtgtagaccgtattattgttccccatgtttcacagcccctccctgtaaaaagatcatcctccaccccatggccatgtggcctgcagggcctctgtggagatacagactcatccctgctctgttgggaccaatgggatgcgtcttggccaacagcatgacatggccatgtggcctgcagggcctctgtggagatacggactcatccctgctctgttgggaccaatgggatgagtctcggccaacagcatgagagtggacatgaactgcaccatgtccaggacattttttagttatgcaaattatttttggtaatatttatttttaatttattttttattgaggtaaaatatacatatataatgtatatataaatatatataaataaattatatgtatgtgtgggtatatatatataatttaccagttttaccattggagtggtaacaaatacatttatattcttttctcccccttcatcgtgcatttctgcaagccccccttgctcatttccttttgttgtgagctcagcctgttccagatgaaggctgacctttcaaccaggatcctagaaagaagacgcatcctggaggatagcccagcagagcacagccgggctgctgcagacctggttaccaggacgcaacattagcggaaagtcagcttccttgtttcacaccattgagagtcaggagttatgtgtttgaaaccacaagattatttcatgaacgttgactataaaacctttttgaaacagcaactgcagtgctaccaactagcttaacgacagatgcagtcttacccgtgtgcaaagatatatgtaagaggtttttcagcaacactgttttaagatagcagaaaatgaaaggaaacaacctaaatatccaccagtagacagacaatggactcaataaattattatatttccatatgatgggatactatgcatctcttcaaaaatgaagttttacaacttttaaaaattatttacatcattgtatattatagtattaacccttctgctactagatgttttcgcttaaccttataatcttcatgttggcccatgtcgataggtgtagatctactaattcattctgcatgctctataatattctgccatgtgagtaactgcgttttattcatttaatctcctgctaatgagtagctgagtaatttcccatttgtgacctgtacatagttgctgttaggaacaatcttctgcctgccttcttgtgcacaggtgcagaggatgctctgagatgtgttcccaggagtggagcccgcaggtcatacgcatgagcatcttcagatgtcatggatattgctaagctgttctccagagtggctgtgcccactgacacccccaacacggcttcaccctcttgtagtggccagactagatgtcaagaccgtaccaaatatgttacattgagacatgtcatatcatactatatatggcatgtatattattatgaatacatagccatgtggtagaaatatcttttaaatatgcagagaaatgatcaacattaacttcaaaatgatggtcacttctgggacgagagaggactgggattagggaaggaatgcaaatgacatcgtagctatttgttatgtcttgtttttttttgtactcaacactacttatttattattgttttccccatattcttttattttgtttggtttggggctctttcatttttattcatcattaataattgcatatatttattgggtacaatgtgatgttatatacatatatacattgtggaatgatcaaatcaggctaattaacatatctgtcacttcacgcatttatcattctttgtggtgaaaacatttaaaactccactcttttagcaattttgaaatatacaatgcattattattacctagagtcaccatgctgtacaatagacaccaaaaggtattcctcccgtctaactgaaactgtgtacccttcgaccgataactcccttttccccacctgccgccccctcacttcagcctctggtaaccatctttctactctttgtttctacgaaatcaacatttttagattccacatataagtgagatcatgtgacatttctcttcctatgcctggcttatttcacttagcgtaatgtcttccagattcatctgtgttgtcacaaatgacacaagtcctttcatctctaagactgagtagttctccactgtgtatatgtacctatgttttaatacattcatctgttgctgggcaggtaggctgtctccatgtctggactgttatgaatagtgctgcagtaaacatggaagtacagacagctcttcaacatcctgatttcaattcctttggatctttacacagcagtgagatggctgaatcatagggaaattctatttttagtttttttttgaggaaccaccatattgttttatgaaatagttttactaatttaccttccccccagagcatataaaggtttccttttctccacatgcttgccgacacttgttagcttttttttctttataatagccattctcacaggtgtgagatgatatcttattgtgcttttaatttgcatttccccagtgattagtgatgctgaatatttttcatgtatctattttctatttgcatgtcttctttgacaaattcaggtcctttgcccatttttaatagggttgtttgttttcttgctattgagtagtttgaattccttacatattttggttattagccccttatgtgatatatgatttgccagtattttcaacacaattcatgaaatgtcttttcactctattaattgctttctttgctatgcagaaatttaggatgatgcaatcccgttcacctagctttgcttttgttgcctgtgtctttggggtccaagccaagaatcattgcccagaccaatgtcatggagctttttcactatgttttcttccagtagttttacaatttcaggtcttacactgaagtctttaatcgattttgagttgattattgtataaggagtgagataagagtccagtttcctccttctgcatgtgaatagccagcttttccaacaccacttattgaagagactgtcctttccccagtgtgtgtccttggcatctttgtgaaaaataaattaactgtagatgaattggtttatttctgggctctctatcctattccattggttgatgtgtctgtttttatgttagtactatgctgttttgattactacatctttgtaatacgttttgaaatcaggcggtgtgatgcctcctgttttattctttttgaacaagattgctttggctatttggggtctttgtggttgcatatgaattttaggatttttctgtgaaaaaaatcaatttccttctgtttctatgaagaatgactgaaatttggatagagattgcattgaatctacaaatcacttttggtagtatggacattttaacaatattagttcttccaatccatgaacaagggatatctttccatttatttgtgtcgtctccaattttctttcatcaatttttatagtattcagtatacatattttttacttccttgaatttattcctaagtatctttttcttgatgccattgtaaatgggattgtttccttaatttacttgtagatagttcattgttagtatacagaaacactgctgatttttgtgttgcattgtgtaacctgcagctttactgaatttgtccatcagttctaacattcctttggtgcaatctttatggttctctttacagaagatcatgtcatcagcaaacagaaaaattaacttcttcctttactatttggatgacttttatctcattttcttgcctaattgctcttgctaagactcccaggactatgttgaataaaagtggtgagagtgggcatccttgtctttctctgatcttagaggaaaagctttcagcttcaccatggattttgatgttagctatgggtttggcatagatggcctttattgtattgaggaacattccttctatacctacttgttgacagcttttatcatgaaaggatgttgaagcatttgtcaaatgctttttctgcatctattgcaaggattgcatggccttcattttgttaatatggtgaatcacatttactgatttgtgtatattgaaccatccttgcatcccacagctgaatcccacttgtttatgatgaatgatcctttttaaaaaaattgtttatttccataggttttggaggaatcagtggtatttggttacatgagtaagttatttagtggtgatttgtgagattttggtgcacccatcacccaagcagtatacactgaacccaatttgtagtcttttatccctcaccccctcctcccctttcctccaagtccccaaagtccattgtatcattttcatgcctttgtatcctcatacttagctcccacttatgagtgagaacatacgatgtttggttttccaattagtgatccttttaatgtaccattgaatatgatttgccagtattttgttgaggatttttgcatttatgttcatcaggcatattagactgtagttggggtttttggcgggggtgggggagtttggtagtctctttgtctggctttggtatcagggtaaggctggcctcataaaatgagtttggaagtactccctcacgttccattttttggaagagtttgagaaggactggtattagttcttctctaaatgttggtaggattcagcagtgaagccatcaggtcctgggcttttctttgataggagactttttattattgattcaatcttcttactcattattgatctcttcaatttcttcatgattcggtcttggtagattatatgtttttaggaatttatccatttcttcttggttatccaatttgttgccatgtaattgttcatagtagtcgcttaagatcctttgtacttctgtgttatcagctgtaacatctctttcatttctgattttatttgcatcttctctctttttttcttagtctggctaaatttttgccaatgttgtttagcctttcaaaaaacaaactttagaaaaactaacttaaaatagagcaatacggtgtgtaatgttaagattttgtaaagcttgcagatatacatgcaaccattttcatgttatttttgtctatgtttaaaatacgtgcttatgtgtaaatatgaccatgtatgtgcagacaaacatttaagaacattttagcaacatttaggttacttctgggaagtggggataaaatagatcactgttactttattcctttctttagtgtcttttagaaacatatattaagtttatgaattaaaagattaaaagcgactaattcaggctcagtagcttttttattgtatggatgagacaaaagacttaaaactatctacacctgtggtttttttcctctgtaaaatatggttagaaatatctactttgcagagctgctgtgaggatttgattagaaattattcataaaaatatctaacagcatgccttttacttagtaggcactaaataaataataattgtttacattattaataagaacataagagatattctgttttcaaatttattcaccctgaaatgtgcagagaaaatacttataggttctttatttttcaataactgattctttcttctacttgagctccccatgggggggaaatgaatcttagagccaagaaacttagtttgactcaataatttaaactggcatttaaatctcttttggtaagtgctgcctctttgggtataaatatgtggactttcagatcgctgttccctcactgggtagggggtgccatatttagcaaataaaaatttaagatactcagttacatttgaattttaggtaaaccacagataatttttttgtagtatgtcccaaatactgcatgggacacacttacagtaagaaaatacttattctttatctgagcaccacatagaaccaggcatcctgcatatcatctggcagccccatctgtgggtgaacagagaggggcaccacgttggggaaaagggccctggactcctggactttgtgcatggggtagagactggatccagtccttgggcaacagataggcctcttctctgatgtccaaggccagcatgacccacagtctgtgtgtctcagctcatctggacctgtggatgggcactggccagaccttccaccttacctctcaagggtagaggactccttgcatttctgccacatgctctttgggccctggactagggtgtccactctggggcctctgcagtgaggccctgaagccctcagcatggtgggatcatagcagattccctagctttcaaccagttgtcagacggcccctcagaagcgtgtggggagttttgatgatgaccgcaggaatactgaactccacccatccccctgcccaagatagtgtgcatgcttcagctttgctgtggccaccccttgtgagtccatggcatcctgggtccatagcctgaagcagagcgcaagcagcagccctggccacagtgttcccacagtgcatctgtctccctgggaccacccacttcccacttcctctttctccctgcatcttcccacaatccacctgagccaaagggacaggctctcctggctctcctgcctctcctgcctctcctgcctctcctccctctcctccctctcctccctctcctgcctttcctgcctctcctgcatgctctgtgctttctcattcagcattcactccacaaacatccaatcgagcacaactctattcaaaacacccttctcaatgcagaaaacaacagcagtgaatctgacacattcttgactgtctcggagcttacatcctagtgcagtagatgaggagaaggacagcaagcaagtatgctgatcattacatattataaggtcccaatagcgtagtgtgtggtaatgagttctacaaagatcaggaaagctgtgagaatggaggctgaccacatggtcatggaggggagttcctttagatgggatagttggagatggcatttgagtagacatttaaatgaaggaaacacaggccatggcagtgtctaggggcagagcatttcaggcagtgagaacaagcggctcagtgggaacaagcctgacatgcctccagccctgcaggaaggccagctagctggagccggtgagtgcagaggacagtggctaaagtaaggttggaaaagtcaccaggcctgcctcttaatgttttcaaaaagatatagaaaataattcagggagactttttttctttctttctggactctccttttgctaagaagaatcgagaagtcacctgcagagaaaacagatcaggggccacctggtcctgagttggaccttccttctcacttctcagggctgcaacattcctgcagctgggaagctgccagctagtgattcaaggaaaaactgaaatatagtttgacattttcaaaatattcctgttacatgaatacgtttttacaaggtgttatgagagacccattggatggagtgacatccttcctggaggagccagcagacttagcactgaggcttgagtaatttataagaacccataaagccatcctggaatgtgtgtctgtatggtaaaaatgatgttatgaggatataaaccaaatgtaatgcttcatagaatgatgttttatggcattacaataatctgaaaatatggactttgagttgggtgtgttgcagttaacacaggtgcagaggtagggagctgtgccttggcccccctgccggcctggcctctgccatcccatcattgattactcttgcatgaattcgggttctccaggctccgcacgtctatctacgtggcataagaaaagcctgttttcttgttctcggctaaactaatggcttcgtttttgttttcttcctggctattctctacccaacacaggtcctggtgttcctatggtgacggtgcacaacacaacagataagaaaagtaagtgctcttttttttccttaaatcttcctgagactcaggagaaaggaagcaaaacactctatgagatcagctggcccacattctcctactcagagacagagggatgagtcatgtcctagcagttcagaataggccatgctgatcaccaatatcaacgaaatatgatgaaagtcaaagtccgcatacccctgccagagggccccacaccccttcacaagtgctgagcctggagggtcattccaggcctacccaggtcatagactgacatcctctgaacagccagctcaaaaggctttgtagcctcacatgagtccgtccccactgagaacctgccatgtggcaccaagacttgaggggcacatggaggctcatctgtctttgtgggtctgggagcttcacggcatggagggtctctgcatccatgctgcacaggatatcagagaaaaacttattctgccatttgtaaaatggtagggaaggctttttcaggactgttgtgaaaggggagggagattcaggctcaactttgaatacagcaagatcccgtgggggtttatagccagtgaccagagaaaggggtccgtggatggaaaactgctaagagaaggcatcagtgggaggcgatttttgctaagctgacctcacaagatccttgctgaaggcaggacaaggacttaggctcaaaggtggaggacgaggaacagttacggagggtgatcagatatcaggggtggagacctcttgctaaagctgggcaatgcaggccgaagacaggttaggatcaaggttgaagcctggtcaagaagaggactcagaggagcctcactcaagtttggtcaaggagagtctttgaaagacttcccagggtcactagaggtggcatgtgtttgcttggagggaccccacacaggttgccacgggcacatccgtgtttacgcgagggatgtgtgctgtgtgcagtgggaggcagaggcacagcacagctgagaagcaaagagaactcgccctcggtccctccctttccagccctccctctgtctaacccaaagcagcctgtgtcctccttcccccgaatccttcccactcccttccacattcaggaaccccttccctggcaggagggcaaacttcatggcccgggtccgcagttcccctaggtctggggacagaggtgactccgtgtctccagtgaccatcgagcatcagcggctccctgattcctatctctgtggtggtacttcaagctccaggagaactggaggcggcggcggtgaggcgcatgttggaaaggaggctccaaacgtgtgtttagacaccgtgaagtggtcaaactgttccaaagtgggcaaaatagattcgtttaaagagacagcacttagccaataatcccaaataatgatgatagtctgccaagctatcaaatcattattagaaatacaaaaccaaagcataagtaatcataaaaccagaaataaattaatagattttaaagcccccacaaaaagccataaagtggatgtcagaatggatatacaaaaacactcagaatggccgttggagggaccccgtgctgagaagaagcgggatggccttcctgtgctcctccccagaggaggggctggtttccccagcaaaaaggttcacctgctcccaggctgctttccagcctcacctgcgaggtttgggaatctgggccatttgagcaatgggggcggtatccccggaaggatgttgggcgcgattgcctgggtctctcacctccccactgcatccacccaccctctgcccactctaaggggcacgaggctgtgaagggccctccaggaggccgcagaggccaagctagaacttccaccaaggcctggggtcggtggagtctgacagacatactccggcatgacagtgaatgtttgaaacacctgtgctagacctctttaggtggaattttccctgaaaaaatgccgatgttgcatagagcctcaactgtgacatcttttttttccttaagcaaatgtatattttcattttgagtatttgataagatttagagtccatggacacctttctggtatttgtgaggttttccccttcttgaaaattgatggtctggtagaaattagataaggtgtccaatggagctcacagcattgcagcctcccgggttagctgttgcccgatggttctgtgagatgccaccactgaagacccggaagtggagacacaggactctatgcactatttgtgcaacttcctaggaatctataattatttcaaatttaaaagttttttctaatctgtggtctaataaaaaacacaaaagtatctttcagctttgaaaaatatgatatagcatatggctcttcttacaaaagtcattcccttaaatgctttttacttctttggaggaagctattattaatctattcaagttcaaaggttaatatagtccctacttttgggaaatgcattttgacttctaagccacttccagcctggatgtgatcagtccttggggctcctaaagcctcccacggtgctggatcaagtcaacacagtttccaaggctcatgtgtgagtgaaaatgaagccggcctgtatcttaggtgtgtgtgacactgttgagaaaatatttcatttattccatttataaaaataaggtaatctataggtgggctgaggtgcaattcttcggaagagagtcccagtaagaattgaccaaatgtcttccagcaagtgcaacatgctaatatgctcaaagatccaggaaattttgttaactctgctgggaaacaaaacaaccacttcttttcctctgtaggactggctactacattaaccaatcaatccaatcaatattgacagaccataggccctaggttgccatccatatccgttgcggagctgcataaatgggaattttttaggaagcatttcgccgtttgcagttgagctgtcactttggtgactgtgactccctgaagcaaagagatgggacccagcggcttaagaaataaaaagcactgtgcacacaggatggggctggcgttacatgcctgtactcccttcttctctgtgtgaaatttaacagtgaacctgaaggtgacaccattgcgcttgatctcagcaaagtgctgactaattggaaactggacggcgtttagaattattttggtcacatttattttacgagcctatttatatagcagtgtttgactctgggtttcctggagcctaattcaaactctaggaatatttcatcccgccctagcctgtttctgcatttctggctgtcaatgtagttcaagctctttcaggatggtaacttaagctgccattttaacttggaaaaaaaaatgattaaatgtggttgagttgattgtcgttcccatccccaggaggacagtaggggtcccatcttgctcagtgtctatgttacattcagacttcatgatttgaggggttccaggttcctgaacacccactttttccccatgcctggataaaagtgcctgaaatcccttccttgcacggccatccctgagggttggcacatcatagctgcacgaatggctttgagtccacctgggaaataagagtgagtgtggcagggcctggtaaagtgccaaacccagccctgagttccagcctccaggtgtttgccatgggaggcgtgtggggtttcttcagtgtgtttaccttttgatatgtctgatgtcctcttgcagcacttcacagcccatctccaacccagctgtgtcttccccaaacaaaatgcactgagttttcattttgtctgtcaaactggtgcatcttggatgagaaggcaggtgcctggtgcttccaggcccccagttccagcagcatcttgttcgtggtgtggttggaccacatcagagcctcctcgtggcctctgcagtggatgaagggtccacagcatgtggtttgcggggggatgtgcatatcaggcagccgacaaagccattgtcaggccagcacttcacacatcagcctttgggcctcaggtaagcttgagatcagttgtcctctttcacgattgaaaaggccgctgaagacttccaggagcaacacaaaggcaggcagtgagtcacccatccctgcagatgcctgtttcatccaaacactcagccagctagcggttctgcatcgtcaggattctgcaaaaccccacaccacttgtacttgttccatttgatgctccatcctgaacaactcagacaaccgtgttctgatcagggggccagagaaaggctggaggtcacagggagccatggtagtaacaatagtggccccaaccagcatttatcagcacttgctccggggcagggtgctgtggcaaatacttgacatattttaactcatttcatcctctcaacagcctgtgaggcaggaactgctattatccccacttgtcagctaaggaagctgaggcaccacagcttaggtgatcgggccacatgcatgcagcgaggaagcaaaagcagaggagttgcatctcggacgcaagcagtgcggctccaacagagcctgttcttccagacatgtggtcattgcatggcgctgctcagccgcctgccctcatgcggtctgaaggacaactgcaaatccagagcgatgcccggcctgcactcccattgagatgagtctggggaggcagaagcagtcacacctgcagctcgttctcagcaccttctccgcccatacaccacccccggggtccatccgagccagctctggggtgagcgtgcggcacggcaccttctcctgctctgagaagccttccacgtcacagggaagagatgctcctcaggccctggtggctgttaaacctgtgggagccccgtcgaattaagggctctgcttcctgcagcagctcagcctccatgtgcaggctggggtcatactccatgcactgtgagagctcagcccttgaacttcaccctctaatggcagccccttagcccccaggcagcagtctttggctagccatccattattctcttttgaatgtaatcgtagcagcagttctgggctctccacacagcaccaggccccttccttgtaccaaccctatgaggttcaacaattcatctgagatccacagcaaacttcagggcgaggcccggactcttgtcttatctgactaccaagcaggcgctcttgactgtgggctgggggctgataccagatgtctgacaaggggggaaaggcagccccagaccccaagacccaggatctcctggccttcacgtcgctgccatctgggaaatgtgctcacagcagcagcctctgtgaccactgagctgctggtcaaaaatcacccctggtttagatcagccctggtgaggccatgccagcacaggcatttgcacctcacgcctctgttgaacagtgtgcaaagcagcagcgcttccaacccgcgctgtggggctgagccaggaaagcggggcccatggcctacagctgggcagggcaagacaggaggcctcggggagccggctcctgagccgctgtgtgacgccatgactggcagctgaggtgtggcccacgttctgttacagggcagagcctcggcactgtgcgtcagctagcaaagggggctctggaaggctgggacccgtctttatcatactatcctctcccagccctgctgtgaaatttgaaattactgtttcagaattctttgtcctttcccctcctctcccccactgaccccaaaaccaccctgggaatatttgacttttttcctctttagaaaatcttatctacaaacagagcctgcggggtgttcacagatgtgactctgaattatttaaaagctgtttccttaagaaggtaattatggttgggaccaacctatactcatttggtgcctggatattcaaacaaacaacttaggtactgggataaaaaaaccaacaaaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccaggtgggtccatgaagcaacgccagatgcagttggtttccagcctctgttcctgcaccagtgctgctgggcgcacccctgccccaccttctccctgaggcaccccctcctagactgtcaaggctgtgcccacagctccccttccatcaagcacagggcgcccacacatggagagacatcaggagcatggcattccagagggcccacatgtcactgtcacgctacacgccaaggagtttgcccgccatcctgcaggacccaggaggagcactgtcagacgtccctctcgaaaagcttctggtcgctgtgcagagaatggatggaaggaccccaggttgcagacaggagggctgctgggggccatggtggaaaggatgagagtctggaccagcaggggggcctccaatgaggggctgcctctgcaggccctgcagggagagatgcacctggaaaggggccgaagagctgccatctcaatccagtccagggaggtgtggcacttgctggggtggcgaagcatcatacagaatcctacagcctgtggccctcaaaacctgggtcttgtccagtcctaacaaagaaggaacagccccgctgcctccttgggtgcagcagcaggcgactgggtgggtgtctggagagtaggtcctcatgcctctcaccctgcaggccaactgggcaaagccctggctctcagaaacagtggccaggacacagcgggcagctgccccatcacagccgtggagccaccaccaaggttggggccgtccagcaaatgcacaaacccatttcagacctggagataaaagccagctctttcctgcagatcatatggggcagaaccaaaaagactaaaaatgtaaaaagatgatgaaggaaagtaaatgttaaaagaaaaaaaatttcgaaagcagcctggtgcctaacttcagccctaggtcttaacatggctgcatcaggcaagtttctacctaagacccacagctttcaaatattttaaggagcaatttggtggccaaagagagaaagtctcattataaagtggcctttatgtgaggggaccttgccaagtcatgccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaagtattgtggcaatttgatacttaccactgcccagttaaacatttctggaacaagttcttcttagctttacatccttccttttcctcctcgagctgatatttacattccatttgtccgcccgtcaccccagaattctgtcctaacgtcatttaatcttggaaatattttaaaggtcttttctttttaacttccggtgaccataaggccataatcattacttgttggatggaattattatcataattatcacttgttcacatcaagcaattaggatacattacatactttgataattgttggacataaaaagttatgattgctctgagatgcatctcttagcgagctgggtgtggtggtttttcactcagttcatgagcacacctgactcatttccagagaagaccttgtcagaaacgtgtgcgctcctggtttttccctccttttggtggtcgcttctttttgtttctgtagaatgtctgaaaatgtgttcatgtaaataaatggagagagaggagtcttgttatagcagtgccattttcactgaacgcctgagctatatgccaaaacattgtggcccatccattctctgtcattaaggattattttcaatgatctattgatttttagctcagtgagattccccttccattttgttaaaatcaaaggatgacaagccgaccatgttactgggggctcttacccattactgggggagttctcttactgaactcagccttggtggtccctcatccttcatgtggagcccacctgtgtacaagatgccccagggacagatgagggggctccaaggccttccttgccctcgtgacgcctgtgtcaggccatgatgaaagaggcacaggaaaggagcagttccttggagcgaatcaggcatgtccattctcagcacatttgccagcaggctcctatggatgcagagagcctgggaaccagtctcctgaatcccacgtgtctgcactcgaaatcttctggacccacagggttgcacgcgtgagcagctgtcctggtgggtggagtgtctgcagatttgctgttggaacgtgttagacttcagtccagcatttgggtgggcaagctggcatttggctaacacagagtggaaagcaagccacgcatggagctgcacgccctgcaggatgtctgcaggtgcttcttcctctctactacctaatgcgggaggagagctgggcttcgctgccacccagcagctctcggtgcctcgaggagcacctgcaggctgggcactgtgccagccactgcacccgctcatccgtgggctggaggacacacacatgagtcccctcaatgcacaactcctctggcatcaaacacctgccatgggcccagcatgatgctagaaggaccaaaaataaatgccacctactgggaccctgccctcaagttgcttaaaatctggctggaggaaaaaagatatggcaaaaagaataatagttgcccaaactgtgtcagactgactctaacaactcaacattcggagttcagagaaaagaggctgggtgctgtggctcacacctgtaatcccacgaaggtgggaggacctctttttcttttttgacctcctgggctcaagcaatcctcccacctcagccccacaagtagctgggactacagacatgcatcaccatgactggctaatttttacatttttctttggagagatcaggtctccctatgttgcccaggctggtctcggactcctggactcaagtgatcctcctcccttggcctcccaaagcattgggattacagacgtgagccaccgcacccgaaccctttcctttgtcttttctattttgttcataaagcatgtctctgttgatcactgcatgtatatgtggagggaaggacaatatgattttaagaaatgtaatatttagcatcttggccccaagattctacaatcctttcataggatttttttttttttttgagatgggggtcttgctctgtcacctaggctcaaggggagtggtgcaatcacagctcaagctatcctcccactgcagcctcgacctccagagctcaagctgtcctcccacctcagcctcctgagtaactgggaccacaggtgtgtgccaccatgcctggatttttttatgtttatattttgtagagatggagttgggattacaggtgtgagccactgcacccagcaaggaagatctcttgagtccaggagtttgagactagcctgggaaacacaatgagaccctacctctgcaaaaattacaaaatttagccgggcatggtggtgtatgcctgtagtcccagctgctcaggaggctaaggtgggaggattgcttgagcccgggtgttcgaggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacagcaggagaggcctggactagaaaggcacagaaaacccaggcaggggaagtcaggccaaggcaacagggagatgccggagagacttctgcctaagcctctgcgtgcacacaccatcctgcagttttatttcttgtagaaatgtgagaaagggaagcggctgctctctcctcttttagatccgttgcctattggtgttcattggatctggtcaccaattttccaaaatttagcacagtggtgattccatcaatcccctgaacctgccgggccacttggaagcatgtcttgcaacagtgcacagctacaccacgacctgcccatgggacgcagcgagggaagcagcctcatgagcaggcctgagtctctgcggtctcactgtgtccagatctgataatagctaattccaccaaatattagagggggctcacatttaattaaagagtggccatttgtgtgctccagactggaggtccccactgccctgaagtcaaaagaaaagtccttcagggaatatgccaatcttttcttatttctctgctgagctcctgccctctttgaatgcaattatgggaacaaataaaatggcttaactcaagtcccctgtgggacagtcagctctctgctgataaaaccagttgtgtgggcaatcattaaatgagaaatctaatatttaactaaatttaatagtctgttgctttggtgctttcctgtgaagggtgggatttcaatagagaggaacgaggtattcacacgcagcctgtgtagtccatgagcgattagaacatggtgcgttcccacatgaaaccagaactctcagatccggaaactggtaacgggctgtttggtggccagcctgtgttccgttagctctaggcaagcttaactcagtaggcagcagagaacattgctccctgagtttaaccttctccttcatgaccagcatttgagatcgcacactgacggctgaaacatcaaattcacatgcatatatatggagacaagagcgtactttaaccagctgtaagagggtctgtccccattttctctcagtttgagatttggccatccagacaggctcttgccactagcagacccccccagctgaagccctttctgggacccagaagcagaagctaactgatagcaagaagcccatctctgttctcattggtagggtctttctacctttgctcctgccagttcccctgatcttcatcggttgtcacttccatcatttgacccacatttgcacaccccaagttcctcacctgttttgcacctgggatgatcatgtcagcaggcagaggagcagagaccacaggttctccaagggttacagctgaggcgtcgagatgacctcatgagatcgaggcactggtctcctacaataagctggagtttggagcgtgtggatgaactgcctcatagtcccagagtcgagtgaattaacttaggtgcatcattagtctcctaaacatcagaaaattttccatcaacttctaaacaccagaaacttttccatcaacttctaaacaccagaaacttttccatcaatttctaaacaccagaaacttttccatcaatttaatgcagtttgctttgggtcctcgggtctgagctgtgtgggaaacactggttgatagtctggcctcagtttttccaactcttaccgttcaagagatctgagccctgaagacctttgcagcttcctgagacactcaggaggacctctcctcggtcctgtttagtttcctggggccacatgggaacaaggagaaagacttgggtagaaacccagactcgttaccatctaaagatgcttaatttccaagatatgaatcgattttccacaaacccatctaccccgggtacccaaaactagtgcatttcgtctctgggataggactgaacactgataccttggcgaggggtagggagaaggatttgctgccaggaaaatgaccaaaactttcatttggtgttaagtgtatccagagagcttgacaggtgcctgagatagggtggtcaggtccctcttggaggaggtaacgcttgcgttgatggaggagaaggagctagcaaggaagatttcaaacacagggcagcacgtgcaaaggccctggggcagcaaagagcttgggaaatgctgttctcttcattaccaggcagcactccctgctagtcttcctttcctgtaactgtgaatagaacatgaatgatatgcagtcactgtctcataaaccaactcctctcacctgagtgtgtgcctggagcattgcattaaagggctgagggcatttggactcagcaccaatgagtgctgccgcccatccattaggaacatgggctgaggctgtgaagctggcgcaggggcatgcaggccccttggggtggagtgcacctcccctaactcacgtgcatgcctgtgagggagagtgcgccacctctgcagccaagtctctgggtctcagagttaaggtcaagtctacttggacttcccttggacttcaccactgcagacaccccttgcagacgtagctgtgtttcctgctgggacacgtgtcctgcaagggacacgtttctcgcatgctacgtggtgttcggaacctttcccagtggtggtctaacgtcagatttgttaaaactctacctgtttgaaaactagtgtcactatttctccccttattttttatcaaagctcaatattcaaatgtgtccagcaacttgcaagtcattttcattttatgtactcgtcacaagcgctgggagcttccatttccccctgttcctctacagaaggttgccaggccttctgggcagagttcttgaataaagccacagccccatgttctccacacaaagccacacgtccagattctcctagttatgggcggtcatttgacctccagctgccccggagaagcgcccacctgcagagcagctttttttttttttttcaagggagttatatgggaggatgactggacatccattctagcattgtttgtgatcatttgtttacgctttaaacaaatgcacaaattgcagctgcttccaagtgatttgacgagccaaaggcaaagttccttgcagaaaaattccctttcacaatgaaccacaagttatccccatgtgtaggcttagtgtgagaagggagaaaggaagttgggtggtttttatgacacgtcagatggtgaaatgaaacagaatggccatttcagtacatgaacggagagttcctcaggggacttctttgcatctgaagaaatagataacgaggacgtgtgtgtgctgtcgcggcagaggcacaaaggtccagcgcatccacaccacagggcagaactgaccttggtctctaccacggagggaggacagccagtcccactgcagtgtgaagcaaggctcacacgactccactgtccacaaatacagtcaccgaagttaaggtctctccagagaccagcttatcttctgttttgggagagagatcagaatccattttatttctgggaacatttaataaagatgataccctagtttctacccacctttccttttctggttattatggccacaatttttggaaaaccatttgtcctaacagatgtgtaatgtaggttttcttaaaaccagcagtcatgggaagaatcataccaaaacctgtgcgtgtgacgccacggagaacaaaaacctctggtgggggaaggagaaagcctaagacggtggggagaatctttaatccacccaaattccagatttgagtctaggcttttgagcgcataacttgagcgtgttttttaatgcccagtttctttttctgtacactagaaataataataatcacctctgaggctgatgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcagggcacaggatctctctccctgagaggctgacagttgcttcaaagcaagaccacagactccaacgctctccttctttggtgaccgtgtcaagacaccgtccagaaaaacctcttccctctggaaattccctttctgtgccatctgaagtccttcctgcctcatcagctggtggattatgggctgatgaggggcgtccttgcagccagggtttacgtgaggaggtttgagtgctgttactccctaggaaatgcttctcactctgcctttctctgcctgtgcccttctttccttgaactgtccctccagtcattcggtaagttctcctgggcactaactctgtgctaggcgttgctaagcactaaacaccccagagcattagctggacctggactcacagctctaggagggaggcagagcctcggagcctcaactcccacctccgcacagatggctcccaagtcacccggctggccccgtgtcctcactgcccaccaggtcgttactcttggaaacccaagtgtaaaatgcccacagcggatttcactgtcttcccccagaactctgtcccgctccagacttccccacctctatgcatagcagccttttggtggtaagttggtgtcgaataactgagacttcaaaccttgaagctgtctttgagtcattcatgcagacaccacttacccatcacctctgaggctgtaaacgggtttccctcctgtgcaaactccgactgactgatagtaactgcaggagctctttgttgaaagggaaggtttccagagctcggcggaaagcgtgttgaggctgataagtaacactgagctgaaagggcagggggaggagccacacaccttgcgtttgccatccctagaccgtctctggaacctctttgtctgcccttccctgacacgagacagcagcgtgtcgcctggagcctagggtattcgctggcagcccccttgtgctcagcagcttagaggagacacaatcacctaacagactcagctcccaagagcaggtaccaaggctcaccccacgaaacaaaaacaggtcccccaaacagtacgtgctgcaaagctgcattgcgtagagcagaaagtaaatagcacgagaattcagagaagagcatgagactgggctggggacatgtgggaatgctcacggaacgtgggacttgaacatggtccctagagtcagcatcaggtgggctcacaagaggagaccgtgcaatccagagaagagggcaacgtgaggggtcttaggcaagggcaagtgcagtgcagtgtggctgggtctggaggctgccctggagtcccagcctgcaggacagcccaggtgtgggccctgcacagggaccctcactcgcctgtgctcaccacgccctccctgcagcccaccacaggtccgggccaaaaacttctggccccgccatttggccacaggaagctatgctctatcacaacttttctggacattgcattcacctctgaaagtcagaacattctggaattttgatgcacttcagatccgctcccgcccccacccccacccccacccctgcccccaacacactcacatgtccaaaggctgtctctcttaaaataccctgaaggtgaccacgccagggaagggggcatgaacgaaatgagtagggaatggtctaggagaaaaagaataattttgtgtgtgtctgtgtgtgagacagagtctcactctgtcccccaggctagaatgcagtggtacgatcttgggttactgcagccttgacctcccgagctcaagtgatcctcccacctcagcctcctgagtagctgggaccacaggcaggccacatgcccaactaattcttttttttttttttttttcgtagagacagggtctcactatgttgcccaaactggtcttgaactacggggctcaagcaatcctgcctcagtcccccaaagtgccaggattataggtgtcagccatcatgcccagcctagaggaggaagaagagaaattcaagaaaaccataaacaagggctgggcatggtggcttatgcctggattcccattactttgggaagctgaggagggcagatcacttgaggtcaggagttcaagacaagcctggccaacatggtaaaaccccatctctacaaaaaaatacaaaaattagccaggcgtgatggcatgtgcctgtagtcccagttacttgggaggctgaggcacgagaatcacttgaacctagaaggcagaggttgcagtgagccaagatcgcaccactgcactccagccttggcaatagagtgagactttgtctcaaaaaacaaaaaacaaacaaacaaacaaaaaatggaggctgtgacaagctgctttggccaagaaatgtgtgtattggccagtcacggtggctcacgcctgtaatcccagcactttgggaggccgaggcatgcggatcacttgaggtcaggagttcaagaccagcctggccaacatggtgaaactctgtctctactaaaaatacaaaagttagctgggtgtggtggtgcacacttgtaatcccagctactggggtggctgaggcaggagaatcacttgaacccaggaggcggaagttgcagtgagctgagatcgcactactgtactccagcatgggtgacagaatgagactccatctcaaaaaaaaaaaaaaaaaaaaaaatgtgtgtgttatcccagcccaatggagaaaccattgccccggcatgtctctgaagctcctctgttctcagctcgaggctcctccgcagccttggcggccagactgtcaccctggcaagatccctttctgagctccttaggcctggcctcctcctcctccagcccactctacccactgctgtcccagtaacgcttcccaagcctgcagcactggtgtgtgactgtcatcccttcctcttaggaaatgcagaaaagacctttcaaagcacaaagccagctttcccacccttgccacacactctgtccagcagggggtttccttaaaaggtgggtgggtacagatgccaggagaggatgtggggcacctgtatgagcccagcatcaggaagacccccttagggatcgcaggaaatctgaaagatgtcagccctaccgacctgacttggttttgtttttttactttatgctaccagaggctaatgcttttctttattttattttattttgtattttttagaaaagtaggacatcttccagaagggctcccctgaaatgttttcagccagtcagaacatggtttccaaggtctgcccttgggcttatcagtggcagggagcagcccagaccatgttttatggaatttaaatgatgaagtccaaggcctgcctctccgccagtccctgggccattgagctaatttgcaagccattaacattcagcccgaatcagtaatgagacgccaggtcagagctggctgcccagccagccacccaagcctgcagtgtatctgtgtagtaattgtattgaaaagccgctaattccaatttaattgctgtgcctttggtaatctgggttgtagttaacatcaacaaataaattcaacttggatgggaagatttgttggaaggtagggggcacagaagaaattggtgaggcaggtttttgaggtttggttcctacccactctccctcacccactggatttcatgctgctgaggaccagatccagtgaccttggtagccacgggatccaatgggctgtaccatccttccctggcttcccctagctgtggctgcagcatagccatagagccacccagcacaaacctgccaacagcaagacccacagatccacctggctctgcacagaggcactgccatgggccggcaccctctcccctctaggcggccccctgtctcccctgaccctctatctcttcctctccctgcctccctgctcccaaatatccatccccagcatccccgatcagatgctgagagatgcctttgttgccgcaggcagccctcctgctctcagggcaccatatttccctgcctgaaattctgctgctagcgagtgcccgggccatcgagtcttccgtgcattcagtgcactcccatatgcaagactgaatggaagcttcagagaaatgaagcttcacacaggtcgggtgacttgcccaaggccgcgcagcaggccagagtcctcaggatgaaaaccctgggccagtctctgtctgtgggcttcccctcaggccccacccagagcaccctcacccccacggtcacccaagggcatgcccgataccccgtggccagcattgccccctaacccgtgctgtgctctgcttctccccagacctgcccatgcagatactgaagccagcaaccttcaccgacaccacccactaccctctgctcctggtggtgtaagtatcgtcacatctgtctttccctggtgctcgttctggggctccgtgacacccatgataaaggaatattgaactcttaagaaaagataagcaggagaaatgacattgttgcaaactgaaaacataacatcgtttagcccaatgtcaggttctttaggaatcttggagacacccagaggttaaaggaaagtgggtgctgtgtacccaccgcctctccccaggctgcctcaggttctgtgaccataaagtgaggctgctgggatcatcgtagtggcattttgcatgacaggctcaccggaggctggcaggggacaggtcccaagacacagagacacaagatggctggagcctgggacccgcaccctgagcccgtgggtctcactggctggcatttctggccactgccgtgaatgcccttttttcaccagcaaagaattttttcagctctttcttatattcattaataaagcctccggtttgggttttgagaacaactttttgtgctctgtaaatgccttgaaggtgttgggtctgattagggaactcagtgctaggagccggcccagtgccctgtgcataggttcaaatgttgcctgacagccctgagtctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagagccggctgaagcgaggcctatgctgggctgtgttaaggatgccagtgcaactaccccctgagtaaacgctggcacctgatggagctctgattaaccctggtgtcttgccctgctcccttcctgagggctgagtccctaaatagcaaaaaggttccattatagaaacgccccagggcacagattccaatagctgattccgttttgcaattaacccactttccttaatatctggactgctttcacactttcccagcagccatgcatgcacactcacccacatgcagacacacgcacccacacacaggcacacgcacatgcacacacacccacatgtgcacacatgcatccacacacacacatgcacacacgcatacataaacacacacatatgcatacccacatgcacacacacccacaggcacacacatgcacacacacgcacccacacacataggcacacacacatgcacacacccacatgtgcacacatgcacacacacacgcacctgcatacataagcacacacatgcatacccacatgcacacatacacacacatgcacacacatacgtgtgcatacgcatccacatgcagcacatatgcacatgtatgtgtatatacacatgcacacatgcacacatctatacacacccacacccacagacccacacaccccacacatgtgcacacacaccacacacgtttcctgcctcctttctcttactaaaccagattttccccactttctccaggatgctaacaacttccgaaccagctttcttcccctgcacactggtttcttcagtgatcttaaaggaaatccccaaaagcatttcagtttacaaaacaattctccttcccttcagaggtaaaagtggtcgtgcccggtggagacagctgagctctgctgagctcggacgggaccggccaggcaaccccaccccctgggtgcacactcactctggccttgctagcttgccttggaggctgtgtctttttgtttgtttctcactgtgacatcaaatgtgatagcaaggagatctggagtccctgagcccctgcttcagattaaaaaaatccaaaagaaaacaaaggcacactcgacatagagcagcaccatgactcaccaggaccctaagcatgcagcactcgagcgcgccgctcctggcccgctcctcctgcccccaccccactcctcagcccttggcagacagctgggagagtgcccgtggtcgaagcagtcacctggctggagccactctcagttggggcactgctccctgctgttccagggaggcaggctggacctggggctgactttctctcctgtccatctttttcccggcaagagggaaaatcacttaaaaacttccccacacccataagtatgctggtcaatgaggaacaaccagtcctgcatagaaaatggccctgttcccagcctgggcaacatagcaagaccccatctctacagattaacagatttttcttttaattagccaggcatggtggcacatgcctgtggtctcagctatttggaaggcaaaagtgggaggattgcttgagccccagaggtcaagcctgcagtgaaccaagattgtgccactgcactccagcctggccgacagagtgagaccctgtctcaaacaaaagaaaaaaaaagaagaaaagaaaagaaagagagagagagaaggaaagaaggaggggagggagggaggaagggagggaacagccctgtttgaggaaaaagaaaacagccctgtttgtggcactggtcgaatcccatggtccaaatgccccaccatggatgcctttcagccagcagtgctgggctcgcaaatgaagagctgggaggagagcacagtgggagccgccagcccaggtcggaggccacactgcccagagccaatggctccttgactcccgagcagagggagggagaaaggccacccatatggcgggtttgctgttacttccgacttaacaagagacagaccacgtcttcaagccagggatgtggctagagtcagcgcggccttgtcacttgtgatgggtactgagaggtacagcctgggacatctagaacccaggaaagagaaaccttcttgccgtgtagggaaggtccccgcagggagaaggtgggaggatttgtattgtttccctcaccaaatagatgctttttggtggccgtcccagacagcgccggtgtgtgtagggatggccctgggtgtcctaggctcttggaggtctcctcttcctcctcactttatggggtgtggataacacctggctcacctgcccggggcaacagaatctggggtatggagttgagcgtgtggcagccgggtcacgggtaaaatcccttacgggggtcatctgacgtggcagctgctagaccagccgccacccaccacgcagcaggcctgctgagcccgggattctctttccagggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggtgagcacccgcccaggaagcaggagaggccgggaggggacggggctcctcatgggggcagcaccgcagtcacagtgcgggaatgctttttctccacgcacacatttttcatgcaatttgctcttacctaaaatctcttggccattccaaagaagtttcaaaggaaacttaggaatcttctcctagggacatttataactagttttcccactgcagggtagattgttgagttgactaaaacaaggggatagaaattgccggttgggttggcttggcttttctgcgctgtggtcactgacccgggccagtgtccacgcatgtctttgccatttatcccaaggggaggagagaagagatcaggaaggaaggacagaaaaagggaaggaatatgaatggggctggatccgtggaaatgggtcaccctcgttactgagagcaggacctccatgcacatccaggtggggccagaatgcccttcccggctctgaggaagggcaggcttttgttctgtcattcctgtgcatccctatcactgactcagcaagagcaaccgacatcacagaaacaaaaggaggcttagcaccaaggggcagatgctccaaatgacttattgaatcttattgttgcactggaaataaaaagacatcaagacactgcgccaggctgcagctggccttcaggctcattttgtagaagcagttttcacagtctgatggcacagaggactgcagcacttactctaacttcaccccttagagatgctgcaggaacagctcaacggactgtggacttgggttctgagaatgacaagaaggcagggagaagcgcatctaccagggacccccgccgcgaccatgatcatcaccgttatgggcaggggagcgtgaggctgggcccgggcacacaaggagggtggagcacagagcccagctcagtacatgtttattgactggacctggcatctctgtacctattataccagggtgctttgtgcgtttggaaatttttactcaactgactttgaaaacatttctcctcattttgaaaaagattgacggccctggtatgtactcagcgaatggtctttcaatggaaaacaatgagcgtgtgaatgaatggttccggtcctcctccagggagctatgagctgggtgatggcagacaaagcaattgcttcagaaacccgtgttgcagctgggaaatacggagcgggagagctctcaggactcagatactcagggaaggagtgtctgccaggatgcctttgcctggaagtcaatgactacaacaacacatgtgtgcgtgcacacacacacacacacacacacacacctctcaaataaggaactatattggctacaaaagacacagggatgtcaggtctcaaggttgatgaatccagacaccaacaatgtcaccaacgacccaggctctctccgtctctccgcccagccagccatgatggtctcatcctaagccgagccctcagtcacggggtggccctcagtagcacctggctccatgcttcgtcatctacctccagcaggttggggaggaaaccacttttagaaacttccagaaaggaaaggaaagtctccccacaagcagacagcaaacctctccttccatctccctggccctcccctgcccattccagaacctgccaccagtgagacaggtgcaggcagcccccccagagaccaagtgggtccgtctgacaccagtgtggggccagcccctgagcagaggatgtggggtgacaagggaatgctggggttcagtgtggaaggaggatgggtgggtggctgctgggtcagcagcgggcagtgccagccacagaggactcccaggacacggaagccggcccaggctgcgctctggagtggagtgggcctggcttcctgggtgggggcacgagtgctctcctggcttcccagacctcctcctttgggtctttttcatttgtgtgtggcttcccctgccatctcctgctctttcctcaccccacctgctctatctcctcccagggagatttggaagcccggggcctccccgccatcaagggcaggcccaggggaaagtcgcagcaccctcaggctccccttcgacacttggctctgcctggcatcttccccaaagagcacaggaattagagggcaaaggtgtttcacacacacacacgtcgtgccctaaaaagaaggaatgggcccaaccatctgttccaaaacaaggcagaacctgttctggaaaaagtcaataatgccaactcctaaaccaccgaagctcaaagaatgggagcgtgtggacaacggcaaagcttagagccgttgccaaagcacagactttcttaggaagctgatgcccaatggcgccaagccatagaaagcctccctcagctctccctaggaacgaggtctgcattttcattcatcagaaagaaatagcccaatttgatcggaaacctaaaatcaggaggctgacacattagcctgactcctcccactcccacagttcccccgtccaccaccaccatatcctcaccgaggagcccacaggccagcctcccacgagcagctgagatgagctgtggaagggagctcgtcccacccctgtggaaggcagcgggcagctgtgtaaacccgactagggccggtgggctcctgtctcctagagacaggttgtctctgggctcaacttgggattttcttcacgattgtttcttttgggtcctacgtgctcatgtgtacacacacagacaccctgggtcatgtgctaaggagcagcagaaatgcctcatttttatttactcatttgttcacgtagctagtggaggaagccaaaatagttatccccaaaatattgagacctgctaagtgaaagatactgaaaacacagggactctctgcctctgcccctgtttgccagacgccaggacatccatccttccttcctggggacagcacctgctcatcagcccagagagggtcccagccgttgccagggtctctgggggcagattgcattgccttctcacaggttccctccttttaaaagactgggggctgggcatggtggctcacgcctgtaatcccagcactttgggaggcccaggtgggcggatcaccggagtccaggagttcaatcaagaccagctggccaacatggtgaaaccccgtctctattaaaaacacaaaaatcggccgggcgcggtggctcacgcctgtaatcccagcactttgggaggccgaggcgggcggatcacgaggtcaggagatcgagaccatcctggctaacacggtgaaaccccgtctctactaaaaaaaaaaaaaaatacaaaaaattagccgggcgaggtggcgggcacctgtagtcccagctactcgggaggctgaggcaggagaatggcgtgaaccccagggggcggagcctgcagtgagccgagattgtgccactgcactccagcctgggcgacagcgagactccgtctcaaaaaaaaaaaaaaaaaaaaaacacaaaaatcagccaggtgtaatcccagctactcaggaggttgaggcaggaggatcgcttgaacctgggaggcagaggttgcggtgagccacgatcacgccactgcactccagcctgggcaatgagccaaactccatctcaaaaagaaaaccgtaaataaataaaagactggagctgctctctcctttgcctggtcactatgctgagagttatggctctttgttaaaatactgtgtaaacagggcccctacaccactgccttaagaggcactggaactgaggcctccgccacgtggagggcacagcgcacgccaggaaatctcttccggttttcctcttgttcatctgactttcattttcaggacagtgacagtgtctcgaccaggaactcataagggttgagaaaagaaattatattttctcctctttactagaaaatgtctaaaaatatctctaactccacacttgacattatggcttggcttgaggtaaaatccagacagacaataatttccatctaacaagcaacaagcccacagcctgcaggcgtcctgctgctggttgaggtccagaaaccggaaggaccccagccacttcgtgggggaagcagaagaccacaatgcggggcaaggtcccagcaagggtgaggcagggacccaggcagcactggcccagagcactgaggcccagagcaccaagcggctgctgccaaggctgggccgtagcaggaagctcatgggaagaatccctctgtggccaaacaggtacaagacaggggcctcctcccaggaattgggaacagaaggctgtgcaggtgggatggggtctcactggcttgactctgagcccagaagcatagaaccagagctccacagattcctgccgacccctaaggctcatcccagagcccgcgtgcttggagtcacaggctctgggtgggggcccaatagcagcagatggaccccatgcaacaggggctgcgtctcccagaaggggctctgcggctgtggattaatggctcgcagtcgagaagcttctatacctggaagtgctacagagttattgcaagggtgctttgaggttttaacgtgaacatgctgacttggcactaaataaataaaagcaataaataattatattggaatgctaaggttgctttttatttgaagaggggttttcatccttgaaatggatggaaaacatggctctgggctacaggaagacaaagtggcagcaggatgtgcactgaaccctctttcccctcctcgacctcacaggacgatgctgaaggagcagtacattgacaggacgcgcgtggccgtgtttgggaaggtgagtctgcgccaccctggtctgaaaacccctcagttccagtgtggcctgcaccattacccacgtctaatcctgatttattgagaacgtctgtggtctgctggtgagcaagtaattttttaaaatcaagagcctgggtgcttagtgattccagccgtgggaggtttcatttgatcagctcattttcctaagtttctttttacattatctggaaggaaagagaagggaagccaagtccccgcaggagagctctaatacattcctaatgacttttctcccatccatctgctgtagctcttggcatggtagccaggaaagaagcaaagcaggaatctatttctggataactcgatgtggagtaacaacgttaattaccatgtctacttagacggaagcacaggtgtggggagggtcgcgcagtgaactctcaaaccagagccgctcccatctggtggcccttgtcagaaggctgtagcctgggacagctcagctgtagctgaggcccacggtttggagttaggtctctgcaccgccacctactatggccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcaggtgaaggcttggacaagtaatcagcacagtgcctcttacgtcatcgcctccaaaacctcagagcccagcatgcactggagacccggccctgccctgtgggctgctcccggaagcaggggatgcaggagccctcccacacctcctccttacctgccggaggtgaagtggtcaggaggagggccggcggcttctctccttgttcagagcccgggcacagagccctagaggtgcattccaggtgcctagatgtccactcactgcctgtgaggcccgaagccactgggtcattggtaggtgtaacttgggtgtcaatagccatcacctctccccaccctcatggaagtgacttcccagcagactggcagctgaaaggcagggagcctgggccgtggtcagtcttttccagtcgtcactctgccccaaatgcacatggatgccactcctgagggcttggcctccttcctgtgccttgcatatagtccatccactcagggcctttcatagttcacttctggacacagagaggctttctcaacaggcagttggtccagaagcacaggcagccgaggtgccaaagggaaaggggaccctgtgcacctgtcagagcacaactgatgcacccccacaccctgtacccccgcactcagctccgccgaggacatctgtctgagctccgtgctggggatctttcctttgccattctgcccagtggatcccgggcgtctttccagagcataagcatctctgttttgttttaacaagccttagatagaggtccgtagaccccacaatggtatttctcctctgaagaataaagcgtcaatccttttagtggcttggcatgttgcggcctgtccattctgtttcctcctcgcatgtgccccagtgatctggctgcagcctttgtcaggcatcgcaggacctgggacacagagcccaggggagcagcagccaccctgcacccagaggtgacctggagagcaagggggcacctgtgcgttatgttctgcagtttcccccccgacaccgaaaatcccccctgcagaagattgcctgtctctcatttaaaccagagcaggccgcgtggccctgcaggaaaatgagatttaaagaaaacgaagaatgacaagtaaggacgtgtggagttcactgacaataaatattatttgtcagaaaatgaaaatcttctttcattgtcattagacaaggtgcccctgccctattaaaggaacacaccggaacgatcgtgcaggtcataaatggttgatcttggagtttggcatgacctgcgcttcacggtctcagtcaggtacctgggttctctacactccatgctcccaacacgcatgctcacagactcacatacacatggatgctcacccatacacatgctcacacacacatgctcacacattcacacacatgctcacccatacacctgctcacccatacacatgctctcacatacatgtgctcacacatacacacacatgctcacccatacacatgctcacacattcacacacatacacaaatgctcacatacacgctcacacatacacacacatgctcacccacacaatgctcacacattcacacacgctcacccatacacctgctctcacacacatgctcacacatacacacacatgctcacccatacacctgctcacacatacacatggtgtcacacacacgctcatacacacacatgctcacacacacgattacatacacctgctcacacacacacacatgctcacccatacacatgctcacacacacgctcacattcacacacatgctcacccatacacttgttcacacatacacatgctctcacacatgctcagacacatgctcacccatacacatgctcacacacgctcacacattcacacacacctgctcacacatacacatacatgctcacccatacacctgctcacacacacatgctcacccataaacatgctcacacacacacatgctcatacacgtttacccatacacatgctcacacgattacatacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcacacatacacacgagtacatacacgctgacacatgctcacacacacgattacatacacatgctcacacatacacatgctcacccacacacacgctcacacatacactcacacacacctgctcacacatacccatacatgctcacccatacacatgctcacacacacatgctcacccatacacatgctcacacacatgctcacccatacacatgctcacacacacatgctcatacacgtttacccatacacatgctcacacacgattacatacacctcccacatacacgattacatgcacctgctcacacacacacatgctcacaaattacatacacatgctcacacatacacatacatgctcacaaacatgattacatacacctactcacacacacatgctcacacaattacatacgcctactcacacacacatgctcacacaaattacatacacctgctcatacacacacacatgctcacacgattacatacacatgctcccacatgctcacctatacacatgctcacatacacacgagtacatacacatgctgacacatgctcacacacacgattacatacacatgctcacacacattcacattcacatgttcacgcacacatgctcacatgctcacccatacatacacacgattacatacacatgctcatacatacacgattacatacacatgctcacacaggctcatacacatgctcttacccatacatgctcacacacacacatgctcacacacaagcacacatgatcacacaggcacacatgatcacacatacacaggcttgcacaagtttacacacatactcatacatgctcacacaggcatacacacatgctcacatatgcacacactctcacatgtataggcacacacaggattacacatgctcacacatgtgcttatacacatacacccatgcacatgttcacacgtttatacacacatatcacacacacacacccccatatactcacacacacgctgccacatgctctgtctctcacacatacctgacagttccgtgctgtcccgtttccctcggggtcttcccttcggaggctgcagctcgtctgagcatccagccttgaaggcactgagcaggcaaggaggtagggcttttctctggggaggcctgcgttgcagtacggcttcctcatccccaccaagggcagggaagggcaggagtctaggacttacctgaatacagaacacctgggagcgtctgtctcgtgtcggccttgtgctgagcatgtgcagaccaggacttgcgccctaagccacttgttggcccctccctcagaatcatgtgcagtggcttggcctcacccacagacaagggaggcggtaagaaatgccataaagagacgctgagcctgaaggacagcaccttacacctgtgcagtccacacttgcctttccaattcgccgttgcatttcatcctcacgtcccttgacaccaaggcccagaagcggagaaggcgcacgtcgcataatgctgagttggaagggagtttgcttttcatctcttgttactgccccgtgaacaactttccaagtgacacattttgtaaaaggagagaacctgcatggaactggctgctctggggctgtctccctgcccgaggctgcttcatgctgagttactgccaggactcctaactgtcttctctctgcgctttctccaggattacggtggctacctgagcacctacatcctcccagcaaagggagaaaatcaaggccagacattcacctgcggctctgctctctctccaataacagacttcaaactctatggtaaatagccctgcaggaccaagcgacgggctctgctcccgccccgccccgccccctgcctgcgtggccccacagccctcccttcagcaccaccgtcccgctaaccacaggtgcctccaggccacagtcaccaccttgggctgatggaagaacccggggaaggagagggaagggtctcaggtaatatgttttgaatgaaagtggtcaatccccagatgcctacaaatcacatcccaatgaagaccacgagttggaaacagctagtactccgctggcagcagtgggggcgaggaagccagggtgcgcaggaggggagcaggtgccacaggccctgccgggccgccctccttctctgctcccagaagaatccgagcagggccctgccctgagttctatgcctgggcatgggtatttggtgcacaggtgttaccagataaggaagggatggttgggagggaattgctaccatagagcaattcaacgaggtccacgtggctcagctctgccttcccatctccctggccatgcaaatggcacctggtcagcacctgtcctcagagagtatggctctccatgagcacaaggcagagatggggtcaggctgtcagggtgacctgctgtggggatcagatggagatgagcccacccaggtgtgggaaccagacctctgtccaggcacagaagggctttgctgtgtttgggggttccaggctcctgcattctcctccttatggtcacccaaccctttttctctgaacctgagctctgtgacctgaacccatttcttagaatatacagagaggtcttttctgtggctccgagaacttgaattcaggtcagggctccgtggcagccaggctgttccctccagctgtccccaccctaagcagcgctggcaagtgaggtggaaatggagggggcttcctgctgctggtccaccgcagtcctgccagagcctgacattccctgcaggttggaggaacgagtccagcccccattgccacacctagccctagccctgctgtgctggccgagccctgtagacaccgcccagcaaggcagggaccacggtgggcccagcagcctcctggctggtgcagccaagtctcccaacaccttcacagcgggctcactccagtgcaaattttaactcgtacaggaactctcctggtccaaaatgtgaatcatgtaagaggaatcttccctcaggaatgcgggtgccaccttcaaattgagtgagactttcttaattctttcatcatgctgtttcagatttgtctgattcaaatgcacataaatctgaatcagattgtctgattcaaatgcacacaaaagctgccatcatgtcttgatgggtcactgtgcccaaaaccagccagtcctcttcattgtctcctgggcgccctcaggcttaccctgcaggccaggggcactgtgcagagccctttcggccctcagccctgggagaagcccctgacactcttctgtcacccagctgaccgcagggcctcaggcagaaccaagagcagggatgtgcctggactttttaaaaaataagtaaatcttgatggaaatgtgctctcttaccacccatgcccttcctaagtgttgaaggaggaggttatcctacttatttaggaatcagattaactgggttttgcttaattaaggttctgcgatgctgatgaaaattgcaacaccggcactcacacacattaaggttcccgttgtaccgcctgatgccccttgtaaagacccaaatgatttaggtggtgtttttaaaaaaccaacaatctgccacacaagtggcaagtgggaatgagcctgagtcctcaccccgcacccggtccagggccctccctagagtttgggggctgcgctcacagggcctcgaagccagaggtaacctccctccctttgcttccgtgcagcctctgcgttttccgagaggtacttgggcctccatggacttgacaacagagcatacgaggtgtgtatgggcacaactagagaatgtgatgagaccagtcagcctctgccacagtctcccagcctgccctggctgtatggcccactctgccttccccagccccatgcttctccctcaccagcaccaaagcccactcagaaacctccgaaggatcattccaccagagagtggattgaggttaacatggcctctctgggttccgcctgatttcccattataggacttgagggatgaggaagaaagtaagaggatatttgatggcggagtcagtcccagcgtccatggatacctgatgtgcacaggactcctggctctccctacagccagagctgtgctgctgggggagagtgagctttttttttttttttttttgagatggagtcttgctccattgcccagtctagagtgtagcagcatgatctcggctcactgcaacctctgcctcccaggttcaagcaattctcctgtctcagcctcccaagtagcttggattacaggcacacgctgccacgcccagctaatttttgtattttcagtagagacggggtttcaccgtgttggtcaggctggtctccaacccctgacctcaggtgatccacctgcctcagcctcccaaagtgctgggattacaggtatgagccaccacccctggtccgagagtgagctcttgactgaggagcagaaggcctctctgatgcgacctcctgagtcagacctgttgatttggtgcagctgtcagacacggcatttctccagctgtgcgcagggagggaggccagagctcctggccgaggcagcactgcattttcagagtggaaacttggacaaaggaactgagtccaaccagggagtcagctccctgaggctccaggtgaaatgatggccctctaaggctacctggagttggaggaaactcttcctttttcccttcttctcttccaccccctcctcttccaaaaagggagttaatgtgggggaaagctgggtgtggtatattagtccgttttcatgctgctgataaagacatacctgagactgggcaatttacaaaggaaataggtttagtggagaacttacagttccacatggctggggaagcctcacaatcatgctgaaggcaaggaggagctggtcacatcttacacagatggcagcaggcaaagagaaagcatgtgcagggaaactctgccttataaagtcatcagctctcgtgagatttattcattatcatgagaacagcagcacaggaaagacccacccccatgattcattcatctcccactgggtccctcccacaactcgtgggaattatgggagctacaagatgagatttgggtggggacacagagtcaaaccataccactgggcttctgacatctgccctgcatttctttgcagatataaggcatcccggttctccgggaacttagtgttttcaatacacttcacctaccttctcagtcaggtttccaagcagaacacctggctccctgcagtgcagccccctaactctgtccccttgcccccgcatgtgcagatgaccaaggtagcccatcgagtctccgcgctggaagaacagcagttcctgatcattcatcccactgccgatggtaaggactgaaaacatgaattcactgtgtatctagtaagagcctcctccttgatggcaccatgggttttaacaaatgtcttcctctcttttttttttttttttttgcacagaaaaaattcatttccagcacacagcagaactcattacacaactaattaggggaaaggctaattacagcttacaggtacagtacgcatgttactctgttttgaacctggagcaagacattcctttcatggagaaagacctgacgggtgttcagggccttctactgcagcagacacgcctgtgctgtggtggtcggtgatgagcaaggtcccagcaggttggaaaatcagcacatgctcaacgttttcttataattaatgatagctccgctctgtacttcagcccggtttaaatccctttaggacaaccatctccccgtactcccaccccagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccagaactgaactcactttcccacaaccaacccgtggcccgtccacaacagcatcaagtgctgacccagcagcctcaaacctgggctcttcccagtaatgcacagggatgtctctggaaacttctgccatttccttcctgccttctgctcctttggtggaacaggtatgacccaatggtctcttcaggtccaacatgaatgaatgggagagctccttggggacagatgacaggcaggcaccctgcctccctcagagagctcttgccctgggctgatcactgccttggcctccagcatccctgcctgtgggagggagggaccacctgtgggcttgatcaggcagggagagctccagccagaagggagttggaccccagtgtggatgaagaggggcagaaggacggggttacaccacacttgagttcccttgtgaaagacgttcagatttcagactttttcaaagtaagtgtggcagttgcatggcagtgttaagcacactgaccatggacgctccaaaggtccatgtgtatgtgttcatgtgggcaactccccaagatatggggcgagctgaaccccccaggtacagagcagcctgcatcgctgcaggctccatgggtatcagggagcaggacccacccagggacacacatgtgggcacagcaaaggccttcacagacaccccatgcatctggagccaggcccagccccaggtaagagcacgggagacgggggcctgaggcaggaggagaaagcttcctgcccatatcctcttgtactacttgatgttttaatgacatatcatagcctaatgacagcattaataaatacttcaaaataaagatgaatttcaccctccaaaaacatacaaagaaggcaggaagaggcagtctagtgtcatagaaagatgtaggttttgggccagatgcagtggctcacacctgtagtccctgcactttgggaggctgaggtgcggggattgccttgagctcaggagtttgagaccagcctaggcaacagagcaagaccccatctctacaaaaagtttttagaaaatagccggacgtagtcatgtgtacctgtggtcccagctacacaggaggctgaagtgggagaatcacttgagcccaggaggttgaggctgcagtgagctatggtaacaccatggcattccagcctgggcgacagagtgagaccctgtctgaaaaagaaaagaaaaaaataagatgcaggctttgaatccctgcacgtgcacagatggttcacggtgctcctaggagatggtggcatcaccgcattggcagtagaataattagccatcatcctattggcatctgggaccgaatgagcccacattccaggcctcattctaagcacggcacggctataagattgtttaattctcacaaagtgtcatgagctggagtctgtgattatcctccccacccgacacacctggaatccgaggctcaggcaagttaacctccacagtcacacagggagtagccaggacgcaaaatctgtggggtgggcccgtgggcacccaggacagcacgcagcccttccacgggagtttcccacactcagagtgtaactgagagagcataggagtgtaatggcgcgatctcggctcacagcaacctccgcctcctgggttcaagtgattctcctacctcagcctcccgagtagctgggattacaggcacgccccaccatgcccagctaatttttgtatttttagtagagacacggttttaccgtgttggccaggctggtctcgaactcctgacctcaagtgatcctcccgcctcggcctgccaaagcactgggattacaggcatgaaattctatttcttttcagagcctgacaccctgaaaacttgggctgcggctctgtagtccctaagcttgtatccatgttgcaaattcaagcaagcagatccggactgtagagtgttgaatgaagagcttcccaatgttttcacccagttcccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttacca
